United States Patent 11,098,302 (IDENTIFICATION OF POLYNUCLEOTIDES ASSOCIATED WITH A SAMPLE) - sequence listing, part 54

SEQ ID NO: 184342 - DNA, 661 bp, Homo sapiens
  misc_feature: GYAE6OF02G69G9.51.71.G05.1.454.CMB.1.raw
  modified_base (252)..(252): a, c, t, g, unknown or other
  misc_feature (252)..(252): n is a, c, g, or t
  modified_base (522)..(522): a, c, t, g, unknown or other
  misc_feature (522)..(522): n is a, c, g, or t
tcagcgatcgtatacacgaccggtgctcgatttagtgtcgtcgcaagagagagggggtgggtccgaggaggcagaactctgggtgtctcaccatggcctggatcctctacttctcccctcctcactctctgcacaggctctgaggcctcctatgagctgacacagccacccgtcggtgtcagtcgtccccaggacagacggccaggactcacctgctcgtaggagatgactagttcgaaccctaaaccgatntacgtacttagtttcggaccgtagacaagtaacgggccggacccgtacgggtccccctggtaggtttcggtagtatgtaaagtaaaagcaacgtggaaggaccgtaccctgaagggtcctcccgtaggacgcgtactttctcgtcgaaccgttcgaggaccgaggggacctaacggtacacgtagttcggactagtaccgtaggtacggacgttaccgaggtacgaagacgggtacggaaggccgttagaacgttagtttaagttcgtanaacaactaagaacgtacaacctacgttaacggttaactttagtcggttagtttaccgaacgttcgaccgtaacggaacgttccgacccggttacgtcggttcaacgtccgaaccgccctaacccgcgttactcctaccg

SEQ ID NO: 184343 - DNA, 632 bp, Homo sapiens
  misc_feature: GYAE6OF02H3Q8L.51.71.G05.1.454.CMB.1.raw
  modified_base (558)..(558): a, c, t, g, unknown or other
  misc_feature (558)..(558): n is a, c, g, or t
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtcgtcagtcgtccccaggacagacgccaggatccacctgctctggagatgcattgaccaaacgatatgtcttagttggaccagcaggaacgccgggtcacggtcccttggtgttggtactagtacgtaaacgtaaagacctacgttacgaggacggtccctaggacgggtactccccgtaggacgtcgtacttcgtcgtacggccttcccggagtacggaaacgggtacgtaacggtcactacgtcgggacccagttacgaggttacgggacgtccgaaggcgtacggaagccgaggtctacgtacgtttacgttattgtacaacgtacgtaaacgacgtactaccgtagttacgtacgtttactcggttactacgtacganacgtaccgagtcgtccggttacgcggtaccacggtacccgaacggtacccgtaacccacgttccgtactacccg

SEQ ID NO: 184344 - DNA, 292 bp, Homo sapiens
  misc_feature: GYAE6OF02GSST1.51.71.G05.1.454.CMB.1.raw
  modified_base (276)..(276): a, c, t, g, unknown or other
  misc_feature (276)..(276): n is a, c, g, or t
  modified_base (281)..(292): a, c, t, g, unknown or other
  misc_feature (281)..(292): n is a, c, g, or t
tcagcgatcgtatacacgaccggtgctcgatttagtgtcgtcgcaagagagagggaactcgattacagcagccctcgaagaacatcatgatggctttgatatctggggccaagggacaatggtcattgtctcttcagcctccaccaaggcccatcggtccttccccctggcaccctcctccaagagccacctcgtgggggccacgacgcggcccgtgggctgccgtggtcaacggactacttcctcgtacgcactctgacggcggctggcaaggcncatgnnnnnnnnnnnn

SEQ ID NO: 184345 - DNA, 792 bp, Homo sapiens
  misc_feature: GYAE6OF02JJNEV.51.71.G05.1.454.CMB.1.raw
  modified_base (182)..(182): a, c, t, g, unknown or other
  misc_feature (182)..(182): n is a, c, g, or t
tcagcgatcgtatacacgaccggtgctcgatttagtgtcgtcgcaagagagagggggtggggtccgaggaggcagaactctgggtgtctcaccatggcctggatccctctacttctccccctcctcactctctgcacaggctctgaggccctcctatgagctgacacagcccaccctgggtntcagtcgtccccaggaccaggaccggctaggactcaccgtgccttcgtggagtatagtccaagtttcggacccaaaacccggtattaactcgtacgtttacgtttacgggtaaacccagtaccgaaggtaacggacccggggaccctaccgggcccccgttacggtgggttttcggtagggtagttaggttaaacttaaaacgggacctaccggttaacggaaccgggtaccgtacccggtaccgtacgggggtaaccttccccggttaggaccggtaaccggttctttaccgttaccggtcggtaccttacccggtacggtaacgtacggggacctaaacggggtactaacggtacgtccgggtacattcgacggttacggaggtcccgtaggaccgaggaaccgggtaggacggtacgtaacgttacttaacgtttagtacgtactaactaccgaagtaccggaacctaccgtaacgttacggttaacttagttcttacggtaccggtaagtcgtaccgaacgttaaccggtacccgtacggttccggtaccggtaccgacggttacccgaacccgtacccgtaaccccgacgttcgtaacccgtccg

SEQ ID NO: 184346 - DNA, 669 bp, Homo sapiens
  misc_feature: GYAE6OF02FUOEZ.51.71.G05.1.454.CMB.1.raw
tcagcgatcgtatacacgaccggtgctcgatttagtgtcgtcgcaagagagaggggggtgggtccagggaggcagaactctgggtgtctcaccatggcctggatccctctacttcctccccctcctcactctctgcacaggctctgaggcctcctatgagctgacacacgcccacccgtcggtgtcagtcgtccccgaggacacggaccggccgaggactccaccgtgctcgtggagatcgctagttcgaccaaaaccgatagtgtcttagttcggtaccagcaagaacggccgggaccgacggtcccctggttcgttggtagagttagtaagtaaacgacctacgtaggacggacggtccccgtagaacggggtacctaccccgtggaacggtccgtaactttccgtcgttacgggccttaccggacgggtacggacgggaacctaacgggtcaacgttacggttcgacctatcgaggtcggacgtcgaggtacaggacgggacgcggactagtaacttagtttagtcgtactacgtacaaacgtacaccgtacgtagttacgttactttattcgttccgttagtaactcgacccgtaacgtacggtccgtacccggttcgtcgggtaccacgtaccgaccgacccacccgtagtccgtaccttcccg

SEQ ID NO: 184347 - DNA, 582 bp, Homo sapiens
  misc_feature: GYAE6OF02F5D25.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcacgtgtccccaggacagacggccaggatcacctgctcgtggagatgcattcgaccaaaccgatatgcttattggtaccagcagaagccgggccaggcccctgtgttggtgatgtataaagacactgagaggccctgagggactccctgagcgacttctcgtggctccgaggtcagggacaacggtcactagttcgccatcgaggtggacgtccgaggtcaggacgggacgaggctggtaacttagtttattcgtactaatccaaactagaaccactagtttagttactttagtcgttcgttacggaacttcgaccgtaccgtaacggtcctaacccggttccgtacgggtccaacggaccccgaacggaccccaaacccctcgttccggaccttaaccccg

SEQ ID NO: 184348 - DNA, 666 bp, Homo sapiens
  misc_feature: GYAE6OF02G435K.51.71.G05.1.454.CMB.1.raw
  modified_base (225)..(225): a, c, t, g, unknown or other
  misc_feature (225)..(225): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctcgtgganatgcattgaccaaaccgatatgtacttattggtaccagcagaacgccgggccacggcccctgtgttggtcgatgtataaacgacactggaagacggccctacgagggctcccgtggacgcggtattcctcgtcgggtcctaccgagggtacgaaggggactaacgggtcaacgtagtttacgggacctagttcgaggtcgggtaacggtacccgtaggggaccgtaagggaaggggaaccggtacgggacgttaggaaacctttaagtttacgttacggttaactaaatcccgaaactaccgggaacctaacccgttaagtttacgggttaactttaacgttcggtttacgttacggtaaccgttggaccgtaacgtacggtccgtacccgttcgtcggtaccacgtacccgacggacccaacccgtattccgtactaccg

SEQ ID NO: 184349 - DNA, 568 bp, Homo sapiens
  misc_feature: GYAE6OF02GJ7TY.51.71.G05.1.454.CMB.1.raw
  modified_base (415)..(415): a, c, t, g, unknown or other
  misc_feature (415)..(415): n is a, c, g, or t
tcagcgatcgtatacacgaccggtgctcgatttagtgtcgtcgcaagagagaggggggtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcacctgctctggagatgcattgaccaaaccgatatgcttattgtaccagcagaagccgggccaggcccctgtgttggtgatgtataaagacacgtgagacggccctgagggactcccgtgacgcgattctctcggctaccgaggtcgagggacaacggtcacgattcggaccagtcagtggagtccgaaggcaggaggacggaggntggtaactagttattgtacaatcaacagaccaccgtagtttacggtaactttagtcgttacttacggtaactggaccgtacgaaggtccctaccggttccgttacgggccaacggtacccgaacggacccaaccccgacgtcgtacctacccg

SEQ ID NO: 184350 - DNA, 723 bp, Homo sapiens
  misc_feature: GYAE6OF02H4T7S.51.71.G05.1.454.CMB.1.raw
  modified_base (168)..(168): a, c, t, g, unknown or other
  misc_feature (168)..(168): n is a, c, g, or t
  modified_base (182)..(182): a, c, t, g, unknown or other
  misc_feature (182)..(182): n is a, c, g, or t
  modified_base (222)..(222): a, c, t, g, unknown or other
  misc_feature (222)..(222): n is a, c, g, or t
  modified_base (688)..(688): a, c, t, g, unknown or other
  misc_feature (688)..(688): n is a, c, g, or t
tcagcgatcgtatacacgaccggtgctcgatttagtgtcgtcgcaagagagaggggggtgggtccaggaggcagaactctgggtgtctcaccatggcctggatccctctacttctcccccctctcactctctgcacaggctctgaggcctcctaatgagtctgacacngcccacccgtggtntcagtcgtcccaggacagacgcaaggctccacctgctcgngggactatcgactacttcggaaccctaaaacgtattacgtcgtacgttttaacgtttcggaaccaaggacaacggaaccgcccgggaccgacggtccccgttggttacggttggtacgtagttaggtaaacgtaaaagacctacgtacggaacggtaaccggtcccgtaacgggtaacgggtaccttaccggtacggaacgtaccggttacttacggttccgtacgggtccgtaccgtagggtaccggaaacgggtaacctaaccggtactaacgtagttcgggaactacgtagtaacggtggtaacctaacggcggtaaccgaaggacggacgggacgtacgttactaagtttacgtttaacacggttaacaagttaccaaacgtacgaacctaacgtagttacgtttaactcgttcgtacgttaacgctaacgccgtaaccgtagtcgtaccggtctaggaccncgaaccgaaccgacccaacgtacgtccgaactccg

SEQ ID NO: 184351 - DNA, 538 bp, Homo sapiens
  misc_feature: GYAE6OF02G6DGH.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtggagatgcattgcccaaaccgatatgcttattggtaccagcagagccgggccaggcccctgtgttggtgatgtataaagacactgaggacggccctgagggtactccccgtgacggcgtacttctcgtggcctccgaggtcagggacaacggtcactagttcggcagtcagtggagtccgaggcaggaggacgaggctggacttattacttgtacaatcaacagacacctattggtacttagtgttacgtgactgaccgacgtaggtccaccgttccgtggtaccacgcccgaacggcccaaccccgactcgcctaccg

SEQ ID NO: 184352 - DNA, 703 bp, Homo sapiens
  misc_feature: GYAE6OF02IN2B2.51.71.G05.1.454.CMB.1.raw
  modified_base (232)..(232): a, c, t, g, unknown or other
  misc_feature (232)..(232): n is a, c, g, or t
tcagcgatcgtatacacgaccggtgctcgattttagtgtcgtcgcaagagagagggggtgggtccaggaggcataactctgggtgtctcaccatggcctggatccctctacttcctcccccctcctcactctctgcacaggctctggacgcctcctatgagctgacacacgcccacctcggtgtcgagtccgtcccgaggcagaccggccaggactcaccgtgcctgtgganatgactacgttccgaacccgtaaacgtatacgttcgtactttaagttacggtaaccgagaaccgaagaaccggcccggaccgaaccggtcccccgttggttcggttagggtgtacgtagttaaacgtaaaagaccgtacgtaggacgacggtacccctagacggtactcccgtgacgacgtcttcgtcgtacgtccgtacgacggtacgacggtacgtaactaccgtactacgttcgacgtagtacgacgttacgggacgtaacgacggagtaagggaaccggacgggacgtagtaacgttaagtttaccgttagtttacaacgttaacaccgaagaacgtaacgttacgtacgttagtttaacttagttcgttacgtaacgtacgttaccgactaacccggtagtcccgtaacgttccgcgtaccgaaccgtacccggaacgttaccccaaccgtactccgacttacccg

SEQ ID NO: 184353 - DNA, 775 bp, Homo sapiens
  misc_feature: GYAE6OF02HZPT1.51.71.G05.1.454.CMB.1.raw
  modified_base (244)..(244): a, c, t, g, unknown or other
  misc_feature (244)..(244): n is a, c, g, or t
tcagcgatcgtatacacgaccggtgctcgatttagtgtcgtcgcaagagagaggggggtgggtccaggaggcagaactctgggtgtctcaccatggcctggatccctctacttctcccctctacactctctgcacaggctctgacggcctcctatgagtctgaacacacgcccacccgtcggtcgtacagtcgtaccccgaggacacggaccggcgacggactccaccgtgctcgtaggacgtntacgacgtattcgaacccaaacgtacttagtcgttactttaacgttcggtaaccaggcgaacggaccggacccggaccgaccggtcccgttggttaccggttaggtcgtaagttagtaaacgtaaacgtacgtaacgttaggaacggtaccggtaccctacggacggtaccttacccgagggacgtaccgttacttaccgtcgtaccggttcgtaacccgggtaggtaccgggaaacgggtacgtaaccggtactacgttacggttaccggacttacggtacgtagggtaccgggtaaactcccgggaaggtacggaaacgggtaacgggtacggtacggtacgtaacggttaaccttttagttacgttacgtaacgaactaaccgaacgtacgaaccttacgtacgttaagttacgttacgttacgtacgttaaccgagttacgaccgtacggtaacgtccggttaccgtcggttaccgacgcccgtaaccgaccgtaaccccgtaaccgtacgttaccgaccttacccg

SEQ ID NO: 184354 - DNA, 806 bp, Homo sapiens
  misc_feature: GYAE6OF02F5WFE.51.71.G05.1.454.CMB.1.raw
  modified_base (229)..(229): a, c, t, g, unknown or other
  misc_feature (229)..(229): n is a, c, g, or t
tcagcgatcgtatacacgaccggtgctcgatttagtgtcgtcgcaagagagaggggggtgggtccaggaggcagaactctgggtgtctcaccatggcctggatccctaaactacttctccccctcctcactctctgcacaggctctgaggcctcctatgagctgacacagccaccctcggtgtcagtcgtccccaggacacgacggccaggatccacctgctcgtgganatgctattcgaccaaacgtatactgtcttattcggtaccagacaaggaacggcccgggaccgacgggcccccgttggttcggtttcggggtgtaagttaggttaaacgtaaaacggtaactaccgttagggaacgtacgggcccctacggaacggggtaccttccccggtaggtacgtacgtactttccgtacgtcgggtaccgtacccggtaacgggtccggaacggggtaaccgtaaaccggggttaccaacgttaacgttcgggaaccctacgtccgaagggtaccgggtacgtacccggaagggtacggaaacgggtaacgggaacgggtaacgggtacgttaagggttaactttaagttttacgtttcggttaaacctaaacgtaaccaaaccggaaacgtaaccctaacgttaaggtttacgtttaactttaacgttcgtttaccgttaacggtaaccgttacgtacccggaacctaacggggtccctaacccgggttccggtaaccgggtacgtaacccggccccaaaccggtacccccctaacccctacggttaccgtacctaaccccg

SEQ ID NO: 184355 - DNA, 797 bp, Homo sapiens
  misc_feature: GYAE6OF02G718C.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctctcactctctgccgaaaaaaaggctctgacggcctcctagtgacgctgacacgacgccctacccgtcggttgtccaggttccgtacccccgaaggaccgacggaccggccgaggtactccacccgttgccttacgtagggagattcggactaagttaccgaacccgaaaacgtgttacgtcgttacctttagttacggtaaccgacgacgaacggaaacggccccggggacccgaccgggtcccccgttggttcggtttgggtagtagttaaggttaaagtaaaacgaccgtagtacggacgggtaccggaccccgtaggtaacgggtacccttaccgtacggtacgtcgttaaccgtttccgtccggtcggtcctaccggtaacgggtaccggaacggggtaaccgtaaccggtaccacgttacgtacgccctagtacgtacggtacggtacggccgaaggacggacggaacgggacgacgggtacgttaggttaacttagtttagtacgtactacgtacaaacgacgtaacgacgttagttacgtttacgttagttcggttacgtaaccgtactacggaccgtaacgtacggttaacccgtccgtttaccggtcggtaacccgacccggtaacccggaacccgaccccgtaaccgtccgttaccgacttccccg

SEQ ID NO: 184356 - DNA, 410 bp, Homo sapiens
  misc_feature: GYAE6OF02GJ7O9.51.71.G05.1.454.CMB.1.raw
  modified_base (335)..(336): a, c, t, g, unknown or other
  misc_feature (335)..(336): n is a, c, g, or t
  modified_base (338)..(339): a, c, t, g, unknown or other
  misc_feature (338)..(339): n is a, c, g, or t
  modified_base (342)..(410): a, c, t, g, unknown or other
  misc_feature (342)..(410): n is a, c, g, or t
tcagcgatcgtatacacgaccggtgctcgatttagtgtcgtcgcaagagagagggaactcgattacagcagccctcgaagaacatcatgatggctttgatatcgtggggccaaagggacaagtggtcctagtttgtctcttcacgccctcccaccgaacgggcccagtccggtccttcccccctggccacccctcctaccaaagagtccaccgtcggtcgggggcacgacgcccggcccgtgggctcggcgttaggtcaaacggtacttaccttaccgtcgtacgcctaccgtgtacgacggtccgggtcgtacggacgacgccgtacaagtagnntnntcnnnnnnnnnnnnnnnnnnnnnnnnnnnnnnnnnnnnnnnnnnnnnnnnnnnnnnnnnnnnnnnnnnnnn

SEQ ID NO: 184357 - DNA, 617 bp, Homo sapiens
  misc_feature: GYAE6OF02J1BVO.51.71.G05.1.454.CMB.1.raw
  modified_base (136)..(136): a, c, t, g, unknown or other
  misc_feature (136)..(136): n is a, c, g, or t
  modified_base (152)..(152): a, c, t, g, unknown or other
  misc_feature (152)..(152): n is a, c, g, or t
  modified_base (155)..(155): a, c, t, g, unknown or other
  misc_feature (155)..(155): n is a, c, g, or t
  modified_base (157)..(157): a, c, t, g, unknown or other
  misc_feature (157)..(157): n is a, c, g, or t
  modified_base (249)..(249): a, c, t, g, unknown or other
  misc_feature (249)..(249): n is a, c, g, or t
  modified_base (251)..(251): a, c, t, g, unknown or other
  misc_feature (251)..(251): n is a, c, g, or t
  modified_base (391)..(391): a, c, t, g, unknown or other
  misc_feature (391)..(391): n is a, c, g, or t
  modified_base (459)..(459): a, c, t, g, unknown or other
  misc_feature (459)..(459): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctctcactctctgcacnggctctgagcctctangancngacactagccacccgtcggtgtaccagttcgccccgaggacagacggccaaggactcacctgctcgtaggagctgactattacgaccaacgntntcgtcttagtcgtaccagacacggacggcccggctacggcccctgtggttcggtagtatagtaagtaaacgtacacgtaaggtacgacggtccctacggagggactccgtagacgtcgtacttctcggtcgtacgtccgngtacgaggacgaccgtacactacgtacggctactcaggtcggaactcggacgacgaggaacgtacggngtctacgagttacttagttacgaactacacgtaacgacgaactagttaacgtacgttacttgtacgttccggtactaggtacacgtaacgtacgtactaccggtcctaggttacgccgtaactacccggaacccctaccgtacctccgtacctaccgg

SEQ ID NO: 184358 - DNA, 802 bp, Homo sapiens
  misc_feature: GYAE6OF02ICF1L.51.71.G05.1.454.CMB.1.raw
  modified_base (143)..(143): a, c, t, g, unknown or other
  misc_feature (143)..(143): n is a, c, g, or t
  modified_base (177)..(177): a, c, t, g, unknown or other
  misc_feature (177)..(177): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctctcactctctcgcacaggctcnggacggcctcctagtgacgctgacacacgacccnccgtcggtctacgtgtccgtccccgaggaccgagaccggccgaggactccgcctcgtctcgtggagacttggctagttccgaacctaaacggtatagttcgtactttacgttacggaacctagacgaacggtaccggccggggacccgtacccgggtcccgttgggttcggttcgggggtaagtagttaacggttaaaacggttaacggaaccttaacggtcggtaacggcccggtacctacgggaacggtacccgttccggtacggacgtacggtctttaccggtcggttacggccgtaccgtaggaccgaacgggtacgtaaacccgtcgaacctggttccgaacctacgtacgtggaccggtaccgtacggtacggcggaacggacggggtacgacgtacgttaacggttactttacgtttaagttaccggataaaccgtaggtaaaccgaccggttaaaccacccgtttagtttacgttacgttaacccggttcggttaacccggtaaccgtacgtttacccgaccggttaccggtaccggaccgtttaaccggtcgtccggttaccgaaccggccccgtaaccggtacccgacccgtttacgtccgtacccgtttccccg

SEQ ID NO: 184359 - DNA, 783 bp, Homo sapiens
  misc_feature: GYAE6OF02I1VVG.51.71.G05.1.454.CMB.1.raw
  modified_base (179)..(179): a, c, t, g, unknown or other
  misc_feature (179)..(179): n is a, c, g, or t
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctctatgagctagacacagccaccctcggtntcagtcgtcccgaggacagaccggcaggatcacctgctcngganatcacgtattcgaccaaaccggatatgtacttagttacggtacgagtcgaaggaccggccggccgtaccggtccccgtgttacggttcggttagtacgtagttaagtaaaccggacaacgtacggacgaccggtaccgtacggtacgggtacctacccgtacggtacggaccgtatttacgtacggtcgtaccgtacgtaacggtaccgaacgggtaaccgtaaccggtacctaacgttacggttacggaccgtaggtaccgtagggttaccggaacggttacccgaacgggacgtaaacgggacggggtaaaccggtacggtacgttacgttaacgttacgttttaacgttacgttaactaacgtaaccgtaacgaaaccggttacctaaccgttaaggtttacgtttaacttacgtttaacgttaccggtttaacgacgttacggaaccgttaaccggtacggttaacccgttaacccggttcggtaacccggttacgaacccggtaacccggtaccggaaaccccgtacccgttaccgttacggtacccttacccgg

SEQ ID NO: 184360 - DNA, 523 bp, Homo sapiens
  misc_feature: GYAE6OF01D7EZ3.37.57.F02.1.454.CMB.1.raw
  modified_base (522)..(523): a, c, t, g, unknown or other
  misc_feature (522)..(523): n is a, c, g, or t
tcagtagtgtagatcacgaccggtgctcgatttagctcgatatagttgggtctggggaggcctcgtccagcctggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaaagaactccgtgcatctgcaaaatgaacagtctgagagccgaggacacggctatttattactgcgcgagagaaggactgggcggtttcgactactgggggccaggggaaccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnn

SEQ ID NO: 184361 - DNA, 247 bp, Homo sapiens
  misc_feature: GYAE6OF01DE2XA.37.57.F02.1.454.CMB.1.raw
tcagtagtgtagatcacgaccggtgctcgatttagctcgatatagttgggtttgggacagacttcactctcaccatcagcagactggagcctgaagatttgcagtctatcactgtcagcagtatggtgactcaaagacgttcggccaagggaccaaggtggaaatgaaacgaactgtggctgcaccatctgtcttcatcttcccgccatctgaatctacacactgagcgggctggcaaggcgcatag

SEQ ID NO: 184362 - DNA, 522 bp, Homo sapiens
  misc_feature: GYAE6OF01BWL93.37.57.F02.1.454.CMB.1.raw
  modified_base (519)..(522): a, c, t, g, unknown or other
  misc_feature (519)..(522): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggctatttattactgcgcgagagaaggactgggcggtttcgactactggggccagggaaccctggtcaccgtctcctcagcctccaccaagggcccatcggtcttcccctggccgccctgctccaggagcacctccgagacgcacacgcggccctgggctgcctggtcaaggctactccatctacactactgagcgggctggcaaggcgcatagnnnn

SEQ ID NO: 184363 - DNA, 543 bp, Homo sapiens
  misc_feature: GYAE6OF01BLYH2.37.57.F02.1.454.CMB.1.raw
  modified_base (542)..(543): a, c, t, g, unknown or other
  misc_feature (542)..(543): n is a, c, g, or t
tcagtagtgtagatcacgaccggtgctcgatttagctcgatatagttgggtctggggaggcctcgtccagcctggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggctatttatactgcgcgagagaaggactgggcggtttcgactacgtggggccagggaaccctggcaccgtctcctcagcctccaccaaggcccatccggtcttccccctggccgcccctgcctccaggacgccaccctccgagacgcacacgccggccctgggcctcgccctgggtccaacggacttaccttccatctaacacctaactgacgtcgggctcggccaaggcgcatagcnn

SEQ ID NO: 184364 - DNA, 536 bp, Homo sapiens
  misc_feature: GYAE6OF01EDK94.37.57.F02.1.454.CMB.1.raw
  modified_base (430)..(430): a, c, t, g, unknown or other
  misc_feature (430)..(430): n is a, c, g, or t
  modified_base (525)..(525): a, c, t, g, unknown or other
  misc_feature (525)..(525): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctggggggtccctgagactctcctgtgtagcctctgaattcccctttacggcttattggatgagctgggtccgccaggctccgaggggaaggggctgggagtgggtggccaacataaagcaagatggaagtaagaaggagtatgtggactctgtgaagggcctttcaccatctccagagacaacgccaagaactccgtncatctgacaaatgaacagtctgagagccgaggacacggctatttatactgcgcgagagaaggactgggcgtttcgactacgtggggccaggggcncccgtggtacc

SEQ ID NO: 184365 - DNA, 545 bp, Homo sapiens
  misc_feature: GYAE6OF01AV0VS.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttcctgttgctattttggaaggtgtccagtgtgaggtgcaattggtggagtctgggggaggcctcgtccagcctggggggtccctgagactctcctgtgtagcctctgaattccccttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgagacacggctattatactgcgcgagaggaaggacgtggggcggtttcgacgttacgtcgggggaccaaggggacccctgggtcctacccgg

SEQ ID NO: 184366 - DNA, 528 bp, Homo sapiens
  misc_feature: GYAE6OF01AK826.37.57.F02.1.454.CMB.1.raw
  modified_base (467)..(467): a, c, t, g, unknown or other
  misc_feature (467)..(467): n is a, c, g, or t
  modified_base (481)..(481): a, c, t, g, unknown or other
  misc_feature (481)..(481): n is a, c, g, or t
  modified_base (525)..(525): a, c, t, g, unknown or other
  misc_feature (525)..(525): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctggggggtccctgagactctcctgtgtagcctctgaattcccctttacggcttattggatgagctgggtccgccagggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccggagacacggntatttatactgcgngagagaggactgggcgtttgactacgtgggcagggaccctggcnccg

SEQ ID NO: 184367 - DNA, 504 bp, Homo sapiens
  misc_feature: GYAE6OF01AR75V.37.57.F02.1.454.CMB.1.raw
  modified_base (494)..(504): a, c, t, g, unknown or other
  misc_feature (494)..(504): n is a, c, g, or t
tcagtagtgtagatcacgaccggtgctcgatttagctcgatatagttgggtttgggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggctatttattactgcgcgagagaaggactgggcggtttcgactactggggccagggaaccctggtcaccgtctcctcagcctcaccaagggcccatcggtcttcccctggcgccctgctccaggacgcacctccgagagcacagcggccctgggcctgcctggcaaggctacttccatctacactactgagcggctggcaaggcgcatagnnnnnnnnnnn

SEQ ID NO: 184368 - DNA, 544 bp, Homo sapiens
  misc_feature: GYAE6OF01EAW0J.37.57.F02.1.454.CMB.1.raw
  modified_base (384)..(384): a, c, t, g, unknown or other
  misc_feature (384)..(384): n is a, c, g, or t
  modified_base (416)..(416): a, c, t, g, unknown or other
  misc_feature (416)..(416): n is a, c, g, or t
  modified_base (427)..(427): a, c, t, g, unknown or other
  misc_feature (427)..(427): n is a, c, g, or t
  modified_base (541)..(542): a, c, t, g, unknown or other
  misc_feature (541)..(542): n is a, c, g, or t
  modified_base (544)..(544): a, c, t, g, unknown or other
  misc_feature (544)..(544): n is a, c, g, or t
tcagtagtgtagatcacgaccggtgctcgatttagctcgatatagttgggtctgggggaggcctcgtccagcctgggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggctatttatactgcgcgagagaaggactgggcggtttcgactacgtggggccagggaaccctggtcaccgtctcctcncgcctccaccaggcccatccgtctcccctgcnccctgctcagngccacctccgagcgcacacgcggcccgtgggcctcgcccgtggtacgaacggtacctaccgttccactcctacacctacgtggacggcgggcgtggccgaagggcgaccatagnngn

SEQ ID NO: 184369 - DNA, 542 bp, Homo sapiens
  misc_feature: GYAE6OF01AZH7Y.37.57.F02.1.454.CMB.1.raw
  modified_base (342)..(342): a, c, t, g, unknown or other
  misc_feature (342)..(342): n is a, c, g, or t
  modified_base (436)..(436): a, c, t, g, unknown or other
  misc_feature (436)..(436): n is a, c, g, or t
  modified_base (476)..(476): a, c, t, g, unknown or other
  misc_feature (476)..(476): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagccgtggggggtccctgagactctcctgtgtagcctctgtaacttcccctttacggcttattggatgagctgggtccgccaggctccgagggaggggctggagtgggtgccaanataaagcaagataggaagtaagaaggagtagtggtggactctggtggaagggtccgtttcacctatcctccgagagacaacgctaaagactcgngcatctagacaatgaacagtctgagagaccgagacacggntattatactgcgagaggagaggcgtgggcgttcgacgtacggtgggaccacgggccctggtacccg

SEQ ID NO: 184370 - DNA, 547 bp, Homo sapiens
  misc_feature: GYAE6OF01CMPFS.37.57.F02.1.454.CMB.1.raw
  modified_base (306)..(306): a, c, t, g, unknown or other
  misc_feature (306)..(306): n is a, c, g, or t
  modified_base (343)..(343): a, c, t, g, unknown or other
  misc_feature (343)..(343): n is a, c, g, or t
  modified_base (432)..(432): a, c, t, g, unknown or other
  misc_feature (432)..(432): n is a, c, g, or t
  modified_base (541)..(541): a, c, t, g, unknown or other
  misc_feature (541)..(541): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctatttggaaggtgtccagtgtgaggtgcaattggtggagtcgtggggggaggcctcgtccagccgtggggggtccccagactctcctgtgtagcctctgaacttcccctttacggcttattggatgagctgggtccnccaggctccgagggaggggctggagtgggtggccaanataaaagcaagatggaaagtaagaaggagtatggtggactctgtgaacgggtcctttcaccatctccagagacaacgccaagaactcgngcatctgacaaatgaacagtctagagagacgaggacacggacttattatactgcgcgagagaaggacgtgggcgttcgactacggcggggaccacgggaccctggtccncggtcc

SEQ ID NO: 184371 - DNA, 224 bp, Homo sapiens
  misc_feature: GYAE6OF01B77NG.37.57.F02.1.454.CMB.1.raw
  modified_base (219)..(224): a, c, t, g, unknown or other
  misc_feature (219)..(224): n is a, c, g, or t
tcagtagtgtagatcacgaccggtgctcgatttagctcgatatagttgggtctgggctgagctgggctaagctggacctggctgggcctccaccaagggcccatcggtcttcccctggcgccctgctccaggagcacctccgagagcacagcggcctgggctgcctggtcaaggactacttccatctacactactgagcgggctggcaaggcgcatagnnnnnn

SEQ ID NO: 184372 - DNA, 504 bp, Homo sapiens
  misc_feature: GYAE6OF01ENUUU.37.57.F02.1.454.CMB.1.raw
  modified_base (498)..(504): a, c, t, g, unknown or other
  misc_feature (498)..(504): n is a, c, g, or t
tcagtagtgtagatcacgaccggtgctcgatttagctcgatatagttgggtttggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaaatgaacagtctgagagccgaggacacggctatttatactgcgcgagagaaggactgggcggtttcgactactgggccagggaaccctggtcaccgtctcctcagcctcaccaagggcccatcggtcttccccctggccgccctgctccaggagcacctccgagagcacagccggccctgggctgcctggtcaaggactacttccatctacactactgagcgggctggcaaggcgcatagnnnnnnn

SEQ ID NO: 184373 - DNA, 595 bp, Homo sapiens
  misc_feature: GYAE6OF01AFD9L.37.57.F02.1.454.CMB.1.raw
  modified_base (271)..(271): a, c, t, g, unknown or other
  misc_feature (271)..(271): n is a, c, g, or t
  modified_base (314)..(314): a, c, t, g, unknown or other
  misc_feature (314)..(314): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (383)..(383): a, c, t, g, unknown or other
  misc_feature (383)..(383): n is a, c, g, or t
  modified_base (497)..(497): a, c, t, g, unknown or other
  misc_feature (497)..(497): n is a, c, g, or t
  modified_base (512)..(512): a, c, t, g, unknown or other
  misc_feature (512)..(512): n is a, c, g, or t
tcagtagtgtagatcacgaccggtgctcgatttagctcgatatagttgggtttgggggtcgtcagagaggagccttagccctggactccaaggcctttccacttggtgatcagcactgagcacagaggactcaccatggaattggggctgagctgggtttccttgttgctattttggaggtgtccagtgtgaggtgcaattggtggagtcgtggggggaggcctcggtccagcccgtagggggtcccctggagactctcctgtgtagcctntgaactttcccctttacggctttattggatgagcgtgggtccnccgaggcctccgaggggaaggggctgggagtgggtggccaanataaagcaagntaggaagtaagaaggngtactggtggactgtgtgaagggtccgtttcaccatctaccagacgacaacgccaaagactccgagcatctgacaaatgaactagtctgaagacggccgaagggaccacgggtnttaagtttactacgngccgcgaacggaggaaacggcgtggggtccggtttacgacgtacgtcgggggacccaggggtaacccctgggtcctaacccgg

SEQ ID NO: 184374 - DNA, 530 bp, Homo sapiens
  misc_feature: GYAE6OF01CYPV5.37.57.F02.1.454.CMB.1.raw
  modified_base (499)..(499): a, c, t, g, unknown or other
  misc_feature (499)..(499): n is a, c, g, or t
  modified_base (504)..(504): a, c, t, g, unknown or other
  misc_feature (504)..(504): n is a, c, g, or t
  modified_base (521)..(521): a, c, t, g, unknown or other
  misc_feature (521)..(521): n is a, c, g, or t
  modified_base (527)..(530): a, c, t, g, unknown or other
  misc_feature (527)..(530): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggctattatactgcgcgagagaaggactgggcgtttcgactacgtggggccagggaaccctggcaccgtctcctcacgccctccaaccgaagggccccagtccgtccttccccctggccgcccctcgcctccaggacgccacctccgagagcacagccggcctgggctcgcctggtcaaggactactcatctacnctacngagcggctggcaaggcncatagnnnn

SEQ ID NO: 184375 - DNA, 621 bp, Homo sapiens
  misc_feature: GYAE6OF01BM4NY.37.57.F02.1.454.CMB.1.raw
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggctatttatactgcgcgagagaaggactggggtcgtttcgacgtacgtgggggccaggggaaccctgggtccaccgtctcctcacgccctccaaccgaacgggcccagtcccggtccttcccccgtcggccgcccctgccctccgaggcgcccaccgtccgacgacgccgacgacggcccggcccgtgggcctcggcccgttcgggtaccgaaacgggtaccttaccgttacccgaacgttaccctaaccgtacctaaccgttcggaacgggtcccggggtacgtcgggaccgaaacgggccgacgagtagctgca

SEQ ID NO: 184376 - DNA, 505 bp, Homo sapiens
  misc_feature: GYAE6OF01AMFUP.37.57.F02.1.454.CMB.1.raw
  modified_base (496)..(505): a, c, t, g, unknown or other
  misc_feature (496)..(505): n is a, c, g, or t
tcagtagtgtagatcacgaccggtgctcgatttagctcgatatagttgggtttggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagtcgaggacacggccatgtattactgtacgagagaacagacttggggccagggaaccctggtcaccgtctcctcagcctccaccaagggcccatcggtcttcccccgtggccgccctgcctccaggacgcaccctccgagacgcacacgccggcccgtgggcctgcccgtggtccaaggactacttccatcctacactactgacgcggctggcaggcgcatagnnnnnnnnnn

SEQ ID NO: 184377 - DNA, 553 bp, Homo sapiens
  misc_feature: GYAE6OF01C682L.37.57.F02.1.454.CMB.1.raw
  modified_base (548)..(548): a, c, t, g, unknown or other
  misc_feature (548)..(548): n is a, c, g, or t
  modified_base (552)..(553): a, c, t, g, unknown or other
  misc_feature (552)..(553): n is a, c, g, or t
tcagtagtgtagatcacgaccggtgctcgatttagctcgatatagttgggtttggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaaatgaacagtctgagagccgaggacacggccctatattactgtacgaaaatggcctacggatatgactactattgggactggtacttcgatctcgtggggccgtggcaccctggtcactgtctcctcagcctccaccaacgggcccatccgtccttccccctggcccgccctcgctcccgaggacgcaccctccgagacgcacgacgccggccctggggcctcggccctggtaccaacggtcctacttccactcctaccactactgacggcgggcgtcggctaacgggcanatgnn

SEQ ID NO: 184378 - DNA, 575 bp, Homo sapiens
  misc_feature: GYAE6OF01C3CXL.37.57.F02.1.454.CMB.1.raw
  modified_base (276)..(276): a, c, t, g, unknown or other
  misc_feature (276)..(276): n is a, c, g, or t
  modified_base (546)..(546): a, c, t, g, unknown or other
  misc_feature (546)..(546): n is a, c, g, or t
tcagtagtgtagatcacgaccggtgctcgatttagctcgatatagttgggtctgggggaagggcctcgtccacgcctgggggggtccctgagacctctccttgtgtagcctctgaattcccctttgacaagtgtgccatcgacctgggtccgccaggctccagggaagggcttggagtgggttctcagtttattagtggtagtgggtagtagcacgaggaggttacgcagactccggtgaagggccggttcaccatctccagagacaattccaacngcacgctgtatttgcacatgaacagcctgagagccgaggacacgggccatatattattgtgcgtaaacttccttttgactggttaattatcccctagtgaccacgtggggccagggaaccctggtcaccggtctcctcacgcctccaccaaggcccagtccgtcttccccgtggccaccctcctaccaagtacgccacctcgtcggggccacgcgccggccccgtgggcctcgccttggtcaacggactactcctatccgtacacttacngacggcggcgttggacaggcgcgagtacg

SEQ ID NO: 184379 - DNA, 578 bp, Homo sapiens
  misc_feature: GYAE6OF01DIYYC.37.57.F02.1.454.CMB.1.raw
  modified_base (413)..(413): a, c, t, g, unknown or other
  misc_feature (413)..(413): n is a, c, g, or t
  modified_base (573)..(573): a, c, t, g, unknown or other
  misc_feature (573)..(573): n is a, c, g, or t
tcagtagtgtagatcacgaccggtgctcgatttagctcgatatagttgggtttgggggtccctgagactctcctgtgtagcctctgaattcccctttacggcttattggatgagctgggtccgccaggctccaggggaaggggctggagtgggtggccaacataaagcaagatggaaagtaagaaggagtatgtggactctgtgaagggccgtttcaccatctccagagacaacgcccagaactcattgtatctgcaaaatgaacagactgagagccgaggacacggctgtgtattactgtgcgagagaggaggcgtattaggtagtaaaagtggacgtgggccctttcgtaacttactaacctaactacagtggacgtcgtgggacaaagggaccacggtcaccgtctcctnacgcctccaccacggccacgtcgtccttccccgcggccaccctcctccaacgacgccgaccgtcgtcggggaccacgacggccggcccgtgggcctcgctacggtcaacggtactacttccagtacctacactcgtcgaggccggcgtacggagacgcgngtacg

SEQ ID NO: 184380 - DNA, 835 bp, Homo sapiens
  misc_feature: GYAE6OF01EAQDB.37.57.F02.1.454.CMB.1.raw
  modified_base (119)..(119): a, c, t, g, unknown or other
  misc_feature (119)..(119): n is a, c, g, or t
tcagtagtgtagatcacgaccggtgctcgatttagctcgatatagttgggtttgggggtctcagagaggagccttagccctggactccaaggcctttccacttggtgatcagcactgancacagagactcacagtaggtaggttgggctgagtcggtttcggttttccgttgttcgtactttagttttagggtaaggttcgtacgtaggttggtggtaggtcgacttaagtttgggtaggtacggttcgggtagggggacgtcccgttccgtaccgacgtccgggtcggggtcctggacgtcctctcgtgtagtccgccttcgtaacgtacccttttccccggtttaggtctttaggtgtagtaggtacgtccggttcgggccccacgacggtccgtaaccggggaagggggtacgggcgtaggggtggttcggggaccaaaccaaagtaaaagtaaccggaagaaaggtaggtaaagggaaaaggtaaggaaacggttagttaacggtgggtacgtacgttggtagggaacgggtaccggtttcccttacgaacttacgtccgtaacgacgaaccgaaccgaaccgtaacgtaaacgtaccgtcgtgaacctgttacggacgaaacgtaaatacggtaacttacggtaccgaggaacgacccggaaccggtaacgaccggttaacgttacttttaacgttaacgtcggacgtaccgggaagaaccggttaagggtaaccgggtgggttacccggggtttcgttaaaccggaccggtaccggggggtccggtaaacccggggtaaccggttaccccgtggtccccggttaacccc

SEQ ID NO: 184381 - DNA, 632 bp, Homo sapiens
  misc_feature: GYAE6OF01BVZWF.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggagcctcgtccagccgtggggggtccctgagactctcctgtgtagcctctgaacttcccctttacggcttattggatgagctgggtccgccaggctccgaggggagggctgggagtgggtggccaacataaagcaagataggaagtaagaaggagtagtgtggactcgtgtaggaagggtccgtttacacctatctccagacgacaacgccaaagaacctccgagcatctgactaaatcgaaactagtcgtagaagacgaccggaagggaccacggtacttaagtttacttaacgtggtaccggacgtaaggaacgggaaacgggtacgttcgggggttaccggttttaccgaaccgttaccggtcggggggaccctaacgggggtaaacccccttggggtacccctaaccccggg

SEQ ID NO: 184382 - DNA, 590 bp, Homo sapiens
  misc_feature: GYAE6OF01CTPN3.37.57.F02.1.454.CMB.1.raw
  modified_base (587)..(590): a, c, t, g, unknown or other
  misc_feature (587)..(590): n is a, c, g, or t
tcagtagtgtagatcacgaccggtgctcgatttagctcgatatagttgggtctgggggaggcctcgtccagcctgggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggcttatttatactgcgcgagagaaggcgtgggcgtttcgactacgtcggggccagggaccctggtccaccgtctcctcacgccctaccaccgaacgggcccagtccgtcccttccccgtcggccgtccccgtcgccctccgaggacgccaccctccgacgacgaccacgacggccgcccgtcgggcctcggtcccgtcgggtaccgaacggtaccttaccgttaccactcctaaccacctacgtcggacggccgggcgtcggaccgaagggcgacagtagnnnn

SEQ ID NO: 184383 - DNA, 577 bp, Homo sapiens
  misc_feature: GYAE6OF01CQ7P2.37.57.F02.1.454.CMB.1.raw
  modified_base (573)..(574): a, c, t, g, unknown or other
  misc_feature (573)..(574): n is a, c, g, or t
  modified_base (576)..(577): a, c, t, g, unknown or other
  misc_feature (576)..(577): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaaggggctggagtgggtggccaaacataaagcaagatggaagtaagaaggagtatgtggactctgtgaagggccgtttcaccatctccagagacaacgccaagaactccgtgcatctgcaaatgaacagtctgagagccgagacacggctatttattactgcgcgagagaaggacgtgggcgtttcgactacgtcggggccagggaaccctggtccaccgtctcctcagcctccaccgagggccccatccggtccttcccccgtcggccgccctcgcctccgaggacgccaccctccgacgacgccacgacgccggccccgtcgggcctcggcccgttgggtccaacgggtaccttaccttccaacttcctaccacctacgtgacggcgggcgtcggacgaagggcgacagtagnngnn

SEQ ID NO: 184384 - DNA, 629 bp, Homo sapiens
  misc_feature: GYAE6OF01BZSLC.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtgggggtccctgagactctcctgtgtagcctctgaactttcccctttacggcttattggatgagctgggtccgcaggctccgagggaggggctggagtgggtggccaacagtaaagcaagagtaggaagtaagaaggagtagtgtggactcgtaggtaggaagggtcccgtttacaacctattcctccgaagacgaaccaaaccgacccgaaacgaaccgtccgtagacctatctagacaaagtcgaacagtctaggagacggaccggaaggaccaacggtcttacttttaagttaccgtagaccgacggaaggaacggaacgggtacgttgggggaccgttttacggaacgttacggtacgggggacccgtaacggggtaccccgtgggtacccg

SEQ ID NO: 184385 - DNA, 541 bp, Homo sapiens
  misc_feature: GYAE6OF01BN7G2.37.57.F02.1.454.CMB.1.raw
  modified_base (379)..(379): a, c, t, g, unknown or other
  misc_feature (379)..(379): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagcagtggggggtccctgagactctcctgtgcagcctctggattcaactttggtagctattggatggactgggtccgcagtctccgagggaaggggctgggagtgggtggccaaacatacgaggggaggtgggtggtaacgaaaaaactntgtggactctgtgcggggccattcaccatctccagagacaaacgaccaaaaactcaactgtatctgacaaagtggacggcctggagagtccgagggacacgggctggtgtattattgtgcgagagtatttagactacaaagtttcgagtagatggtatgtag

SEQ ID NO: 184386 - DNA, 566 bp, Homo sapiens
  misc_feature: GYAE6OF01EBIPP.37.57.F02.1.454.CMB.1.raw
  modified_base (378)..(378): a, c, t, g, unknown or other
  misc_feature (378)..(378): n is a, c, g, or t
  modified_base (470)..(470): a, c, t, g, unknown or other
  misc_feature (470)..(470): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgcttattttggaaggtgtccagtgtgaggtgcaattggtggagtcgtgggggaggcctcgtccagccgtggggggtccctgagactctcctgtgcagcctctggttcattctttagcaactacgccatgagctgggtccgccgaggcctccggaggggaacggggctgggagttgggtctcgaggttattacgtggtagtggtaataccgnatactacgcagactccgtggacgggtccgttcaccgtctccgagacgactaacttaccaaagtaactcggtacttatcgtaggaaatgaacngtctaggacgacgccgaaggaccaccggccctataacttactggtgacgagaagagtcgaaggacggtaagatagctaagcagtctcgtgtaaccg

SEQ ID NO: 184387 - DNA, 621 bp, Homo sapiens
  misc_feature: GYAE6OF01BK9HT.37.57.F02.1.454.CMB.1.raw
  modified_base (452)..(452): a, c, t, g, unknown or other
  misc_feature (452)..(452): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaggtgtccagtgtgaggtgcattggtggagtcgtgggggagcctcgtccagccgtggggggtccctgagactctcctgtgtagcctctgaactttcccctttacggctttattggatgagcgtgggtccgcaggctccgaggggacgggcgtggaggtgggtcggccaaacagtaaagcaaaggagtagggaaagtaaggaaagggtagtagtggtggactctggtggaacgggtcctttcgactagtctccagagaccaacgcaagacctcgtnactatctagacaaatgaaactagtctgaagacggaccggaaggacacgggtattacgtttatacgtggacgacgtaagggagtaacgggtacggtcggggttcggtttacgaacccgttacgggcggggggtacccaacggggtaacccgttgggcccgttaaccccgg

SEQ ID NO: 184388 - DNA, 605 bp, Homo sapiens
  misc_feature: GYAE6OF01B9Y7V.37.57.F02.1.454.CMB.1.raw
tcagtagtgtagatcacgaccggtgctcgatttagctcgatatagttggggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccaggccgtggggggtccctgagactctcctgtgtagcctctgaacttcccctttacggcttattggatgagcgtgggtcccgccaggcctccgaggggaaggggcgtgggaggtggggtcggaccaaacaagtaaaaggcaaaggatagggaaagtaaaggaaggagtatggtaggactcgtggtaggaacgggtccgtttcaccatctaccagaacgacaacgaccaaagaactccgagacatctgacaaatgaacagtctagagacgccggaaggacgacggtcttatttatacgtgcgacgagaaggaacggagtggggtcggtttacgacgttacggtcggggaccgaagggtacccctgggtccctacccg

SEQ ID NO: 184389 - DNA, 619 bp, Homo sapiens
  misc_feature: GYAE6OF01ESXVE.37.57.F02.1.454.CMB.1.raw
  modified_base (348)..(348): a, c, t, g, unknown or other
  misc_feature (348)..(348): n is a, c, g, or t
  modified_base (472)..(472): a, c, t, g, unknown or other
  misc_feature (472)..(472): n is a, c, g, or t
  modified_base (516)..(516): a, c, t, g, unknown or other
  misc_feature (516)..(516): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagcttgggttttccttgttgctattttggaagtgtccagtgtgaggtgcaattggtggagtcgtgggggagcctcgtccagccgtgggggtccctgagactctcctgtgtagcctctgaactttccccttaggcttattggatgagcgtgggtccgccaggcctccggaggggaggggctgggaggtgggtggaccaaanagtaaaagcaagataggaaagtaaggaaggagtatggtggactcgtggtagaaggtcctttacacctatctaccagacgaacaacgccaaagacctccgtgcatctgacaaatcgaactgtacnggaacgacgaccggaggaccacggtactttaagtttacgtacgnggaccggacgaaggaacgtaagggtaccggttgggggttaccggtttacgaaccgttcgggtaccgggggaccgtaaccggggtaaccccgtgggtaaccccg

SEQ ID NO: 184390 - DNA, 525 bp, Homo sapiens
  misc_feature: GYAE6OF01A8S9X.37.57.F02.1.454.CMB.1.raw
  modified_base (516)..(525): a, c, t, g, unknown or other
  misc_feature (516)..(525): n is a, c, g, or t
tcagtagtgtagatcacgaccggtgctcgatttagctcgatatagttgggtttggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggctatttattactgcgcgagagaaggactgggcggtttcgactacgtggggccagggaaccctggtcaccgtctcctcagcctccaccaagggccccatccggtccttccccctggccgcccctgcctcccaggacgccacccgtccgagacgccaacagcccggcccctggggctcgcctggtcaaggctactccatctacactactgacgcggctggcaggcgcagtagnnnnnnnnnn

SEQ ID NO: 184391 - DNA, 667 bp, Homo sapiens
  misc_feature: GYAE6OF01CILFE.37.57.F02.1.454.CMB.1.raw
  modified_base (336)..(336): a, c, t, g, unknown or other
  misc_feature (336)..(336): n is a, c, g, or t
  modified_base (655)..(655): a, c, t, g, unknown or other
  misc_feature (655)..(655): n is a, c, g, or t
  modified_base (664)..(667): a, c, t, g, unknown or other
  misc_feature (664)..(667): n is a, c, g, or t
tcagtagtgtagatcacgaccggtgctcgatttagctcgatatagttgggtctgggggaggcctcgtccagcctggggggtccctgagactctccctgtagctcctgattaccctttaccggtacgttatttggtagtgtaggcgtcgggtccggcccacggaccgtcccacgggaaagggggacggtggtaggtgggtggggcccgaaaccaataaaagaacgaagaataggaaggtaaagaaaggaaggtatgtggacgtctgtggaagggaccggtttcctaccactctccacgagaacaaccgaccaagaaacgtaccgtcgcatacttcgnaaaactaagaacaagtctgagagccggaggtaacacggacgttattttaatttactaggcgcgagaagaaggacgtgggcgggtttcgacacgtacgggccgaacggaaccgtcgtcacccgtcttcctcgacgcctcccaaccgaaacgggcccactcggttcccgttccccttccggccggcccctcgtctcccacggacgccaccctacccggagacgccaccgacgccggccccgtgggctcgcctcggtacgaacggtaccttacttccgtacacttaccacgtactggacggccgggctggccgaaaggccgnaactagacnnnn

SEQ ID NO: 184392 - DNA, 579 bp, Homo sapiens
  misc_feature: GYAE6OF01DPCWC.37.57.F02.1.454.CMB.1.raw
  modified_base (568)..(579): a, c, t, g, unknown or other
  misc_feature (568)..(579): n is a, c, g, or t
tcagtagtgtagatcacgaccggtgctcgatttagctcgatatagttgggtttggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggctatttattactgcgcgagagaaggacgtgggcggtttcgactacgtggggccagggaaccctggtccaccgtctcctcacgcctccaccgaacgggcccacgtccggtcccttcccccgtggccgcccctgcctccgacggacgcccaccgtccgaagacgcaaccaggcccggcccgtggggcctcggcccgttcgggtacaacgggtaaccttaccgttacctacttcctaaccaccttactggacggccgggtcgtcgggcgaaaggccgacgaatagnnnnnnnnnnnn

SEQ ID NO: 184393 - DNA, 605 bp, Homo sapiens
  misc_feature: GYAE6OF01AZ4IM.37.57.F02.1.454.CMB.1.raw
  modified_base (245)..(245): a, c, t, g, unknown or other
  misc_feature (245)..(245): n is a, c, g, or t
  modified_base (589)..(589): a, c, t, g, unknown or other
  misc_feature (589)..(589): n is a, c, g, or t
  modified_base (599)..(601): a, c, t, g, unknown or other
  misc_feature (599)..(601): n is a, c, g, or t
  modified_base (603)..(605): a, c, t, g, unknown or other
  misc_feature (603)..(605): n is a, c, g, or t
tcagtagtgtagatcacgaccggtgctcgatttagctcgatatagttgggtttgggggtccctgagactctcctgtgtagcctctgaattcccctttacggcttattggatgagctgggtccgccaggctccagggaagggctggagtgggtggccaacataaagcaagatggaagtaagaaggagtatgtggactctgtgaaggccgtttcaccatctccagagacaacgccaagaactccgtncatctgcaaatgaacagtctgagagccgaggacacggctatttattactgcgcgagagaaggacgtggcggtttcgactacgtggggccagggaaccctggtcaccgtctcctcacgcctccaccaacgggcccatccggtccttccccccgtggccgccctggccctccgagggcgaccaccctccggaacgacgaccacgacgtccggccccgtgggaccctggccctgggtaccaacgggtacctttaccgttacccaacttcccgttaacctaaccgttaccgtacggtacgggccgggtccgttgggacccaaagggcccggaacgtaccgtaaggccncgcgcgcgcnnncnnn

SEQ ID NO: 184394 - DNA, 606 bp, Homo sapiens
  misc_feature: GYAE6OF01AIC4G.37.57.F02.1.454.CMB.1.raw
  modified_base (494)..(494): a, c, t, g, unknown or other
  misc_feature (494)..(494): n is a, c, g, or t
  modified_base (525)..(525): a, c, t, g, unknown or other
  misc_feature (525)..(525): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtgggggtccctgagactctcctgtgtagcctctgaacttcccctttacggcttattggatgagcgtcgggtccgccaggctccgaggggaacggggctggggagtggggtcggacccaaacaagtaaagcaaggagtagggaaaggtaagaagggagtagtggtgggactcgtggtaggaacggggtccgtttacacctatcctaccgaagaacgaaccaacgaccaaagtaacctccgtagcatctagacaaatgaacngtcagagacgcgagacacgtcttattactcngcgcgaagaggaacggtgtaggggtccggtttacgacgttacggtcggggacccaaggggaccccttgggtccctacccgg

SEQ ID NO: 184395 - DNA, 633 bp, Homo sapiens
  misc_feature: GYAE6OF01ANBMI.37.57.F02.1.454.CMB.1.raw
  modified_base (554)..(554): a, c, t, g, unknown or other
  misc_feature (554)..(554): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctggttttccttgttgctattttggaagtgtcagtgtgaggtgcaattggtggagtcgtgggggagcctcgtccaggccgtgggggtccctgacgactctcctgtgtagcctctgaactttccccgtttacggctttagttggatgagtcgtgggtcccgccgaggcctaccgaggggaacgggcgtgggaggtgggtacggccaacgagtaaagcaagatagggaaagtaagaaggtagtagtggtaggtactgtgtcggaagggtcccgtttacacctatccgtacgaaggtacgaccaaacgccaaacgtaacctccggtagacctactcgtagaactaaagtacgaaactgtcgagtacgacgccggaacggaccgaccggtattaagtttacgtacgngtaccgagaggaggtaacggtcgtgggtccgttacgacgttacggtcggggacctacgggaccctgggtccctacccgg

SEQ ID NO: 184396 - DNA, 594 bp, Homo sapiens
  misc_feature: GYAE6OF01DWHY3.37.57.F02.1.454.CMB.1.raw
  modified_base (287)..(287): a, c, t, g, unknown or other
  misc_feature (287)..(287): n is a, c, g, or t
  modified_base (381)..(381): a, c, t, g, unknown or other
  misc_feature (381)..(381): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttagaaggtgtccagtgtgacgtgcaactgggtggagtcgtgggggaggcttggtccaggccgtggggggtccctggagactctcctgtgcagcctctggattcaactttggtanctattggatggactgggtccgccagtctccgagggaaggggctggagtgggtggccaaacatacgaggggaggtggtagggaacgaaaaaactntgtaggactgtgtgcggggccattccgaccatcctccaagacgaacaaaccgaccaaaaactcaactgtatctgacaagtggacggacctggacgataccggaggaaccgacggcttggtagttaacttaagttggtacgcgggtaagaagttaatttaaggaccttaactaaaagggttttccgaaggttgaacttgggttaagtggtaacg

SEQ ID NO: 184397 - DNA, 629 bp, Homo sapiens
  misc_feature: GYAE6OF01DIXSW.37.57.F02.1.454.CMB.1.raw
  modified_base (354)..(354): a, c, t, g, unknown or other
  misc_feature (354)..(354): n is a, c, g, or t
  modified_base (491)..(491): a, c, t, g, unknown or other
  misc_feature (491)..(491): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcttgggttttccttgttgcttattttggaaggtgtccagtgtgaggtgcaattggtggagtcgtgggggaggcctcgtccagccgtggggggtccctgagactctcctgtgtacgcctctgtaactttccccgttaggcttattggatgagctgggtcccgcaggcctaccgaggggaaggggctggaggtgggtcgaccaanataaagcaagataggaagtaagaaggagtatcgtaggactcgtaggtggtaaacgggtcccgtttacacctattcctaccgaagacgaaaccaacggccctaaaagaacctccgtagccatctagacaaagtcgaanagtctgaagcgaccggagacacggtacttaatttactcgtagccggagtaaggaggaaacgggtcgttcgggggtaccgttttaccgaacgttacgggtcggggaacccaaggggtaacccctgggtaccctacccgg

SEQ ID NO: 184398 - DNA, 548 bp, Homo sapiens
  misc_feature: GYAE6OF01B1W02.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctgggggtccctgagactctcctgtgtagcctctgaattcccctttacggcttattggatgagctgggtccgccaggctccgagggaaggggctggagtgggtggccaacataaagcaagatggaagtaagaaggagtatgtggactcgtgtgaaggccgtttcaccatctccagagacaacgccaagactccgtgcatctgacaaatgaactagtctaggagacgccgaggaccaggcttagtttattacgtgccgagagagaaggacgtggggcgtttcgacgtacgtggggacccaggggtacccctggtacccg

SEQ ID NO: 184399 - DNA, 610 bp, Homo sapiens
  misc_feature: GYAE6OF01A5ROM.37.57.F02.1.454.CMB.1.raw
  modified_base (316)..(316): a, c, t, g, unknown or other
  misc_feature (316)..(316): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggacctcgaccatcggaagttggggacgtgagtcctgggttttcccttgttgtctattttggaaggtgtccgagtggtgaggtgcgaattggtggagtcgtgggggaggcctcgtccagccgtgggggtccctgagactctcctgtgtagcctctgaacttccccttaggcttattggatgagctgggtccncgaggctccgagggaaggggctggaggtgggtcgccaacataaagcaagataggaagtaagaagagtatggtggactcgtgtaggaaggtccgttacactatcctaccgagagaaccaaccgacccaaagaacctccggtgacctatcctgaaccaaatcgaaacagtactaggaacgacggccggaaggaccacgggtcttaattttacgtacgtcgcgacggaagtacggaagggtacgtggggtccgtttacgacgtacggtcgggaccgacgggtaacccgtggtacccg

SEQ ID NO: 184400 - DNA, 683 bp, Homo sapiens
  misc_feature: GYAE6OF01EELJI.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagcttgggttttccttgttgctattttggaaggtgtccagtgtgaggtgcaattggtggagtcgtgggggagcctcgtccagccgtgggggtccctgagactctcctgtgtacgcctctgtaactttcccctttacggctttattggatgagcgtcgggtcccgcgaggcctccggaggggagggcgtgggaggtgggtcgaccaacataaagcaagataggaaagtaaggaaggagtagtggtagactcgtggtaggaacgggtccgtttacacctatcctaccgaagaacgaaccgaaaccgacccaaaggtaaccctccggtacgactaactcgtacgaactaaagtcgaaactcgttacgaggaacggacgaccggtaacggaaccgacggttactttaagtttaacgtacgtacggtaccggacggtaaggaaacgggtaacggtacgggttcgggggttacccggttttaccggaaccggttacgggtaccgggggacccgtaacggggtacccccgtgggtacccccg

SEQ ID NO: 184401 - DNA, 588 bp, Homo sapiens
  misc_feature: GYAE6OF01ENKHY.37.57.F02.1.454.CMB.1.raw
  modified_base (453)..(453): a, c, t, g, unknown or other
  misc_feature (453)..(453): n is a, c, g, or t
  modified_base (583)..(583): a, c, t, g, unknown or other
  misc_feature (583)..(583): n is a, c, g, or t
  modified_base (585)..(585): a, c, t, g, unknown or other
  misc_feature (585)..(585): n is a, c, g, or t
  modified_base (587)..(588): a, c, t, g, unknown or other
  misc_feature (587)..(588): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctagaaaatgaacagtctgagagccgaggacacggctatttatactgcgcgagagaaggactgggcgtttcgactacgtggggccaggaaccctggtcaccgtctcctcacgccctccaccgaacgggccccagtcccggttcccttcccccgtggcccgcccctcgccctccgacggacnccacccctcgagacgccacgacgccggcccgtgggcctgccgtggtccgaacggtaccttaccttccactacctaacacctacgtgacggccgggtctacgggaccgtaaacgggcctacgtaacgtagncngnn

SEQ ID NO: 184402 - DNA, 524 bp, Homo sapiens
  misc_feature: GYAE6OF01DQ9HS.37.57.F02.1.454.CMB.1.raw
  modified_base (417)..(417): a, c, t, g, unknown or other
  misc_feature (417)..(417): n is a, c, g, or t
  modified_base (463)..(463): a, c, t, g, unknown or other
  misc_feature (463)..(463): n is a, c, g, or t
  modified_base (493)..(493): a, c, t, g, unknown or other
  misc_feature (493)..(493): n is a, c, g, or t
  modified_base (521)..(524): a, c, t, g, unknown or other
  misc_feature (521)..(524): n is a, c, g, or t
tcagtagtgtagatcacgaccggtgctcgatttagctcgatatagttgggtctgggggaggcctcgtccagcctgggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggctatttattactgcgcgagagaaggactgggcggttcgactactggggccagggaaccctggtcaccgtctcctcagcctccaccgaagggcccatccggtcttcccccnggccgccctgcctccaggacgcacctccgagacgcacagcggcccngggctgcctgtcaaggctactccatctacnctactgagcgggctggcaaggcgcatgnnnn

SEQ ID NO: 184403 - DNA, 624 bp, Homo sapiens
  misc_feature: GYAE6OF01EPJZY.37.57.F02.1.454.CMB.1.raw
  modified_base (618)..(619): a, c, t, g, unknown or other
  misc_feature (618)..(619): n is a, c, g, or t
  modified_base (621)..(621): a, c, t, g, unknown or other
  misc_feature (621)..(621): n is a, c, g, or t
tcagtagtgtagatcacgaccggtgctcgatttagctcgatatagttgggtctgggggaggcctcgtccagcctgggggggtccctgagactctcctgtgtagcctctgaattcccctttacggcttattggatgagctgggtccgccaggctccagggaaggggctggagtgggtggccaacataaaagcaagatggaagtaagaaggagtatgtggactctgtgaagggccgtttcaccatctccagagacaacgccaagaactccgtgcatctaggcaaaatgaacagtctgagagccgaggacacggctatttattactgcgcgagagaaggacgtgggtcggtttcgactacgtggggccacgggaaccctggtccaccgtctcctcacgccctaccaccgaacgggccctacgtcggtccttcccccgtcggccgtcccctcgcctccgaggacgcccaccgtccgagacgccacgacgccggcccgtcgggcctcgcccgtgggtaccgaaacgggtaccttaaccttacccaacttacccgtaacctaacccttaaccgttcggaacgggtcccggggacgtcgggaccgaaacgggccgactagtaagnngnacg

SEQ ID NO: 184404 - DNA, 566 bp, Homo sapiens
  misc_feature: GYAE6OF01A7JMB.37.57.F02.1.454.CMB.1.raw
  modified_base (290)..(290): a, c, t, g, unknown or other
  misc_feature (290)..(290): n is a, c, g, or t
  modified_base (562)..(564): a, c, t, g, unknown or other
  misc_feature (562)..(564): n is a, c, g, or t
  modified_base (566)..(566): a, c, t, g, unknown or other
  misc_feature (566)..(566): n is a, c, g, or t
tcagtagtgtagatcacgaccggtgctcgatttagctcgatatagttgggtctgggggaggcctcgtccagcctgggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtcngagagccgaggacacggctatttatactgcgcgagagaaggctgggcggtttcgactacgtggggccagggaaccctggtcaccgtctcctcagccctaccaccaacgggcccagtccggtccttccccctggccgccctcgcctccgacggacgccaccctccggacgacgcgaccacggccggcccgtcgggctcggccgtcggtacgaacggtactacttaccactcctactactacgtgacggcgggcgtcggcaaggcgacagtagnnngn

SEQ ID NO: 184405 - DNA, 540 bp, Homo sapiens
  misc_feature: GYAE6OF01AHFM4.37.57.F02.1.454.CMB.1.raw
  modified_base (272)..(272): a, c, t, g, unknown or other
  misc_feature (272)..(272): n is a, c, g, or t
  modified_base (454)..(454): a, c, t, g, unknown or other
  misc_feature (454)..(454): n is a, c, g, or t
  modified_base (538)..(540): a, c, t, g, unknown or other
  misc_feature (538)..(540): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggcctttcaccatctccagagacaacgccaagactccgtgcatcngcaaatgaacagtctgagagccgaggacacggctattatactgcgcgagagaaggactgggcgtttcgactacgtggggaccagggaccctggtccaccgtctcctcagccctccaccgaggcccatcggtcctccccgtggccgccctgcctccgacggacgccacctccgagacgcaccnggccgccctgggctcgcctggtcaaggacctacttccatcctacactacgtcggacgcgggctcggcgaaaggcgacagtagcnnn

SEQ ID NO: 184406 - DNA, 622 bp, Homo sapiens
  misc_feature: GYAE6OF01CHT4O.37.57.F02.1.454.CMB.1.raw
  modified_base (161)..(161): a, c, t, g, unknown or other
  misc_feature (161)..(161): n is a, c, g, or t
  modified_base (171)..(171): a, c, t, g, unknown or other
  misc_feature (171)..(171): n is a, c, g, or t
  modified_base (229)..(229): a, c, t, g, unknown or other
  misc_feature (229)..(229): n is a, c, g, or t
  modified_base (237)..(237): a, c, t, g, unknown or other
  misc_feature (237)..(237): n is a, c, g, or t
  modified_base (436)..(436): a, c, t, g, unknown or other
  misc_feature (436)..(436): n is a, c, g, or t
  modified_base (457)..(457): a, c, t, g, unknown or other
  misc_feature (457)..(457): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcacatggaattgggctgagctggtttctgtgntatttgagtntcagtgtgagtgcaagttggtggagtcgtggggagcctcgtcagccgtgggggtcccngagactcncctgtgtagcctctgaacttcccttaaggctttatggatgagcgtggtccgccgaggctccgaaggggagggctaggacgtgggtcgaccaaacagtaaaagcaaagagtaggaaagtaaagaaggtagtatcgtggaactcgtagtggaaacggtccgttcacctatccacagacgacaacgaccaagaactccgtanccagttcagacaaatgaaacngtcgtagacgaggaccgaggaccgacggtacttaactttagttacgcggtaccggagaacgggtaaggaaacggggtcggttaaggggttaccgggttttacgaaaccggttaccgggtaccgggggacccggaaccggggtaaacccgttcggggtaaaccccg

SEQ ID NO: 184407 - DNA, 547 bp, Homo sapiens
  misc_feature: GYAE6OF01B3JSO.37.57.F02.1.454.CMB.1.raw
  modified_base (234)..(234): a, c, t, g, unknown or other
  misc_feature (234)..(234): n is a, c, g, or t
  modified_base (403)..(403): a, c, t, g, unknown or other
  misc_feature (403)..(403): n is a, c, g, or t
  modified_base (536)..(536): a, c, t, g, unknown or other
  misc_feature (536)..(536): n is a, c, g, or t
  modified_base (538)..(547): a, c, t, g, unknown or other
  misc_feature (538)..(547): n is a, c, g, or t
tcagtagtgtagatcacgaccggtgctcgatttagctcgatatagttgggtttggggggtccctgagactctcctgtgtagcctctgaattcccctttacggcttattggatgagctggggtccgccaggctccgaggggaaggggctggagtgggtggccaaacataaaagcaaagatggaagtaagaaggagtatgtggactctgtgaagggccgtttcaccatctccaganacaacgccaaagaactccgtgcatctgacaaatgaacagtctgagagccgaggacacggctatttattactgcgcgagagaaggactgggcggtttcgactacgtggggccagggaaccctggtcaccgtctcctcagcctccaccagggcccatcggtccttcccccnggccgccctgcctccacggacgccaccgtccgagcgcacacgccggccccgtgggcctcgcccgtggtacgaaggaccttacgttcccagtcctacacctactgagccgggctcggacaacggcgacagtagncnnnnnnnnnn

SEQ ID NO: 184408 - DNA, 569 bp, Homo sapiens
  misc_feature: GYAE6OF01AQ53J.37.57.F02.1.454.CMB.1.raw
  modified_base (466)..(466): a, c, t, g, unknown or other
  misc_feature (466)..(466): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtggggggtccctgagactctcctgtgcagcctctggtttcatctttagcaactacgccatgagcgtggggtccgccgaggcctccggaggggaacggggctgggaggtgggtctcgaggtattacgtggtagtggtaataccgcatactacgcagactcgtggaccgggtccgttcaccgtctccagacgacaattcccaaagtactacggtactatcgtaggaaatgaacngcctaggagcgaccggaggaccaccggtcccttataacgttactgtcgcgagaggatcgaagggacggtgtaacgtagacctaggctagctcgtcggtaaccg

SEQ ID NO: 184409 - DNA, 602 bp, Homo sapiens
  misc_feature: GYAE6OF01EDRIU.37.57.F02.1.454.CMB.1.raw
  modified_base (309)..(309): a, c, t, g, unknown or other
  misc_feature (309)..(309): n is a, c, g, or t
  modified_base (489)..(489): a, c, t, g, unknown or other
  misc_feature (489)..(489): n is a, c, g, or t
  modified_base (513)..(513): a, c, t, g, unknown or other
  misc_feature (513)..(513): n is a, c, g, or t
tcagtagtgtagatcacgaccggtgctcgatttagctcgatatagttgggtttgaggtctcgagagaggagccttagccctggactccaaggcctttccacttggtgatcagcactgagcacagaggactcaccatggaattggggctgagctgggttttccttgttgctattttggaaggtgtccagtgtgaggtgcaagttggtggagtcgtgggggagcctcgtccagccgtggggggtccctggacgctctcctgtgtgcctctgtaactttccccttaggctttattggatgagctcgggtccnccaggctccggaggggacggggctgggagtgggtggaccaagataaagcaagataggaagtaaggaaggtagtatggtaggactcgtggtaggaacggggttccctttcaacctatctacccgaggaacgaaccaaaccggacccaaaaggaacctccggtgacatctagacaatgaacngtctgagagccgaaggacacggtnttattatacgtgcgacgaggacgaagggtacgtggggtacgtttccgaacgttcggtacgggggaccacggggtaacctcgggtacccg

SEQ ID NO: 184410 - DNA, 585 bp, Homo sapiens
  misc_feature: GYAE6OF01DUB5G.37.57.F02.1.454.CMB.1.raw
  modified_base (312)..(312): a, c, t, g, unknown or other
  misc_feature (312)..(312): n is a, c, g, or t
  modified_base (523)..(523): a, c, t, g, unknown or other
  misc_feature (523)..(523): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagcttgggtttttccttgttgcttattttggaaggtgtccagtgtgaggtgcaattggtggagtcgtgggggagcctcgtccagccgtgggggtccctgagactctcctgtgtagcctctgtaactttcccctttacggctttagtggatgagctcgggtcccnccgaggctaccgaggggaagggctgggagtgggtgaccaacgataaagcaagagtaggaaagtaagaaggagtagtgtacggactcgtggtagaacgggtcctttacaacctatcctaccgagaacgacaaaccgcctaaagaacctccgtagcatctagacaaagtgaactgtctaggacgaggaccgaggacgacgtcttattatacgngccgagagaagaggcgtgggtacgttcgaaccgtacggcgggaccaacgggaccctggaccc

SEQ ID NO: 184411 - DNA, 567 bp, Homo sapiens
  misc_feature: GYAE6OF01C62TI.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattgggtggagtcgtggggggaggcttgggtccagccgtggggggtccctgagactctcctgtgcagcctctggattcaactttggtagctattggatggactgggtccgccagtctccgagggaaggggctggagtgggtggccaacgatacgagggaggtggtaggtaacgaaaaactgtaggtggactcgtggtggcggggccgtattccacctatcctccagacgacaacgacccaaaactcaactgtatctgacaagtcggacgcctagagacgtccgaggacgacggctgtagttattagttgtgcgtagagtattagaacttaacgtaaagtttcgagttacgtactggtaatggtatacg

SEQ ID NO: 184412 - DNA, 642 bp, Homo sapiens
  misc_feature: GYAE6OF01EC7BM.37.57.F02.1.454.CMB.1.raw
  modified_base (314)..(314): a, c, t, g, unknown or other
  misc_feature (314)..(314): n is a, c, g, or t
tcagtagtgtagatcacgaccggtgctcgatttagctcgatatagttgggtctgggggaggcctcgtccagcctgggggggtccctgagactctcctgtgtagcctctgaattcccctttacggcttattggatgagctgggtccgccaggctccagggaaggggctggagtgggtggccaacataaagcaaagatggaagtaagaaggagtatgtggactctgtgaagggccgtttcaccatctccagagacaacgccaagaactccgtgcatctgacaaatgaacagtctgagagccgaggacacggccctntattactggtgcgagagatcaaggacggagtatagcagcagctctgactacgtcgggccaaccggaacccttggtaccacccggttctccctcgacgtccctaccaaccgaaccgggccctaacgtccggttcccttccccccgtcggtaccctacccctccctacccgaacgaccgacctacccgtcggtccgggggaccacgacggcccggtcccgtcggggcctcggccgttacggtaccgaaacggtaccttaccgttccgtaacttacctaacctaaccgttacgtacggtacggcgggtaccgtcgggaccgagggtacccg

SEQ ID NO: 184413 - DNA, 578 bp, Homo sapiens
  misc_feature: GYAE6OF01DJX71.37.57.F02.1.454.CMB.1.raw
  modified_base (362)..(362): a, c, t, g, unknown or other
  misc_feature (362)..(362): n is a, c, g, or t
  modified_base (461)..(461): a, c, t, g, unknown or other
  misc_feature (461)..(461): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
  modified_base (481)..(481): a, c, t, g, unknown or other
  misc_feature (481)..(481): n is a, c, g, or t
  modified_base (510)..(510): a, c, t, g, unknown or other
  misc_feature (510)..(510): n is a, c, g, or t
  modified_base (544)..(544): a, c, t, g, unknown or other
  misc_feature (544)..(544): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagcttgggtttttccttgttgtctattttggaaggtgtccagtgtgaggtgcaagttggtggagtcgtgggggaggccgtcgtccaggccgtgggggtccctggacgctctcctgtgtagcctctgtaactttcccctttacggctttatggatgagtcgtgggtcccgccgaggctccggaggggacggggcgtgggaggtgggtggaccaanaataaagcaagagtaggaaagtaaagaaggagtagtgtggactcgtaggtggaacggtccgtttacacctatcctacagagaaccacgacaagactcgncatcngataancgaatgtcngaagcgacggagactcggtattattactntcggacgagaaggagaaggcggtgggtccgttanacggtcgcggggaaccacgggtccctgggtcccc

SEQ ID NO: 184414 - DNA, 615 bp, Homo sapiens
  misc_feature: GYAE6OF01ASR4X.37.57.F02.1.454.CMB.1.raw
  modified_base (306)..(306): a, c, t, g, unknown or other
  misc_feature (306)..(306): n is a, c, g, or t
  modified_base (347)..(347): a, c, t, g, unknown or other
  misc_feature (347)..(347): n is a, c, g, or t
  modified_base (441)..(441): a, c, t, g, unknown or other
  misc_feature (441)..(441): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttcctgttgctattttggaaggtgtccagtgtgaggtgcaattggtggagtctgggggaggcctcgtccagccgtggggggtccctgagactctcctgtgtagcctctgaacttcccctttacggcttattggatgagcgtgggtccnccaggcctccgagggaaggggctgggaggtgggtggccaanataaagcaagatggaagtaagaaggagtatgtggactctagtgaagggtccgtttacacctatcctccagacgacaacgccaagtacctcgtancatcctagacaaagtcgaaactgtactaggagaacggccgaagggactaccgggtattaagtttactacgtgccgtacggaagaacgggaaggtaccgttagggggccggttttaccggaaccgttacggtcgggggaccctaaggggaaccccttggggtacccgtaccccgg

SEQ ID NO: 184415 - DNA, 636 bp, Homo sapiens
  misc_feature: GYAE6OF01BTO74.37.57.F02.1.454.CMB.1.raw
tcagtagtgtagatcacgaccggtgctcgatttagctcgatatagttgggtttgggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgcccagaactcattgtatctgcaaatgaacagactgagagccgaggacacggctgtgtattactgtgcgagagaggaggcgattaggtgtaaatggctgggccttctactactactactacatggacgtcgtggggcaaagggaccacggtcaccgtctcctcacgcctccaccgaacgggcccacgtcggtccttcccccgtggccctacccctcctaccaacgacgccaccctcgtcggggcaccgtaggcccggcccgtcggggcctcggcccgttcggtaccgaaacgggtaccttacccgttaccctaacttcccgtaacctaacccgttaccgttacgggaaaccgggcccggggtaccggtcggggtaacccggaaacgggcccggacccgtaaagg

SEQ ID NO: 184416 - DNA, 605 bp, Homo sapiens
  misc_feature: GYAE6OF01BGI8A.37.57.F02.1.454.CMB.1.raw
  modified_base (477)..(477): a, c, t, g, unknown or other
  misc_feature (477)..(477): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagcttgggttttccttgttgcttattttggaaggtgtccagtgtgaggtgcaattggtggagtcgtgggggaggcctcgtccagccgtgggggtccctgacgactctcctgtgtagcctctgtaacttcccctttacggctttattggatgagtcgtcgggtccgccgaggcctccggaggggaaggggcgtgggagggtggggtcggacccaaacgaagtaaaacgcgaaaggatagggaaagtaaaggaaggagtatggtaggactcgtaggtagaacggtccgtttacacctatcctaccagacgaacaacgacaaagacctcgancatcagactaatgaacagtcagagacgccgaagacacggtacttatttatacgtgcgacgagacggaagggcggtgggtccgttacgaacgttcggacggggaccgaacgggtaccccgtggtacccg

SEQ ID NO: 184417 - DNA, 720 bp, Homo sapiens
  misc_feature: GYAE6OF01BT3H9.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtggggggtccctgagactctcctgtgtagcctctgaactttcccctttacggcttattggatgagcgtggggtccgccgaggcctccgaggggaaggggctgggaggtggggtggaccaacgataaagcaagagtaggaaagtaagaaggagtagtgtggactcgtggtaggaacgggtccgtttccacctatcctaccagacgaacacgccaaagaactccggtagccatcctgaacaaagtcgaactagtctaggaacgacggacccggtaagggaacccgtaacgggtaccttttaagtttttaaccgttacgtagggtccgggtaaacgggaacgggtaaggggaaacggggttaccgggttcggggggggttaccccgggtttttaccgggaacccggtttaaaccggggtcccggggggggacccccgtaaaaccgggggggtaacccccctttcgggggtcccccgttaacccccgggg

SEQ ID NO: 184418 - DNA, 621 bp, Homo sapiens
  misc_feature: GYAE6OF01BKMQ5.37.57.F02.1.454.CMB.1.raw
  modified_base (309)..(309): a, c, t, g, unknown or other
  misc_feature (309)..(309): n is a, c, g, or t
  modified_base (464)..(464): a, c, t, g, unknown or other
  misc_feature (464)..(464): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtggggggtccctgagactctcctgtgtagcctctgaactttcccctttacggcttattggatgagcgtgggtccnccgaggctccgaggggagggcgtggaggtgggtcggaccaacaataaagacgaagagtagggaaagtaaaggaaggagtagtggtggactcgtggtaggaacgggtccgtttacacctatcctaccgaagacgaacaaccgacaaacgacctcgngactactctagacaaagtgaacgtagtctagaacggacgaccggagggaccacggtacttatttactactggcgacgaaggaggaacgggtacgtggggtccgtttacgacgttacggtcgggggacccaaggggtaccccttgggtcccgtacccg

SEQ ID NO: 184419 - DNA, 638 bp, Homo sapiens
  misc_feature: GYAE6OF01ADECK.37.57.F02.1.454.CMB.1.raw
  modified_base (413)..(413): a, c, t, g, unknown or other
  misc_feature (413)..(413): n is a, c, g, or t
  modified_base (632)..(633): a, c, t, g, unknown or other
  misc_feature (632)..(633): n is a, c, g, or t
  modified_base (636)..(636): a, c, t, g, unknown or other
  misc_feature (636)..(636): n is a, c, g, or t
tcagtagtgtagatcacgaccggtgctcgatttagctcgatatagttgggtctgggggaggcctcgtccagcctgggggggtccctgagactctcctgtgtagcctctgaattcccctttacggcttattggatgagctgggtccgccaggctccagggaaggggctggagtgggtggccaaacataaagcaagatggaagtaagaaggagtatgtggactctgtgaagggcctttcaccatctccagagacaacgccaagactcgtgcatctgacaaatgaacagtctgagacgccggaaggacacggtcttatttactactgccgacgaggtaaggaacgggtacgtggggtaccgtttaccgactacggtcggggaccaacggggaaccctggtaccctaccgtcctccngaccgtccctaccgaaccgaccgggcccctagttcccggtccccttccccgcggcccgtccccgtgtacccgtccgacggccgtacccaccgtccgagacgccaacgcggcccgccgtggtcctcggtcgtcggtaccgaacgtaccttacctaccacttacctacctactaccggtcgacgggtcgggtcctgggaccgaaaggccgtacgacgtagnngtncg

SEQ ID NO: 184420 - DNA, 704 bp, Homo sapiens
  misc_feature: GYAE6OF01BV2QS.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcttgggttttccttgttgctattttggaaggtgtccagtgtgaggtgcaattggtggagtcgtgggggagcctcgtccagccgtgggggtccctgagactctcctgtgtagcctctgaactttccccgtttacggcttagttggatgagcgtgggtccgccgaggcctccgaggggaacggggcgtggaggtggggtgaccaaacaagtaaagcaagataagggaaagtaaaggaagggagtagtggtacggactcgtaggtaggaaacgggtccgtttacaaccgtagtcctaccgaaggtaacgaaccgaaaccggacccaaaggtaaccctccggtagacctacgtaccgtaggaactaaaagttcgaaaaccgtaggttaccgtaggaaacgtacggacccggaagggacccacgggttactttaagtttaccttacgtggaccggacgtaaaggaaggtaaacggtcggttgggggttaccgtttaccggaacgttacccgggtcggggacccgtaaccggggtaacccgttgggtaccccgtacccg

SEQ ID NO: 184421 - DNA, 329 bp, Homo sapiens
  misc_feature: GYAE6OF01BI5OM.37.57.F02.1.454.CMB.1.raw
  modified_base (321)..(329): a, c, t, g, unknown or other
  misc_feature (321)..(329): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccaggccgtggggggtcccctgagactctcctggtgtagtcctctagtaactttccccgttacggtcttagttggattgacgtcgttccgggggnnnnnnnnn

SEQ ID NO: 184422 - DNA, 720 bp, Homo sapiens
  misc_feature: GYAE6OF01DYQ7O.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttcctgttgctattttggaaggtgtccagtgtgaggtgcaattggtggagtcgtgggggaggcctcgtccagccgtgggggtccctggagactctcctgtgtacgcctctgaactttccccgtttacggctttagttggatggagcgtgggtcccgccaggcctccggaagggggaggggctgggaggtgggtacggaccaacgaagtaaagcgaaagagtaggaaagtaaggaagggagtatggtaggactcgtgtgggaacggtccttacacctactcctcgaagacgaacaacgaccaaagaccgtccgtagcctaactcgtacgaactaaagtgaaacgttacgtacgttacggaaacggtacggacccgggaacgggaaccgtaccgggtttaactttaacgtttttacttaaccgtcggggaaccgtacggaaagggaacgggtaaaacgggtacggttttcgggggggtaccctttttaacccgggaacctttacccggggtcgggggaaccccttaacggggggtaaacccccttgggtccccgtaaccccggg

SEQ ID NO: 184423 - DNA, 633 bp, Homo sapiens
  misc_feature: GYAE6OF01DZJPL.37.57.F02.1.454.CMB.1.raw
  modified_base (359)..(359): a, c, t, g, unknown or other
  misc_feature (359)..(359): n is a, c, g, or t
  modified_base (546)..(546): a, c, t, g, unknown or other
  misc_feature (546)..(546): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcttgggttttccttgttgctattttggaaggtgtccagtgtgaggtgcaattggtggagtcgtgggggaggcctcgtccgaggccgtcggggggtccctgagactctcctgtgtacgcctctgtaacttccccgttaggcttagttggatgagtctgggtccgcgaggctaccggaggggacgggctgggaggtgggtacgaccaaanataaagcaaagagtaggaaagtaaagaaggtagtaatggtagactcgtggtaggacggtcttacactatcctacaagacgaacaaccgtaccgaaagtaacctcccgtagtactctagaacctaaaagtcaacgacgttcaggagaacgtcgtaggaacgtaccgacgttccttaggttacttacgnggtaacgacgaaaaggtctacgtaaggttctaaaccgtaacgtgggtaacttggtaactaagttttacttttggacgtttaacgggg

SEQ ID NO: 184424 - DNA, 631 bp, Homo sapiens
  misc_feature: GYAE6OF01AO5WX.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaggtgtccagtgtgaggtgcaattggtggagtcgtgggggagcctcgtccagccgtggggggtccctgagactctcctgtgtagcctctgtaacttcccctttacggcttattggatgagctgggtccgccaggctccgagggagggctggagtgggtggccaacataaagcaagagtaggaagtaagaaggagtatgtggactcgtaggtaggaacgggtccgtttacacctatcctaccaggacgaaccaaccgacccaaagaacctccgagccatctagacaaagtcgaactagtccgtaggaacgtacggacccgggtaggacctacgggtaccttaagtttaacttaccgtggaccgtacggaaggacgggtaaggtacggttgggggtacccgtttacggaccgttacggtcgggggaaccctaaccggggaccccgttgggtaccccg

SEQ ID NO: 184425 - DNA, 640 bp, Homo sapiens
  misc_feature: GYAE6OF01BBMEI.37.57.F02.1.454.CMB.1.raw
  modified_base (628)..(628): a, c, t, g, unknown or other
  misc_feature (628)..(628): n is a, c, g, or t
  modified_base (632)..(632): a, c, t, g, unknown or other
  misc_feature (632)..(632): n is a, c, g, or t
  modified_base (636)..(636): a, c, t, g, unknown or other
  misc_feature (636)..(636): n is a, c, g, or t
  modified_base (638)..(639): a, c, t, g, unknown or other
  misc_feature (638)..(639): n is a, c, g, or t
tcagtagtgtagatcacgaccggtgctcgatttagctcgatatagttgggtctgggggaggcctcgtccagcctgggggggtccctgagactctcctgtgtagcctctgaacttcccctttacggctttattggatgagctgggtccgccaggctccgaggggaaggggctggagtgggtggccaaacataaagcaaagatagggaaagtaaggaaggagtatgtggactctgtgaagggtccgtttcaccatctccacagacaacgccaaagaaatcaattctttttgacaaatgaacagtctagagagtcgaggacacggccatgtatactgtacgagagaacagacgttgggccagggaacccgtggtccaccgtctcctcacgccctaccaccgaacggcccacgtccgtcccttcccccgcggcccgccctcgcctccgaacggacgccacccgtcccgaagacgaccacgaccgccggcccgtgggaccctcggcccgtcgggtaaccaaacgggtacctttaacccgttacccaactttacccgtaacctacccgttaaccgtcggaaccgggtccggggaccgttcgggaaccgtaacgggccgtacaaacggtacgacngacnacangnnc

SEQ ID NO: 184426 - DNA, 649 bp, Homo sapiens
  misc_feature: GYAE6OF01EAQ4E.37.57.F02.1.454.CMB.1.raw
  modified_base (308)..(308): a, c, t, g, unknown or other
  misc_feature (308)..(308): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtggggggtccctggagactctcctgtgtagcctctgtaacttcccctttacggcttattggatgagctgggtccncaggctccgaggggagggcgtggagtgggtgccaacataaagcaagataggaaagtaagaaggagtatggtggactcgtagtggaaagggtcccgttttacacctatctaccaaggaacaacaaccgacccaaagaacctccgtagactatccagacaaatgaaactagtcgtaggacggacgaccggaaggaacctacgggtacttaagttttaacgtacgttcggccggtaaggaaggaacggtaagggacggttacgggggttaccgggtttaccgaacggttaacgggtacccggggggacccgtaaacggggtaaccccccgttagggtacccccg

SEQ ID NO: 184427 - DNA, 567 bp, Homo sapiens
  misc_feature: GYAE6OF01DW5XP.37.57.F02.1.454.CMB.1.raw
  modified_base (453)..(453): a, c, t, g, unknown or other
  misc_feature (453)..(453): n is a, c, g, or t
  modified_base (565)..(567): a, c, t, g, unknown or other
  misc_feature (565)..(567): n is a, c, g, or t
tcagtagtgtagatcacgaccggtgctcgatttagctcgatatagttgggtctgggggaggcctcgtccagcctgggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggcctttcaccatctccagagacaacgccaagaactccgtgcatctgacaaaatgaacagtctgagagccgaggacacggcttaatttattactgcgcgagagaaggactgggtcgtttcgactacgtcggggccaagggaaccctggtccacgtctcctcacgccctaccaccgaacgggcccagtccgtccttccccgtcggccgccctcgcctccgaggacnccaccgtccgagacgcacgacgcccggcccgtgggcctcgccgtcggtacaacggtacttacttccatcctacacctacgtggacggcgggcgtggacgaaggcgcaatgcnnn

SEQ ID NO: 184428 - DNA, 579 bp, Homo sapiens
  misc_feature: GYAE6OF01B8B0J.37.57.F02.1.454.CMB.1.raw
  modified_base (488)..(488): a, c, t, g, unknown or other
  misc_feature (488)..(488): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtggggggtccctgagactctcctgtgtagcctctgaacttcccctttacggcttattggatgagcgtgggtccgccgaggcctccgaggggaaggggctgggaggtgggtggccaacgataaagcaaagagtaggaaagtaagaaggagtagtggtaggactcgtggtaggaacgggtcccgtttacacctatcctaccgaagaacgaacaacgacccaaagaacctccgtagcatctagacaaatgaacagtcngagacgccgaaggacacggtcttatttatcgcgcgacgagagaggcgtgggcgttcgacgttcggcggggaccacgggaccctggtacccg

SEQ ID NO: 184429 - DNA, 621 bp, Homo sapiens
  misc_feature: GYAE6OF01CLEVX.37.57.F02.1.454.CMB.1.raw
  modified_base (450)..(450): a, c, t, g, unknown or other
  misc_feature (450)..(450): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtggggggaggcttgggtccaggccgtggggggtccctgagactctcctgtgcagcctctggattcaactttggtagctattggatggactgggtccgccagtctccgagggagggctggaggtgggtggccaacagtacgagggaggtggtaggtaacgaaaaacgtagtggtggactcgtggtgggccggggcctattcaccatcctccagacgacaacgacccaaaactcaacgtntactcgtagacaaagtcggacggcctaggacgtacgtacccgaagggacccgtacgggtcgttcggttagttatttagttggtgaccggagtaaggttacgtttaaggaactttaaccgtaaaggttttacggtaggttacggtaacgttgggttaacttggtaagttcgg

SEQ ID NO: 184430 - DNA, 860 bp, Homo sapiens
  misc_feature: GYAE6OF01D0PS6.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaagttggggctgagtcgttgggttttccttgttgtcttagttttggaaggtgtccagtgtggaggtgactagttgggtggaggtcggtggggggacgtccgtccggtccgacggtccggttcggggggtcccctggacgtacttccgtccgttggtcgtacgtcccttcgtacgttaaccttttccccgtttacggtctttagtaggtagtggtacggtccggtcggggtcccgccgtacggccgtacggaagggggaacggggtcgtaggggtacgggtcgggtacggaacccgaaagtaaacgtaaaaggacgaaaggtaaggtaagggtaaaggtaaaggaaggtaagttacgtaggtacggtactacggttagggtacgggtaacgggttcccgttaccgtaccgtacgttacccgtaaccgaacggaaccgtaaccgtaaaccccggaccgtaaaacggtacccgttacccggtagtacctaacgttacgtaacggtaaaccgtaaagtacggaaacgtcggtaaccgtagggaaccgggaacggaaccgggtaacggtaacccgttaaacggttacttttaagtttaaccgtaacggtcgggaaccggaacgggtaaggaaacgggttagggcgggtttaccgggggtacccgtttaacgacgggttaccggggtacggggacccggttaaaccggggtcccgttccggtaccccgg

SEQ ID NO: 184431 - DNA, 596 bp, Homo sapiens
  misc_feature: GYAE6OF01A96KI.37.57.F02.1.454.CMB.1.raw
  modified_base (591)..(592): a, c, t, g, unknown or other
  misc_feature (591)..(592): n is a, c, g, or t
  modified_base (594)..(594): a, c, t, g, unknown or other
  misc_feature (594)..(594): n is a, c, g, or t
tcagtagtgtagatcacgaccggtgctcgatttagctcgatatagttgggtctgggggaggcctcgtccagcctggggggtccctgagactctcctgtgtagcctctgaattccccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaaatgaacagtctgagagccgaggacacggctatttatactgcgcgagagaaggactggggcgtttcgactacgtgggggccaggggaacccctgggtccaccgtctccctcacgccctaccaccgaaacgggccccagttccggtcccttccccccgtggcccgcccctcgcctccgaggacgccaccctccggagacgcacgacgccggcccgtgggcctcggccgtggtaccgaaggtacctaccgttccactcctacacctacgtacggacggccggggctcgggaccgaacgggccgaccgaagtagnngngc

SEQ ID NO: 184432 - DNA, 684 bp, Homo sapiens
  misc_feature: GYAE6OF01DLVK8.37.57.F02.1.454.CMB.1.raw
  modified_base (681)..(681): a, c, t, g, unknown or other
  misc_feature (681)..(681): n is a, c, g, or t
  modified_base (683)..(684): a, c, t, g, unknown or other
  misc_feature (683)..(684): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggctttattggatgagctgggtccgccaggctccgagggaaggggctggagtgggtggccaacataaaagcaagatggaagtaagaaggagtatgtggactcgtgtgaagggcctttcaccatctccagagacaacgccaagacctcgtgcatctgcaaaatgaaacagtctggagacgccgaggacacggtacttattttatactgcgacgagacgaagggctggggtccggtttacgaccgttaagcggggaccaaggggaaccctgggtaccaccgttcctcctacgaacgtcccctacccgaaaccgaacgggtcccctaagttcccgggtccctttccccccgtgggccccgtccccgttcggccccttaccgaacgggaccgacccgtacccgtacccggacggaccgccaaccggaccggccggtccccgttcggggccttaccggtcccggttagggtaaccgaaacgggtaccttaccgttccaagttcctacctaacgttacgtacggtacggtccgggacgtgggacccgaaggtccgactaagtagcngnn

SEQ ID NO: 184433 - DNA, 564 bp, Homo sapiens
  misc_feature: GYAE6OF01ELNR6.37.57.F02.1.454.CMB.1.raw
  modified_base (270)..(270): a, c, t, g, unknown or other
  misc_feature (270)..(270): n is a, c, g, or t
  modified_base (521)..(521): a, c, t, g, unknown or other
  misc_feature (521)..(521): n is a, c, g, or t
  modified_base (527)..(527): a, c, t, g, unknown or other
  misc_feature (527)..(527): n is a, c, g, or t
  modified_base (561)..(564): a, c, t, g, unknown or other
  misc_feature (561)..(564): n is a, c, g, or t
tcagtagtgtagatcacgaccggtgctcgatttagctcgatatagttgggtctgggggaggcctcgtccagcctgggggggtccctgagactctcctgtgtagcctctgaattcccctttacggcttattggatgagctgggtccgccaggctccagggaaggggctggagtgggtggccaacataaaagcaagatggaagtaagaaggagtatgtggactctgtgaagggccgtttcaccatctccagagacaacgccaagaactccgngcatctgcaaatgaacagtctgagagccgaggacacggctatttattactgcgcgagagaaggactgggcgtttcgactacgtggggccagggaaccctggtccaccgtctcctcacgccctccaccgaacgggcccagttccggtccttcccccgtggccgcccctgcctccaggacgccacccgtccgagacgcaccgacgccggcccgtgggcctgccctgggtcaaggtcctactccactcctaacncctacncgacggcgggactcgggacaagggccgacatagnnnn

SEQ ID NO: 184434 - DNA, 633 bp, Homo sapiens
  misc_feature: GYAE6OF01CZ48P.37.57.F02.1.454.CMB.1.raw
  modified_base (496)..(496): a, c, t, g, unknown or other
  misc_feature (496)..(496): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggtttccttgttgctattttggaaggtgtccagtgtgaggtgcaattggtggagtcgtgggggaggcctcgtccagccgtggggggtccctgagactctcctgtgtagcctctgaactttccccgtttacggtctttagttggatgagcgttgggtcccgccgaggcctccgaggggaaggggctgggaggtgggtcggaccaaacgagtaaagcaagagtaggaagtaaaggaagggtagtagtggtggaactcgtaggtggaaacgggtcccgtttacacctattcctacgagacgaaccgaacgccaaagaacctccgtagcatctagacaaatgaacngtcgtagaacgagaccggaggacgtacggacttatttattacgtgacgacgaaggaggtaacggtagttcgggggtacggtttacgaaccgttacgggtcgggggaccgtacgggaaccccgtggtccgtaccccgg

SEQ ID NO: 184435 - DNA, 800 bp, Homo sapiens
  misc_feature: GYAE6OF01CIWIA.37.57.F02.1.454.CMB.1.raw
  modified_base (268)..(268): a, c, t, g, unknown or other
  misc_feature (268)..(268): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagcgtggtttccgtgtagctatttggaaggtgtcagtgtgaggtgctaagttggtggaggtcgtgggggagcctcgtccgaggccgtcgggggtccctgagtactctccgtgtgagcctntcgtaacttccccgtttaggctttaagtggatggacgtcgtcggggtcccgcgtacggtaccgtccggaaggggaacgggtccgtagggtaacggtcggggttcggaacccgaaaacgaagttaaaacggacgtaaaagggtaaggtagggaaaaggtaaaagggaaagggttaacgttaagtaggtaacgggtaaccgttcccgggtaacggggttaaaccgggggttcccttttacccgaacccgttacgttacccgaccgtaaccggaagaaaccgtaacgaacccgtaaacgtaaccgtaccgtacgtacacttcggtacgaactaaagtacgtaaacctaggttacgacggtaaggacgaccggtaaacggacctacgggttacttaaggttttacctaacggttcggaacggttacgaaaggtaacgggtaacggtaccggttacggggtccggtttacgtaacggttacccggggtacgggtacccggtaaccggggttaacccctcgggtaccttacccccggg

SEQ ID NO: 184436 - DNA, 559 bp, Homo sapiens
  misc_feature: GYAE6OF01DWGRV.37.57.F02.1.454.CMB.1.raw
  modified_base (531)..(531): a, c, t, g, unknown or other
  misc_feature (531)..(531): n is a, c, g, or t
  modified_base (556)..(559): a, c, t, g, unknown or other
  misc_feature (556)..(559): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaaggggctggagtgggtggccaacataaagcaaagatggaagtaagaaggatatgtggactctgtgaagggcctttcaccatctccagagacaacgccaagaactccgtgcatctgcaaatgaacagtctgagagccgaggacacggctatttattactgcgcgagagaaaggactggggcgtttcgactacgtgggggccaggggaaccctggtcaccgtctcctcacgcctccaccgaagggcccagtccggtccttcccccgtcggccgtccctcgcctccgacggacgccacccgtccgacgacgccacgacgccgcccgtgggcctcgccgtcggtacaaggaccttacttcccatcctacactacgngacgcgggctggacgagcgcatagnnnn

SEQ ID NO: 184437 - DNA, 597 bp, Homo sapiens
  misc_feature: GYAE6OF01A4CIZ.37.57.F02.1.454.CMB.1.raw
  modified_base (236)..(236): a, c, t, g, unknown or other
  misc_feature (236)..(236): n is a, c, g, or t
  modified_base (256)..(256): a, c, t, g, unknown or other
  misc_feature (256)..(256): n is a, c, g, or t
  modified_base (433)..(433): a, c, t, g, unknown or other
  misc_feature (433)..(433): n is a, c, g, or t
  modified_base (587)..(597): a, c, t, g, unknown or other
  misc_feature (587)..(597): n is a, c, g, or t
tcagtagtgtagatcacgaccggtgctcgatttagctcgatatagttgggtttggggggtccctgagactctcctgtgtagcctctgaattcccctttacggcttattggatgagctggggtccgccaggctccaggggaagggggctgggaggtgggtggccaaacataaaagcaagatggaagtaagaaggagtatgtggactctgtggaagggtcctttcaccatctccaganaacaacgccaaagactccgngcatctgacaaatgaacagtctagagacgccggaggaccacggcttatttatactgcgcgagagaaggcgtgggtcggtttcgacgtacggtcggggaccgaacgggaaccctcggtaccacccgtctcctcacgccctccaaccgacggccctacgtccgtccctccccgtggccnccctgcctccgagcgacctaccgtccgagacgcacgacggccgccgtcggcctcgtccgtggaccgtaacgacctttactacccattacccgtacctaaccgtacgtacggagggtcccgggcgtcgggaccgtacgggcgtactacggtagcnnnnnnnnnnn

SEQ ID NO: 184438 - DNA, 674 bp, Homo sapiens
  misc_feature: GYAE6OF01ESLC2.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtggggggtccctgagactctcctgtgtagcctctgaactttcccctttaggcttattggatgagctgggtccgccaggcctccgagggggaaggggctgggagtggggtcgccaaacagtaaagcaagagtaggaagtaaaggaaggagtagtgtaggactcgtgtaggaagggtcctttacaccatcctcagacgacaacgaccaaagaacctccgtgacatctacgactaaagtgaaactagtacctaggagacggaccggaagggaaccgaccgggttacttaagttttaacgttacgtcggacggtacggaaaggaacggtaaacggggtacggttgggggttacccgggttttaccggaaccgttaaacccggggttcggggggaaccccgtaaaccgggggtaaaccccgttcgggggtacccctaaccccggg

SEQ ID NO: 184439 - DNA, 512 bp, Homo sapiens
  misc_feature: GYAE6OF01B1Y73.37.57.F02.1.454.CMB.1.raw
  modified_base (505)..(512): a, c, t, g, unknown or other
  misc_feature (505)..(512): n is a, c, g, or t
tcagtagtgtagatcacgaccggtgctcgatttagctcgatatagttgggtttgggggggtccctgagactctcctgtgtagcctctgaattcccctttacggcttattggatgagctgggtccgccaggctccaggggaaggggctggagtgggtggccaacataaaagcaagatggaagtaagaaggagtatgtggactctgtgaagggccgtttcaccatctccagagacaacgccaaagaactccgtgcatctgcaaaatgaaacagtctgagagccgaggacacggctatttattactgcgcgagagaaggactgggcggtttgacccccccctatgggccagggaaccctggtcaccgtctcctcagcctccaccaaggcccatcggtctcccctcggcgccctgctccaggagcacctccgagagcacagcggcccgtggctgcctggtcaaggactacttccatctacactactgagcggctggcaaggcgcatagnnnnnnnn

SEQ ID NO: 184440 - DNA, 666 bp, Homo sapiens
  misc_feature: GYAE6OF01BL2FO.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcttgggttttccttgttgcttattttggaaggtgtccagtgtgaggtgcaattggtggagtcgtgggggagccgtcgtccagccgtgggggtccctgagcctcgtcctgtgtagccttcgtcgtaactttccccgtttacggtcttagttggatgagcgtcgggtcccgcgaggcctcggaggggacgggtcgtgggacggtgggtacgaccaacgaagtaaagcaaaggagtaggaaagtaaaggaaggtagtagtggtaggacttgtggtacggtaacgggtccgttacacctatctaccgagacgaacaccgacgaacaacgtcgacgactactcgtagaacaaagtacgaacgtgtaccgagaacggacgaccggaaggtacgacggttacttaacgtttacgtaccgtaggaccgtaaggacggaaggtaacggtacggttcggggttaaccgttcggacccgtacgggtccggggaaccgaccgggtaaccgttcggtacccgtacccg

SEQ ID NO: 184441 - DNA, 823 bp, Homo sapiens
  misc_feature: GYAE6OF01BM9XU.37.57.F02.1.454.CMB.1.raw
  modified_base (680)..(680): a, c, t, g, unknown or other
  misc_feature (680)..(680): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgcttattttggaaggtgtccagtgtgaggtgcaagttggtggagtcgtgggggaggcctcggtccaggccgtgggggtccctggagactctctgtgtacgtcctctgtaactttccccgttacggtctttagttggatggagtcgtcgggtccgccgtacggcctaccggagggaacggggtcgtgggtagggtcggggtacggaccctaacgaagtaaaaggacgtaaaggagttaggggaaaagtaaaggaaagggtagtaagtggtacggtacgttccggttaggtagggtaacggggttcccgtttacccgaacccgtacgttacctacccggaaaggaacgtaacccgaacccgaaccgtaaaaacggtaacccgttcccgggtacgaacctaacgtttaccgacggtaaacctaaaaggtaccgaaacgtacggttaccgtaagggaacgtaacccgggccgggaaacggtaccgtaaacgggttctttaaagttacgttacccggnggtaacccggaggtaacgggaacgggtaaccggtagggtttaccggggtaccggtttttacccggaacggtttacccggggtaccggggggaacccggttaaaccggggtaacccccccttgggggtaccccgtaacccccgg

SEQ ID NO: 184442 - DNA, 622 bp, Homo sapiens
  misc_feature: GYAE6OF01AQP3T.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtggggggtccctgaggactctcctgtgtacgcctctgtaattcccctttacggcttattggatgagcgtgggtccgccgaggccgtccgaggggagggcgtgggagtggggtggaccaacgagtaaagcgaagatagggaaagtaaggaaggagtagtgtaggactcgtgtaggaagggtccgtttcacgtatccgtaccagacgaccaacgaccaaataacgtccgtgacatcgtagactaaatgaacagtctgacgaggccgaggacacggtacttattacgtacgcggacgcgaaggaggaacgggtacgtagggggtccgttttaccggaaccgttacgggtccggggacccgtaacggggacccccgttgggtccctacccgg

SEQ ID NO: 184443 - DNA, 746 bp, Homo sapiens
  misc_feature: GYAE6OF01D5TCD.37.57.F02.1.454.CMB.1.raw
  modified_base (550)..(550): a, c, t, g, unknown or other
  misc_feature (550)..(550): n is a, c, g, or t
tcagtagtgtagatcacgaccggtgctcgatttagctcgatatagttgggtttgggggtctcagagaggagcctttagccctggacctccaaggccctttccacttggtgatcagcactgagcacaggaggactcaccatggaagttggggctgagtcgttggttttcgttgttgcttattttaggaggtgtcgagtggtgaggtgataagttggtggagtcggtgggggacgtccttcggtcccaggtcccggttggggggtcccttaggacgaccttcctccgtgttggtacgtcctctcgtaaccttttccccgtttaaggtcttttagttggatggagtcgttcggggtcccgccgtaggccgtacggaaggggaaggggtcctggggtaggtgggtacgaccaaaagaagtaaacgcgaaaggtagtaagggaaagtaagaagggtagtaacgtggaggtaacttcggtggtaggaacgggttcctttacaacttacgtacctacgaagaacgaaccgaaccgtaaccaaacggtaacctcgganacctatcgtaaccgataaagtcaaagtacgttcgaacggaagtacgaaccggaggaaccctaggttaactttaacgtttaattccgtaacgcggcggtaaagacgggttaacgacgggttaggggtaccggttccggttaaacggtccgggtacggtaacccgggaaccggttaacccggttcggtcttaccccgg

SEQ ID NO: 184444 - DNA, 727 bp, Homo sapiens
  misc_feature: GYAE6OF01E3Z1E.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtggggggtccctgagactctcctgtgtagcctctgaacttccccgtttacggcttatggatgagcgtgggtccgccaggctccgaggggaaggggctgggagtggggtcggccaacataaagcaagataggaagtaagaaggagtagtgtggactcgtggtaggaacggggtccgtttacaccagttcctaccgaagaacgaaccgaaccggacccaaaggaacctccggtgacctatccgtagacaaattgaaacctagtccgaggaacggaacggaccggtaacgggaaccgaaccgggtaccttttaaatttttaacgttacccgttgggacccggtacgggaaaggtaaacggggtaaaccggggtaacggttcgggggggttaacccggtttttacccgggaaacccggtttaaccggggttcggggggaacccccgggtaaaccgggggtaaaccccccgtttcggggtaccccgttaacccccggg

SEQ ID NO: 184445 - DNA, 936 bp, Homo sapiens
  misc_feature: GYAE6OF01DKHNE.37.57.F02.1.454.CMB.1.raw
  modified_base (260)..(260): a, c, t, g, unknown or other
  misc_feature (260)..(260): n is a, c, g, or t
  modified_base (365)..(365): a, c, t, g, unknown or other
  misc_feature (365)..(365): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcttgggttttccttgttgcttattttggaaggtgtccagtgtgaggtgcaattggtggagtcgtgggggagcctcgtccagccgtgggggtccctgagactctcctgtntacgcctctgtaactttccccgtttaggcttagttaggatggatcgtgggtcccgccgaggcctccggaggggaacggggcgtgggaggtggggtcgacccaaanataaatacgaagagtaggaaagtaaaggaagggtagttagtggtacggtactcgttaggtacgggtaacgggttacccgtttacaacccgtacgttcccgtaccgaaggtaaccgaaacccgtaaaccccggaaaccccgtaaaacggttaaccccggttacccgggttagaacccgttaacgttacccgttaaccggaaaccgttaaaaaaccggtttacgaaaaaccccggtttacggtttaccccgggtttaagggaaaacgggaacccggggtaaccccccggggttaaaggggaaacccccggttaaaccggggtttaaccctttttaaaggtttttttaaaccgttaaccccgggttcgggacccgggtaaaccgggtaaagggtaaaacggggtaaacccggggggtaaccgggttttcccggggggggtttaccccgggttttttaacccgggaaacccgggttttaaacccgggggtaccggggggggtaaaccccccttaaaaccccggggggggttaaacccccgtttccgggggtaccccccgtttaaaccccccgggg

SEQ ID NO: 184446 - DNA, 660 bp, Homo sapiens
  misc_feature: GYAE6OF01DEVQ9.37.57.F02.1.454.CMB.1.raw
  modified_base (341)..(341): a, c, t, g, unknown or other
  misc_feature (341)..(341): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgcttattttggaaggtgtccagtgtgaggtgcaattggtggagtcgtgggggaggcctcgtccagccgtgggggtccctgagactctcctgtgtagcctctgaactttcccctttacggcttattggatgagctgggtccgccaggctccgaggggaaggggctgggagtgggnggaccaacgataaagcaagataggaagtaagaaggagtagtggtaggactcgtgtggaacgggtccgtttacacctatcctccgaagacgaaccaaccgaccaaagaacctccgtagactatctagacaaatgaacagtctaggaacgacggaccggaaggaccgacggtactttaagttttacttaacgttcggccggacggaaggaaggtaaacgggacggttacggggggtcccggtttttaccggaaccgtttacccgggtcggggggaaccccgtaacggggggtaaaccccctcgggggtccctaaccccggg

SEQ ID NO: 184447 - DNA, 586 bp, Homo sapiens
  misc_feature: GYAE6OF01CTYN4.37.57.F02.1.454.CMB.1.raw
  modified_base (147)..(147): a, c, t, g, unknown or other
  misc_feature (147)..(147): n is a, c, g, or t
  modified_base (189)..(189): a, c, t, g, unknown or other
  misc_feature (189)..(189): n is a, c, g, or t
  modified_base (296)..(296): a, c, t, g, unknown or other
  misc_feature (296)..(296): n is a, c, g, or t
  modified_base (312)..(312): a, c, t, g, unknown or other
  misc_feature (312)..(312): n is a, c, g, or t
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
  modified_base (351)..(351): a, c, t, g, unknown or other
  misc_feature (351)..(351): n is a, c, g, or t
  modified_base (584)..(586): a, c, t, g, unknown or other
  misc_feature (584)..(586): n is a, c, g, or t
tcagtagtgtagatcacgaccggtgctcgatttagctcgatatagttgggtctgggggaggcctcgtccagcctggggggtccctgagactctcctgtgtagcctctgaacttcccctttacggctttattggatgagctgggtccnccaggctccgaggggaaggggctgggagtgggtggaccaaanataaagcaagatggaaagtaagaaggagtatgtggactctgtgaagggtcctttcacatctcagagacaacgccaagaactcgtgcatctagacaaatgaacagtcngagacgcgagacacgnttattatacngcgngagagaaggctgggcgttcgactgngggacaggacctggacaccgtctccgtcacgtccctaccgaacgaagggtccccagttcccgtccgttcccccgtcggtccgtacccgtcgtccgtaccgacggacgaccacccgtaccgacgacgacacgacggccggcccgtcgggctcgccgtaggtacgaacggtactacttccactactactactacgtcggacgtcgggcgtcggaccgaaggccgactacgagacnnn

SEQ ID NO: 184448 - DNA, 812 bp, Homo sapiens
  misc_feature: GYAE6OF01C7N7F.37.57.F02.1.454.CMB.1.raw
  modified_base (540)..(540): a, c, t, g, unknown or other
  misc_feature (540)..(540): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcttgggttttccttgttgcttattttggaaggtgtccagtgtgaggtgacaagttggtggagtcgtgggggacgcctcgtccaggccgtgggggtccctgagactctcctgtgtacgcctctgtaacctttccccgttaggtctttagttggatgagtcgtcgggtccgccgacggcctaccggaagggggaacggggctggggacggtgggtacggaacccaacgaagtaaaacgacgaaagagtaagggaaagtaaaggaaggtaaggtagttggtaggtaactcggttaggtagggtaaacgggtccccgttttacacccgtagttaccctaccgaacggacgaaacccaaaccggacccgaaaaacggtaacccttcccgggtanacctacttccgtaaggaacctaaaagtggtaaacctacggtttaccgtagggaaacggtaccgggaccgggaaacgtaccgaaccgggttacttttaacgtttttacgtaccttacgggacccggaaggtaaccgggtaaaagggtaaaccgggacggggtttccgggggttaccggtttttacccgggaaaccgtttcccggggtaaccggggggtaacccccgaacggggggttaaaccccccttggggttacccccgttaaacccccgg

SEQ ID NO: 184449 - DNA, 854 bp, Homo sapiens
  misc_feature: GYAE6OF01DAAXA.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagtcgttgggttttccttgttgtcttagttttggaaggtgtccagtgtgaggtgctaagttggtggagtcggtgggggacgcctcgtccgacgtccgtcgggggtccctggacgtccttcctccgtgtgtacgtccttcgtacgtaactttcccccgtttaggtctttagttggtatgagtccgtcgggtcccgccgaggcctaccggagggggaacgggtcgtagggacggtgggtacggacccaaaagaagtaaacgacgaaaggtagtagggaagtaaaggaaggtagtagttggtaggacttacgtaggtaggtaaaccgggtcccgtttaccaaccgtacgttacccgtaccgtaaggaacgaaacccgaaacccgaacccgaaaacggttaacccgtcccggttacgacccttaacgttaccgtaacggaaaccgtaaaacgttacgtaaaacctacggtttacgaacgggtaacggtaccggaacccgggaaacgggtaaccccgtaaggttaaccgtttttaaacgttttaaccgttaacgtaccgggactaacccggggaaaagtaaccggggtaaaccgggtacgggtttacgggggttaccggtttaacccgggtaacccggtttaacggggtcccgggggtaacccgtaacccgggggtttaaaccccgtcgggttaccccggtaacccccgg

SEQ ID NO: 184450 - DNA, 591 bp, Homo sapiens
  misc_feature: GYAE6OF01C4V0X.37.57.F02.1.454.CMB.1.raw
  modified_base (186)..(186): a, c, t, g, unknown or other
  misc_feature (186)..(186): n is a, c, g, or t
  modified_base (213)..(213): a, c, t, g, unknown or other
  misc_feature (213)..(213): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (585)..(585): a, c, t, g, unknown or other
  misc_feature (585)..(585): n is a, c, g, or t
  modified_base (589)..(591): a, c, t, g, unknown or other
  misc_feature (589)..(591): n is a, c, g, or t
tcagtagtgtagatcacgaccggtgctcgatttagctcgatatagtttgggtctgggggaggcctcgtccagcctgggggggtccctgagactctcctgtgtagcctctgaacttccccctttacggctttattggatgagctgggtccgccaggctccagggaagggctggagtgggtgccaaanataaagcaagatggaagtaaagaaggngtatgtggactctgtgaaggccttcaccatctcagagacaacgccaagaactccgtgcatctgacaaatgaaacagtactgagacgccggaggacacggtacttaatttattactgcgcgaaggagaaaggtcgtgggtcgttacgacgtagtcgggcgaacgggacctggcctccgtctccncacncctaccaaccgacgggccctacgttccgtcccgttccccgtcggccgtccctcgcctaccgaggaccgcccaccgtaccgacgacgcacgcggccggtccgtgggcctcgccgtcgtacgaacggtaccttaccttccactacctactacctacgcggacggcgggctcggacgaaggcgtacanagcnnn

SEQ ID NO: 184451 - DNA, 679 bp, Homo sapiens
  misc_feature: GYAE6OF01A096P.37.57.F02.1.454.CMB.1.raw
  modified_base (448)..(448): a, c, t, g, unknown or other
  misc_feature (448)..(448): n is a, c, g, or t
  modified_base (479)..(479): a, c, t, g, unknown or other
  misc_feature (479)..(479): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtggggggtccctgagactctcctgtgtagcctctgtaactttcccctttacggctttagttggatgagtcgttggggtcccgccgagggcctaccggagggggaacggggcgtgggaggtggggtacggaccaaacgaataaagcaaagagtagggaaagtaaggaaggtagtagtggtaggactgtggtaggaacgggtccttacacctatcnccgagacgaacaacgaccaaagacctccgtnacatcgtagaactaaatcgaactagtcgtagaacggacggtcccggaagggaccgaacgggttcttaagttttacgttaacgcggaccggaacgaaggtaacgggaaacgggtacggttcggggggttccgtttaaccggacccgttacggggtcgggggaccctaaaccgggggtaccccttggggtcccgtaccccgg

SEQ ID NO: 184452 - DNA, 780 bp, Homo sapiens
  misc_feature: GYAE6OF01AZ4UE.37.57.F02.1.454.CMB.1.raw
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtggagggtccgtttcaccatctccagagacaacgccaagactccgtgcatctgacaaatgaacagtctagagacgccggaggaccacggtcttaatttactactggcgacgaagaggaaggtacgtggggtccggtttcgacgtacggtcggggaccaacggggtaacccctgggtacccacccgttcctcctacgacgtcccctacccgaaccgaaccgggcccctacggttccccggttacccctttccccccgtcgggccccggtcccccgttcggaccccttaccggacgggaccgtaccccgtaaccccgtacccggaacgaccggtacccgaaccggaccgggtacccccgggtccccggttacgggggcccgtttaccgggtccccggtttacggggtaacccggtaaaccgggttaacccctttaacccgttaccccgttaaccttacccgttaaacccgtaacccgttaaccggtcgggaacccgggtccgggggtacccgttcggggaacccgtaaacggggcccgtaactaacggtagccgagcgcg

SEQ ID NO: 184453 - DNA, 690 bp, Homo sapiens
  misc_feature: GYAE6OF01AURE5.37.57.F02.1.454.CMB.1.raw
  modified_base (490)..(490): a, c, t, g, unknown or other
  misc_feature (490)..(490): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggagcctcgtccagccgtggggggtccctgacgactctcctgtgtagcctctgtaactttccccgtttacggtctttagttggatgagcgtgggtcccgcgacggctaccggaggggacggggcgtgggaggtgggtcggaccaaacaagtaaagcaaagagtaggaaaggtaaggaagggtagtagtggtacgacgttcgtggtacggtaacgggtccgtttacgacctactcctaccgagaacgaaccaccgacaacgaactcgacgactanctacgaacaagtacgaactaggtacaggacggaacgaccggaacggtaccggacgttaacgtttaatttacgtaccgtcgggtacgtaccggaaaggaacggtaaaggggtccggttagggggttccggtttaccggtaaccggttacgggtacggggggacccgaacccggggtacccgttcgggtaccccttacccgg

SEQ ID NO: 184454 - DNA, 672 bp, Homo sapiens
  misc_feature: GYAE6OF01CH84K.37.57.F02.1.454.CMB.1.raw
  modified_base (664)..(664): a, c, t, g, unknown or other
  misc_feature (664)..(664): n is a, c, g, or t
  modified_base (666)..(672): a, c, t, g, unknown or other
  misc_feature (666)..(672): n is a, c, g, or t
tcagtagtgtagatcacgaccggtgctcgatttagctcgatatagttgggtttggggggtccctgagactctcctgtgtagcctctgaacttcccctttacggcttattggatgagctgggtccgccaggctccaggggaaggggctggagtgggtggccaacataaagcaagatggaagtaagaaggagtatgtggactctgtgaagggccgtttcaccatctcagagacaacgccaagaactccgtgcatctgacaaaatgaacagtctgagacgaccgaggacacggcttatttattactgcgcgagagaaggacgtgggcggtttcgacgtacgtggggccgacgggaaccctggtccaccgtctcctcacgccctaccaccgaacgggcccagtcccggtcccttccccccgtggcccgtccccgtcgtcccgtaccgacgggtacgacccacccgtcccgggaagaccgaccgaccgaaggcccccgggaccccgtcggggcctccggtccccggttacgggtcccggtaaacggtaaccccgtttacctttaccccgaacttttcccgaaacccttacccgttaaccgtacgggacggggcccggggtaccggttcggggaacccgtaacggggccggacgtaacgtagacgcagcngnnnnnnn

SEQ ID NO: 184455 - DNA, 734 bp, Homo sapiens
  misc_feature: GYAE6OF01DZHD7.37.57.F02.1.454.CMB.1.raw
  modified_base (177)..(177): a, c, t, g, unknown or other
  misc_feature (177)..(177): n is a, c, g, or t
  modified_base (618)..(618): a, c, t, g, unknown or other
  misc_feature (618)..(618): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcgtggtttctgttgctatttggagtntcagtgtgaggtgcaagttggtggagtcgtggggacgcctcgtccgagccgtgggggtccctgagactctcctgtgtagcctctagtaactttccccgtttaacggctttagttggactggacgtcgtcgggtccgccgacgggtcctaccggaagggggaacgggcgttagggaggttcggggtcggaacccgaaagtaagtaaagacgaaagagtaagggaaagtaaggaaggtagtagtggagtactcgtaggtacggtaacgggtcctttacaccgtagtccgtacgaacgtaacgaaccgaaccggtacccgtaaaagtacccgttccggtagacctaagtccgtaaggaacctaaagttcggaaacttcggtacctagggaaacggtaccggacggaacggtacgtaccggttaactttaagtttacttaacggngtaacccggaggtaaggaacgggtcggttaaccggcggggtttaaccggttaccgaacgtttccggggacggggttacccgaaaccgggtttacccggttcggcccgttaacccgg

SEQ ID NO: 184456 - DNA, 865 bp, Homo sapiens
  misc_feature: GYAE6OF01C09AZ.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccagtggaagttgggctggagcgttgggttttccttgttgcttattttggaaggtgtccagtgtgaggtgacgaagttggtggagtcggtgggggacggccgtcgtccgagccggtgggggtccctgacgacctctccgtgtcgcgacgtcctcgtaggactttacgtaacgttttggtacgtcttagttggaagttcgggacgttcgggtaccccgaaccgtacgttaccgtaccggaagggggaggggtccgtaggggtaacgggttgggtacggaacccgaaacgtacggtaaccggtaggggtaacggttagggttaacggtaaaaaccgtaaaaaacgtttaggtacgggttaggtacccgttacggttacggtcgggtacccggggtaccgtaagtttaccccaaccgttacgttacccgtacccgaaaggtaaccgaaacccgtaaaaccggaaaccccttaaaaaacgtccgtaaacgttacggttacctaccggttaacgaaaccgtaaagggttaccggaaccgggtccgtaacggacggtaaaccggttacccgggaacgggtacccgtacgggtacgttcggtttaacggtttagtttaacggttaggttacgggaacgttaacggtaaggttaaactttacggtaaaacgtttaaaccggttaagggttttaacgacgttaacgggttaaccgttgggttaaagttcgttagtttaacgg

SEQ ID NO: 184457 - DNA, 713 bp, Homo sapiens
  misc_feature: GYAE6OF01D1XCM.37.57.F02.1.454.CMB.1.raw
  modified_base (352)..(352): a, c, t, g, unknown or other
  misc_feature (352)..(352): n is a, c, g, or t
  modified_base (535)..(535): a, c, t, g, unknown or other
  misc_feature (535)..(535): n is a, c, g, or t
  modified_base (553)..(553): a, c, t, g, unknown or other
  misc_feature (553)..(553): n is a, c, g, or t
  modified_base (559)..(559): a, c, t, g, unknown or other
  misc_feature (559)..(559): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcacatggaattggggctgagcgttgggttttccttgttgcttagttttggaaggtgtccagtgtgaggtgctaagttgggtggaggtcgtgggggaggcctcggtccacggtccggtcggggggtccctggacgtacctcctccgtggtgtacgtcccttcgtggtaacttttcccccgtttaggtcctttaagttgggattggacgtcttcggggggtcccncccgaagggccgttcccggaagggggaacggggtcctagggaaggtcggggtcggacccaaacgaagtaaaagcaaaggagtaggaaagtaagaaaggtagtaacgtggtaggactgtaggtaggaacgggtccctttcgactatctccgaagacgaaccaacgaccgaaagacgtcccgtanacctatcgagaactaaanagaacngtactaggagtacgacccgaaggaaccgaggtacttagttaacgttacgcggtacgacggtaaggaacggaagggttaccggtgggggttaccctttacggaaccgtacgggtccgggggaacccgtaacggggtaccccgtcgggtaaccccg

SEQ ID NO: 184458 - DNA, 723 bp, Homo sapiens
  misc_feature: GYAE6OF01D3VY7.37.57.F02.1.454.CMB.1.raw
  modified_base (526)..(526): a, c, t, g, unknown or other
  misc_feature (526)..(526): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaagttggggctgagcgttgggtttttccttgtttgcttatttttggaaggtgtccagtgtgaggtgctaagttggtggagtcgtgggggagcctcgtccgagccggtgggggtccctgacgacctctccgtgtgtacgccttctacgtaacctttccccgtttacggtctttaagttggatggagcgtcgggtcccgccacggcgtccggaggggaacgggcgtgggaggtggggtcggaccaaacgaagtaaaaggacaagagtaagggaaagtaaggaaagggtagtagtggtagacttgtggtaggaacggttccgttacacctactcctacgagacgaaccgaaccgtacaaagtacccgtcgagtcacttacgacacgtaaanagtaaacgtatcgtagaagaccggacggaaggaaccgtcggtactttaacgtttacgtacgtcggaacgcggaaaggaaccggtaagggggtaccggttacggggttaccgtttaccgggaaaccgttaccgggggtaccggggaaccccggtaacccggggttaacccggtttcgggtacccgttaaccccccggg

SEQ ID NO: 184459 - DNA, 832 bp, Homo sapiens
  misc_feature: GYAE6OF01CNC27.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcttggttttcctgttgcttattttagaaggtgtccagtgtgacgtgcaacgtggtggagtcgtgggggagtcgttggtccaggccgtcggggggtccctggacgactcgtccgtgtcgcgacgccttcgtaggtacttacgtaacgtttgggtagtcttagttggatcgggtacgttcggggtcccgaccgtaacgttccgtaccggaaggggaacggggtccgttaggggagggttcgggtcggaacccgtaaagacgttacggaaggggtagggttacggtaagggtaaaaaccgtaaaaacgttgttacggtacggtacccgttagttacgggttcgggaccgggggtaccgttaacttacccgaacctaacgttcccgttaaccgaaacggaaccggaaaacccgaaacccgtaaaccccgtaaaaaaaccgttctaaacccggtttaagttaaccttaccggtaacggtaaaccgtaaaaggttccggggaaccgtacccggttaaggaaccggtaaccggttaccgggaacggtaaccgaccgggttcgttaagggttacgttagtttaggttcggtaggtacggtaacggtaagttaacggtttaacgaaaccgtttaaaggttaaccggtttaggaacgttacgtaacggttaggttactaggtcgttaacgg

SEQ ID NO: 184460 - DNA, 566 bp, Homo sapiens
  misc_feature: GYAE6OF01A7K8L.37.57.F02.1.454.CMB.1.raw
  modified_base (413)..(413): a, c, t, g, unknown or other
  misc_feature (413)..(413): n is a, c, g, or t
  modified_base (439)..(439): a, c, t, g, unknown or other
  misc_feature (439)..(439): n is a, c, g, or t
  modified_base (554)..(554): a, c, t, g, unknown or other
  misc_feature (554)..(554): n is a, c, g, or t
  modified_base (557)..(566): a, c, t, g, unknown or other
  misc_feature (557)..(566): n is a, c, g, or t
tcagtagtgtagatcacgaccggtgctcgatttagctcgatatagttgggtttggggggtccctgagactctcctgtgtagcctctgaattcccctttacggcttattggatgagctgggtccgccaggctccaggggaaggggctggagtgggtggccaacataaagcaagatggaagtaagaaggagtatgtggactctgtgaagggcctttcaccatctccagagacaacgccaagaactccgtgcatctgacaaatgaacagtctgagagccgaggacacggctatttatactgcgcgaagagaaggtacgtgggtcggtttcgactacgtcggggccagggaaccctggtaccaccggtctcctcacgccctaccaccgaacgggcccagtccggtcccttcccccgnggcccgcccgtcgcctccgacggacnccaccgtccgagacgcacgacggcccggccgtgggcctcgccgtggtacaacggtacctactccatacctactactcgtgacggccggcgtacggcgaacgggcgcgtaagtagngcnnnnnnnnnn

SEQ ID NO: 184461 - DNA, 835 bp, Homo sapiens
  misc_feature: GYAE6OF01BTMTV.37.57.F02.1.454.CMB.1.raw
tcagtagtgtagatcacgaccggtgctcgatttagctcgatatagttgggtttggggggtccctgagactctcctgtgtagcctctgaattcccctttacggcttattggatgagctgggtcccgcccaggctccagggaaggggctggagtgggtggccaacataaagcaagatggaagtaagaaggagtatgtggactctgtgaaggccgtttcaccatcctccagagacaacgccaagaactccgtgcatctgacaaatgaacagtctgagagccgaggacacggctagtttattactgtacgagacgaacgagtacgttggggacccaacggggtaaccctgggtaccaacccggttccttccctaccgaccggtccccttacccgaacccgaacggggtaccccctaaagttcccggggttacccctttcccccccgtcggggtccccgtacccccgtttacgggtaccccgtttacccccgaaaggggtaaacccgccccggtaaccccgttaccccggggaaggaacccggtacccgaaaccggtaacccgggccccggggtaccccccgttgggggtaccccgttgggaccccccggtttaggggtaaccccgtaaaacggggttaaccccctttaccggtttaacccctacgtttaccctaaacccgtacttaacccggtacgggtacgggtacccggggtaccgttaccggggacccgtaaacggggtcccgtaccgttaaacggtacccggtagaacccggttgtaaccgccggttaactccggaactgggttccccgtaacgacccgacgcgtcgtaccgtac

SEQ ID NO: 184462 - DNA, 602 bp, Homo sapiens
  misc_feature: GYAE6OF01A8XX4.37.57.F02.1.454.CMB.1.raw
  modified_base (308)..(308): a, c, t, g, unknown or other
  misc_feature (308)..(308): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtggggggtccctgacgactctcctgtgtagcctctgaacttcccctttacggcttattggatgagctgggtccncaggctccgaggggagggctgggagtgggtgaccaacataaagcaagataggaaagtaagaaggagtatggtggactcgtgtggaacgggtcctttacaccgattcctcaagacgaccaacgccaaagaacctccgtagcatctagcaaatgaactagtctaggagacgccggaaggaccacggtcttaatttactacgtcggcggaccgagaagggaaaggacgttagggggtccggtttacggacttacggtcgggggacccaaggggaaccccttgggtacccctacccgg

SEQ ID NO: 184463 - DNA, 1025 bp, Homo sapiens
  misc_feature: GYAE6OF01B2RCC.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagtcttgggttttccttgttgtcttagttttgggaaggtgtcctaggtgtgaggtgctaagttgggtggtaggtcggtgggggacgtccgtccgtaccgaggtcccgggttcggggggtcccctaggacgtaccttccgttccgtggtacgtacgtcccttacgttacgttaaccgttttcccccgttttaacggtcctttaagttggactggacggtccgtcgggggtccccgaccggtacgggtcccgtaccgggaagggggaacggggtccgtaggggtaggggttcgggggtacggaacccaaaacggtaaacgttaaaaacggaccgtaaaaggtaaggtaaggggtaaaaaaggttaaaaggggaaaaggggttaacggttaagtacgggttaagggtaaccctttagggtacggggttaacggggtaaaccggggtttacccccgtttacccgaacccgttacgttaccccgtaccgggtaaacggaaaccggaaaacccccaaaccgggtaaacccccgaaaaaccggttaacccggttacccggtaccgtaaccgtaaccgtttaccgtaaacggaaaccttaaaaacggtttaccggaaaaccggttacggttaccgtaacggggaaaccgggtaacccgggaacccggggtaaacgggaacccggttaaccgggttttaactttaacgttttttaacggtaccggtaaccgggaccgggtaaaccgggtaaaggtaacggggtaaaccgggggttacggtttccgggggggtttacccgggttttaaccggaacgggtttaacccgggggtaccggggggaaacccgtaaacccgggggttaaccccgttcgggttaaccccccgg

SEQ ID NO: 184464 - DNA, 738 bp, Homo sapiens
  misc_feature: GYAE6OF01CVC00.37.57.F02.1.454.CMB.1.raw
  modified_base (276)..(276): a, c, t, g, unknown or other
  misc_feature (276)..(276): n is a, c, g, or t
  modified_base (346)..(346): a, c, t, g, unknown or other
  misc_feature (346)..(346): n is a, c, g, or t
  modified_base (601)..(601): a, c, t, g, unknown or other
  misc_feature (601)..(601): n is a, c, g, or t
  modified_base (723)..(723): a, c, t, g, unknown or other
  misc_feature (723)..(723): n is a, c, g, or t
  modified_base (725)..(725): a, c, t, g, unknown or other
  misc_feature (725)..(725): n is a, c, g, or t
  modified_base (728)..(728): a, c, t, g, unknown or other
  misc_feature (728)..(728): n is a, c, g, or t
  modified_base (730)..(730): a, c, t, g, unknown or other
  misc_feature (730)..(730): n is a, c, g, or t
  modified_base (733)..(738): a, c, t, g, unknown or other
  misc_feature (733)..(738): n is a, c, g, or t
tcagtagtgtagatcacgaccggtgctcgatttagctcgatatagttgggtttggggggtccctgagactctcctgtgtagcctctgaactttcccctttacggcttattggatgagcgtgggtccgccaggctccgagggggaaggggctgggaggtggggtggacccaaacaataaagcaaagagtagggaaagtaaggaaggatatggtggactcgtggtggaacgggtcctttacaccatctccagacgaccaacgaccaaagaacctccgngcactctagaacaaatgaacagtcaggaaggacggaccggaaggacgtacggtctttaatttacttacgnggcgagaaggaggacggtacggtcgggtccgttcacgtcggcgggaccgacgggtaccccgtggtaccaccgtcctaccctcgaccgtaccccctaccgaaccggaacccggggtcccctacggttcccgtttccccccgtttccccgcgggtcccccgtcccgtcgacccgtaccgacgggacccacccggtaccccgtacggaaccgcgacccgaaccggaccgggtccccgggacccggtttcggggacccncccgggttaccggtacggtaaccgaaccggttaccctttacctacccgtaacttaccccgtaacaccgttacgggtcgggaaccggcgggtacgacggaaccggtcgaccgtaccaagcgancncgncncgnnnnnn

SEQ ID NO: 184465 - DNA, 762 bp, Homo sapiens
  misc_feature: GYAE6OF01EM4HM.37.57.F02.1.454.CMB.1.raw
tcagtagtgtagatcacgaccggtgctcgatttagctcgatatagttgggtttgaggtctcagagaggagccttagcccctggacctccaacggcctttccacttggtgatcagcactgagcacagaggactcaccatggaattggggctgagcttgggttttccttgttgcttattttggaaggtgtccagtgtgaggtcgacaagttggtggagtcgtgggggacgcctcgtccagccgtgggggtccctgagactctctgtgtacgcctctacgtaacttccccgttacggtcttagtggatggacgtcgtcgggtcccgccgaggcctaccggaggggagggctgggaggtgggtcgaccaacagtaaagcaagagtaggaaagtaaggaaggtagtagtgtacgtactcgtaggtacggaacggtccgttacgacctacttccgtacgaagacgaaccgaaccgacctaaacggaacccttccggtacggactacgttcgaacgaacctaaagtccggaaactcggttacgaggaacgggaccgggtacccggaagggtaacccacgggtttctttaaacgttttacgtacccgggtacggacccgggaacggttaacgggaaacgggtaaccgggtttacccggttacggggggtttacccggttttaacccggaaaccccgggtttccgggggtacccggggggaaacccccgttaaaccccgggggttaacccccgttcggggttaaccccccg

SEQ ID NO: 184466 - DNA, 667 bp, Homo sapiens
  misc_feature: GYAE6OF01AQ0CN.37.57.F02.1.454.CMB.1.raw
  modified_base (589)..(589): a, c, t, g, unknown or other
  misc_feature (589)..(589): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcgtgggttttccttgttgcttagttttggaaggtgtccagtgtggaggtgacaagttgggtggagtcgtgggggaggcctcgtccgacgccggtcggggggtccctgacgtacctctccgtgtgtacgcctcgtggtattctaacgtttggtagtcttagttggatgggacgttcggggtcccgccgtaggttccgtaccggaggggaacgggggtctaggggtaggtggggtcggacccaaagagtacggaggggtaggtggggtaacggtaaacgaaaaacgttgtggttaggacttcgtggtcgggccggggccgtattccacctatcctcgagacgacaaccgaaccaaaactcactgtactctagacaagtcgggacgtcgtaggacgtacgtaccggaaggaccgacggtcttaggtagttattacgttggngtacggagtacgttagtttaacgaacttaacggttaaggtttacgaaggttcgtacgttaggtatggtagtgttaacg

SEQ ID NO: 184467 - DNA, 663 bp, Homo sapiens
  misc_feature: GYAE6OF01AQXEV.37.57.F02.1.454.CMB.1.raw
  modified_base (648)..(648): a, c, t, g, unknown or other
  misc_feature (648)..(648): n is a, c, g, or t
  modified_base (650)..(663): a, c, t, g, unknown or other
  misc_feature (650)..(663): n is a, c, g, or t
tcagtagtgtagatcacgaccggtgctcgatttagctcgatatagttgggtttgggggtccctgagactctcctgtgtagcctctgaattcccctttacggcttattggatgagctgggtccgccaggctccaggggaaggggctggagtgggtctcaagtactagtgctcctggtaaatagagcagactacgcagactccgtgaagggccggttcaccatctccagagacaattccaaagaacacgctctatctgacaaatgaacagcctagagagaccgaaagacacggtcctaatacttactgtgtaggaaacggcgtgggggagtggggggactacggtcggggaccgaacgggtacccgtggtccgaccgttcctccctcgacgtcccctacccgaacccgaacggtaccccacgttcccggttacccttccccccgtcggacccctaccccctacccttacccgaaacgaccgacccgtacccgttccggtacggggtcccgaccggaaccggccccggtcccggtcgggtccgtcgtaccgttcggtaccgaacggtacctaccgttaccgtaacgttacctaccgtaaccgtacgtcggaccggccgggtcgttcggaccgtacgggacacgtagtacgngnnnnnnnnnnnnnn

SEQ ID NO: 184468 - DNA, 627 bp, Homo sapiens
  misc_feature: GYAE6OF01A0LWK.37.57.F02.1.454.CMB.1.raw
  modified_base (287)..(287): a, c, t, g, unknown or other
  misc_feature (287)..(287): n is a, c, g, or t
  modified_base (306)..(306): a, c, t, g, unknown or other
  misc_feature (306)..(306): n is a, c, g, or t
  modified_base (622)..(622): a, c, t, g, unknown or other
  misc_feature (622)..(622): n is a, c, g, or t
  modified_base (627)..(627): a, c, t, g, unknown or other
  misc_feature (627)..(627): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccgagggaaggggctggagtgggtggccaacataaagcaagatggaagtaagaaggagtatgtggactctgtgaagggccgtttcaccatctccagagacaacgccaagaactccgtgcatctgcaaaatgaacngtctggagagccgaggacncggcttatttatactgcgcgagagaagggactggggcggtttcgacgtacgtgggggaccaggggtaaccctggtccgaccgtctcctcgacgccctccaaccgaacgggcccctagtccggtcccttcccccgtggcccgtcccctgcctcccgaggacgccaccctccgagacgccacgacggccggccccgtgggcctcggccgtgggtaccgaaagtacccttaccttcctactacccgttaacctaccgtaaccgttcgggaaccgggtccggggacttcggggacccgaaagggtcccgactaaggtagntgcgn

SEQ ID NO: 184469 - DNA, 637 bp, Homo sapiens
  misc_feature: GYAE6OF01DQC4U.37.57.F02.1.454.CMB.1.raw
  modified_base (318)..(318): a, c, t, g, unknown or other
  misc_feature (318)..(318): n is a, c, g, or t
  modified_base (355)..(355): a, c, t, g, unknown or other
  misc_feature (355)..(355): n is a, c, g, or t
  modified_base (518)..(518): a, c, t, g, unknown or other
  misc_feature (518)..(518): n is a, c, g, or t
tcagtagtgtagatcacgaccggtgctcgatttagctcgatatagttggggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaagttggtggagtcgtgggggagcctcgtccagccgtggggggtccctgagacctctccgtgtgtacgccttctggactttctaacgtttggtagtcttagttggatggactgggtccncagtctccgaggggagggctggagtgggtcgaccaanatacggagggaggtggtaggtaaacgaaaaatgtaggtggacttgtggtcgggcgggaccgtattccaccatcctacgagacgaaccaacgaacccaaaaactctacgtgtactctagaacaagtcggaccgtccaggacgacgtccggaaggcgaacgggtnttaggttacgttatttacggttgcggtacggaagtaagttaacgtttacgaaccttaagttaaacggttttaccgaaggttacggtaacgtttagggtaatttggtaagttgtttaacg

SEQ ID NO: 184470 - DNA, 630 bp, Homo sapiens
  misc_feature: GYAE6OF01CHYZX.37.57.F02.1.454.CMB.1.raw
  modified_base (625)..(625): a, c, t, g, unknown or other
  misc_feature (625)..(625): n is a, c, g, or t
  modified_base (627)..(627): a, c, t, g, unknown or other
  misc_feature (627)..(627): n is a, c, g, or t
tcagtagtgtagatcacgaccggtgctcgatttagctcgatatagttgggtctgggggaggcctcgtccagcctgggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgacaaatgaacagtctgagagccgaggacacggctatttatactgcgcgagagaaggacgtgggcggtttcgacgtacgcggggaccaacggggaaccctggtccaccgtctccgtcacgccctacccaaccgaacgggcccacgtccggtcccttcccccgtcggccgcccctcgccctccgaggacgccacccgtccgagacgccgacgacgcccgggacccgtgggcctcggcccgttgggtaccgtaaacggtaccttaaccttcccgaacttcccgtaacctaccgttaaccgtgggaccggtaccggggtcgtcgggacgaaacgggccgtacgtaacgtagcngntac

SEQ ID NO: 184471 - DNA, 713 bp, Homo sapiens
  misc_feature: GYAE6OF01DNW7L.37.57.F02.1.454.CMB.1.raw
  modified_base (356)..(356): a, c, t, g, unknown or other
  misc_feature (356)..(356): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgcttattttggaaggtgtccagtgtgaggtgcaattggtggagtcgtgggggaggcctcgtccagccgtggggggtccctgacgactctcctgtgtacgcctctgtaactttccccgtttaggcttagttggatgagtcgtgggtcccgccgaggcctccggaggggaacgggcgtggggaggtggggnggaccaaacgaagtaaagcgaagatagggaaagtaaggaaggagtagtggtaggtactcgtggtagggaacgggtcctttacacctagtcctaccgaggaacgaaccaaccgacaaacgtacctcccgtgacctaacgttctacgaacaaaacgtcgaaacgtacgtcgtacgggaacgacggacccggaaggaccgtaaccgggtactttaacggttttactaccggtacggaccggaccggtaaggaaagggtaaacgggtaccggttcgggggttaccggtttaccggaacgttacccggggtcggggggaacccgtaaccggggtaaccccggttgggtccccgtaaccccgg

SEQ ID NO: 184472 - DNA, 766 bp, Homo sapiens
  misc_feature: GYAE6OF01D2A5K.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaagttggggctgagcttgggttttccttgttgcttattttggaaggtgtccagtgtgaggtgcaagttggtggagtcgtgggggagcctcgtccgacgccgtgggggtcctgacgactctctgtgtacgtcctctagtaactttccccgtttacggtctttagttggatgacgtcgtcgggtcccgaccgaggccgtaccggaaggggacggggtcgtgggtacggtgggtacgaacccaaagtaagtaaagacgaaagagtaggaaagtaaggaaaggtagtagtggtacggtactcgtaggtacggtaacgggtcctttaccaaccgtacgtccgtacgaacggaacgaaaccgtaaccgaacctaaaacggtaccgtccgtacgacctaagtccctaagaaaccaaagttaccgaacgtagttacgaggaaggacccggacggaacggtaccgtaaccggttactttaagtttaccgtacgtcggaccgtacgggaaaggtaacgggtaaacgggttccgggttacggggtttcccggtttaaccggaaaccggtttaccggggtacccgggggaacccgtaaacccggggggtttaccccgtcggttaccccggttaacccccg

SEQ ID NO: 184473 - DNA, 675 bp, Homo sapiens
  misc_feature: GYAE6OF01D1VBM.37.57.F02.1.454.CMB.1.raw
  modified_base (622)..(622): a, c, t, g, unknown or other
  misc_feature (622)..(622): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcgttgggttttccttgttgcttattttggaaggtgtccagtgtgaggtgctaagttgggtggagtcggtgggggacggcctcgtccaggccgtcgggggtccctgacgacctctcctgtgtacgccttcgtagtaacctttccccgtttacggctttagttggatggacgtcgtacgggtcccgccgaggccgtacgggagggggaacgggtcggtgggtacgggtcgggtacgaaccgaaactaaagtaaacgacgtaaaggtagtaaacgggaaaggtaaagggaaggtagttagtaggtacggtacgtgtaggtacggtacgggtccgttacacctcgtacaccgagaacaccgaacgacgtaaacgaccgtcgacactacgtacagaactaagacaacgtgtacgtagacggacgaccggagacgtacgttacttatttacgcgtacgcgaaggtaagaggtacggnggtacgggttcgtaccgagtacgggcggacgtaacggccgtcggtccgtaccg

SEQ ID NO: 184474 - DNA, 671 bp, Homo sapiens
  misc_feature: GYAE6OF01DS3FC.37.57.F02.1.454.CMB.1.raw
  modified_base (366)..(366): a, c, t, g, unknown or other
  misc_feature (366)..(366): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaagttggggctgagcttgggtttttccttgttgcttattttggaaggtgtccagtgtgaggtgcaattggtggagtcgtgggggagcctcgtccgagccgtgggggtccctgacgactctcctgtgtacgcctctcgtaactttccccgtttacggctttagttggatggagtcgtcgggtccgccgacggccgtcgaggggagggcgtgggaggtgggtcgaccaanagtaaagcaaagagtaggaaagtaaaggaaggagtagtggtaggactcgtggtaggaacgggtccgtttcaacctactcctacgaagaccgaaccaaaccgaccaaaagtacctccggtagacctatctagaacaaatccgaaatcgtcgtaggacgacgacggaagtcgaacgtctttaatttacgacgtcgacggacaaggtaaggaaaccgggttcggtacgggggttccggtttaacgaaccgtttaaccgggcgggggtaaccccaacggggtaaccccttcgggaacccttacccccgg

SEQ ID NO: 184475 - DNA, 591 bp, Homo sapiens
  misc_feature: GYAE6OF01COYDS.37.57.F02.1.454.CMB.1.raw
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (299)..(299): a, c, t, g, unknown or other
  misc_feature (299)..(299): n is a, c, g, or t
  modified_base (452)..(452): a, c, t, g, unknown or other
  misc_feature (452)..(452): n is a, c, g, or t
  modified_base (471)..(471): a, c, t, g, unknown or other
  misc_feature (471)..(471): n is a, c, g, or t
  modified_base (571)..(571): a, c, t, g, unknown or other
  misc_feature (571)..(571): n is a, c, g, or t
  modified_base (587)..(591): a, c, t, g, unknown or other
  misc_feature (587)..(591): n is a, c, g, or t
tcagtagtgtagatcacgaccggtgctcgatttagctcgatatagttgggtctgggggaggcctcgtccagcctggggggtccctgagactctcctgtgtagcctctgaattcccctttaggcttattggatgagctgggtccgccaggctccgaggggaaggggctgggagtgggtggccaaacataaaagcaagatgggaaagtaagaaaggagtagtgtggactcgtggtagaagggtccgtttcaccatcctcagagacaacgccaagactcgtgcatcngcaaatgaacngtcngagagccgaggacacggcttatttatactgcgagagaggaagcgtgggcgttcgactagcgggccaagggtaccctggcccaccgtctcctacacgtccctaccaaccgaagggcccctagttccgggtcccttcccccgtcggcccgtcccncgtccctccgaacgggacncctacccgtacgacgacgccacgacggcgcccgtcgggctcgccgtcggtacgaacggtaccttaccgttcacgtactaccacttacgcgacggcggcgnggacgtaggcgacagnnnnn

SEQ ID NO: 184476 - DNA, 809 bp, Homo sapiens
  misc_feature: GYAE6OF01DBCJD.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgcttattttggagtgtccagtgtgaggtgcaattggtgggagtcgtgggggagcctcgtccgagccgtggggggtccctgacggactctccgtggtgtacgcctctagtaactttcccccgtttaggtcctttattacggatggaagtccgttggggtaccccgccctaagggccttacccgggaagggggtaaacggggtcgtgggtaaggttcggggtgggaacccctaaagaacgttaaaacgactaaaagggtagttaccggggaaaaggttaaaggggaaaggttaaggtaagtttacggggtaacggtaccgttacgttagggtacgggtaaaccgggggtttcccggttttccggaacccgtagttcccctaacggaacgaacggaaccgaccgtaaccgaaaacgtaccttccgggtaacacgtactcgtaacgacaaaagtcgaaccgtagtaccggtgaaccgtaccgggacggaacggtaaccgacgttactttaattaccgtacttacggaccggttacgaaagggaggttaacgggtaggttccggggttaacgtttaccgggtaaccgtacggggttacgggggaaccccgtagggggtaacccctttcgggtacccgtaacccccgg

SEQ ID NO: 184477 - DNA, 690 bp, Homo sapiens
  misc_feature: GYAE6OF01BHM7Q.37.57.F02.1.454.CMB.1.raw
  modified_base (326)..(326): a, c, t, g, unknown or other
  misc_feature (326)..(326): n is a, c, g, or t
  modified_base (374)..(374): a, c, t, g, unknown or other
  misc_feature (374)..(374): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttcctgttgctattttggaaggtgtccagtgtgaggtgcaattggtggagtcgtgggggaggcctcgtccgagccgtcggggggtccctgagacctctcctgtcgtacgcctctagtaaccttccccgtttacggctttagttggactggacgtcgtcggggtccccnccgaggcctccggaggggaacggggcgtgggaggtgggtcggaccaanaagtaaagcaagatagggaaagtaagaaggagtagtggtaggactgtggtaggacgggtcccgttacacctatcctacgagaacgacaaccgccgtaaagacctccgtgcatcagactaatgaactgtctagaggaccgacggaacggtacgtaccggtactttaagttaacgtacgtggaacccggtaggaagggtaacggaaacggggttaccggttcgggggttaccgggtttacccgaaaccgggttacgggtaccggggggtaacccctaaccggggggtaacccccttcggggtacccccgttaccccgg

SEQ ID NO: 184478 - DNA, 747 bp, Homo sapiens
  misc_feature: GYAE6OF01CX0L0.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcttgggttttccttgttgcttattttggaaggtgtcagtgtgaggtgctaattggtggagtcgtgggggagtcctcgtcccgagtccggtcggggggtccctggacgaccttctccgtgtcgtacgccttctacggaaccttttccccgtttaggtcctttagttggtatggacgtcgtcgggtccgccgaggcctaccggaggggaacggggtctaggggaggttcggggtacggaccaaacgtaagtaaaacgacgaaaggaacggttaaggaaaggtaaaggaaaggtagtagtgtaggacttcgtaggtaggaacgggtcctttacaaccattccgaccgaagacgaacaacccgaccgaaaacgtaccgttcgtacgctaacgttcgaacgtaacaaagtacgaaacgtacgtaccgtaggaaccgacggacccggaaaggtaccgtaacggttactttaagtttaccttacgtacggacggaggtaaggaaggaacgggtacggttggggttacccggttacgtaacccggtacgggttacccggggaaccgtaacccggggtaacccgttccgggtaccctacccccgg

SEQ ID NO: 184479 - DNA, 616 bp, Homo sapiens
  misc_feature: GYAE6OF01DLLSG.37.57.F02.1.454.CMB.1.raw
  modified_base (316)..(316): a, c, t, g, unknown or other
  misc_feature (316)..(316): n is a, c, g, or t
  modified_base (342)..(342): a, c, t, g, unknown or other
  misc_feature (342)..(342): n is a, c, g, or t
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
  modified_base (457)..(457): a, c, t, g, unknown or other
  misc_feature (457)..(457): n is a, c, g, or t
  modified_base (478)..(478): a, c, t, g, unknown or other
  misc_feature (478)..(478): n is a, c, g, or t
  modified_base (492)..(492): a, c, t, g, unknown or other
  misc_feature (492)..(492): n is a, c, g, or t
  modified_base (611)..(611): a, c, t, g, unknown or other
  misc_feature (611)..(611): n is a, c, g, or t
  modified_base (614)..(614): a, c, t, g, unknown or other
  misc_feature (614)..(614): n is a, c, g, or t
tcagtagtgtagatcacgaccggtgctcgatttagctcgatatagttgggtctgggggaggcctcgtccagcctggggggtccctgagactctcctgtgtagcctctgaactttcccccttttacggctttattggatgagctgggtccgccaggctccgagggaagggctggagtgggtggccaacataaagcaaagatggaaagtaagaaggagtatgtggactcgtggtgaaggggtccttttcaacctatctccaagagaccaaacgccaaagaacctccgtagcaatcgtgacaaaatgaacagtcagagngccgaggaccaggtctatttatacgngcgacgagagaaaggcggtgggtcgttcgaacgttaggtcggggccaacgggaaccctggtaccaccgttcncctnacgcctaccgaaccgaggcccagttccgtccttccccgnggtccgccctgctcgaggacnccgacctcgagacncgaccgacgccggccgtgggctcggccttcggacgaaacggtctacttaccacgttcctaactaactaccgtacggaccgggtcgggtacgtcggtaccggaacggccgtcgaagacgntgngc

SEQ ID NO: 184480 - DNA, 735 bp, Homo sapiens
  misc_feature: GYAE6OF01DETKR.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagagactcaccatggaattgggctgagcgttggttttccttgttgctattttggaagtgtccagtgtgaggtgctaagttggtggagtcgtgggggacgtcctcgtccgaggtccggtcgggggtccctgacgaccttctccgtgtgtacgccttctagtaacctttcccccgttaaggtcctttagttggaatggacgtcgtcgggtccccgaccgacggtccgtacggaaggggaacgggtcgtagggtaacgggttgggtacggaaccctaaacgtaaagtaaaacggacgaaaggtagtaaggaaacgtaaaggaaggtaagtagtcggtaggtacttcgtaggtacggtaacggtcccgtttacacctactccgtaccgaagaccgaaccgaaccgaccgaaagtaccgtccgtagacctacgtcgagaactaaacgtcgaaactcgtacaaggaacgtaccggaccggacgaaccgtacggttactttaacttttacgaccgtggaccggacggtaaggaacggtacggtaccggttggggttacccgtttaacgaccgtacggggtaccgggaccgtacgggtaacccggtcgtacccgtaccccg

SEQ ID NO: 184481 - DNA, 852 bp, Homo sapiens
  misc_feature: GYAE6OF01CDPWF.37.57.F02.1.454.CMB.1.raw
  modified_base (814)..(814): a, c, t, g, unknown or other
  misc_feature (814)..(814): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcttgggttttccttgttgcttagttttggaaggtgtccagtgtgaggtgctaagttggtagggagtcggtgggggacgcctccggtccaggccgtcggggggtccctgacgacctcgtccgtggtcgtacgtccttcgttggtttccatttccgtttaacgacctaaaccgttaccgccctaagttcggacgtcggttccggggtaccccggccgacgggtcccttaccgggaaaggggggtaacggggtccgtaggggtacggttcggggttcctaacggtagggttaactttaccggtagggttaacggtacggttaaaacctaccggactaaacgttacccgttaccgaaccgtaacggtaacccgttcccgggtaaccggggtcccggggttaccccggtttacccgaaccccggtttcctacccggaaggtaaaccgtaaccttaaaaccgtttaccccgaaaagttaacgttaccggttactaacgtcgtaaaggtaaaacgtcgaacgtacgtccgtaaggacggtaaccggaccgacggtaacccgacccggtaccctttacgttaagttaccgtcgtaaggccggtaacgtacgagtaaccgggaaacgtaggggtaacttacgggacgaaccggtaacctacgggttaacccncgtttaaacccgggtcggtaaacggttacccccggggg

SEQ ID NO: 184482 - DNA, 764 bp, Homo sapiens
  misc_feature: GYAE6OF01BQRK7.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtgggggtccctgacgactctcctgtgtagcctctgtaactttcccctttacggcttagttggatgagcgtgggtccgcaggcctccgaggggacgggcgtggagtgggtcgaccaagagtaaagcaagagtaggaaagtaaggaaggagtatggtaggtacttcgtggtacggaacgggtcccgtttacacctactccgtaccgaaggtacgaaccgtaaccgacccgaaaacggtaaacccttcccggtagacccgtaacgttccgtaggaaaccctaaaagtccggaaaacctcgggtttaccgtagggttacggaaccgggtaccccgggaaaggtaacccggtaccgggttaaccttttaagttttaaccgtaccgtcgggtaccggaccggtaaaggtaacccgggtaaagggtaccggttacggggggttaccccgggttttaccgaaaccggttaacccggggttcggggggaacccccttaaacggggggtaacccccgtttgggtaccccgtaaccccggg

SEQ ID NO: 184483 - DNA, 718 bp, Homo sapiens
  misc_feature: GYAE6OF01EK2GU.37.57.F02.1.454.CMB.1.raw
  modified_base (265)..(265): a, c, t, g, unknown or other
  misc_feature (265)..(265): n is a, c, g, or t
  modified_base (429)..(429): a, c, t, g, unknown or other
  misc_feature (429)..(429): n is a, c, g, or t
  modified_base (519)..(519): a, c, t, g, unknown or other
  misc_feature (519)..(519): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattgggctgagtctggttttcctgtgcttatttggagtgtcagtgtgaggtgctaattggtggagtcggtgggggacgcctcgtccaggccgtgggggtccctgagcctctccgtgtgtacgcctntcgtaactttcccgttaggcttagttggatgacgtcgtcgggtcccgtaccgaggccgtacggaagggggtaacggggccttaggggaggttcggggtacgacccaaacgtaaagtaaaagaccaaaggtagtaaggaaaaggtaaaggaaggtacgttaaggnggttaggtaaccgtgttaggtaggtaaccgggttccttaccgaactactcgtaccgaagtaacgaacctaacggaccaaagtactccgtnacatcctagactaaatcgaaacgtgtgtaaggaactagacccggaagggtaacctcggtaatttaagtttaacttcgacgggtccgaaacgaggtaaacgggtagggtaccgttacgggggttcccggtttaccaacggtttaacgggtccgggggaacccgttaaacgggacccccgtttagggccctttaaccccgg

SEQ ID NO: 184484 - DNA, 634 bp, Homo sapiens
  misc_feature: GYAE6OF01BGNDA.37.57.F02.1.454.CMB.1.raw
  modified_base (308)..(308): a, c, t, g, unknown or other
  misc_feature (308)..(308): n is a, c, g, or t
  modified_base (445)..(445): a, c, t, g, unknown or other
  misc_feature (445)..(445): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaggtgtccagtgtgaggtgcaattggtggagtcgtgggggaggcctcgtccagccgtggggggtccctggagactctcctgtgtagcctctgaactttcccctttacggcttattggatgagctgggtccncaggctccgaggggaggggctgggaggtgggtggccaacgataaagcaaagataggaagtaagaagggtagtagtggtggactctggtagaacgggtcctttcacctatctccagacgacaacgccaaagacctcgncatctgacaaatgaaactgtctagaggacggacccggaggtacccgacgggtcttaagttttactaaccgtggaccgtaggaaacggtaaggtaacgggtggttacgggggttccgggtttaccgaacccgttacggggtccgggggacccgtaaccgggggtaaccccttggggtacccctaccccgg

SEQ ID NO: 184485 - DNA, 678 bp, Homo sapiens
  misc_feature: GYAE6OF01CHVT1.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggagcttggtccagccgtgggggtccctgagactctcctgtgcagcctcgtggtacttctaacgtttggtagcttagttggattggacgtcggggtccgccgtagtccgtccgaaggggaacggggctagggacggtgggtcggaccaacgagtaacgagggaggtagggtaggtaaacgaaaaacgtgtggtagactcgtggtcggcggggacctattccgaccgtacgtccgtaccgtaagaacgtaaccgaaacccgaaaccctaaaaaaccgtctaacgttagttactacgtacgaacgtaaacggtcggtaaccgaccgtagaagccgtaccggacggaaccgtcgggtacttaggtagttactttagttgtagcggtaagtacgttaacgtttaagtaaccgttaacgttaaacggtttcgaaggttacgacggtttaggtaacgttgtagttacg

SEQ ID NO: 184486 - DNA, 1058 bp, Homo sapiens
  misc_feature: GYAE6OF01C0592.37.57.F02.1.454.CMB.1.raw
  modified_base (151)..(151): a, c, t, g, unknown or other
  misc_feature (151)..(151): n is a, c, g, or t
  modified_base (397)..(397): a, c, t, g, unknown or other
  misc_feature (397)..(397): n is a, c, g, or t
tcagtagtgtagatcacgaccggtgctcgatttagctcgatatagttgggtctgggggaggcctcgtccagcctggggggtccctgagactctcctgtgtagccttctgtaactttccccgtttacggctttattggatgagctgggtccnccgaggcctccgaagggggaaggggctgggaggtggggtcgaccaaacataaagcaagataggaaagtaagaaggtatactggtacggacttcgtaggtacggaaccgggttccctttacaacctagttcctaccgaagaacgaaccaaccgtaccaaagtaacctccggtagcctaagtccagaacctaaaagttccgaaactacgtctaggaacggaccggaccggaaggacctaaccgggttnttttaaactttcgtaacggtcgaccggtaacggaaggacggtaaacggccgggtttaggggtacccggttttacgaaccgttacgggaccggggggtacccgtaaacgggggtaaacccccgttttcggggaccctaccccggttttaccccgttaccccgacccggtacccggttaacccccctaacccggtaaaacccccgggggtaacgggtaccccccctttaaccgggggttttccccccggggtttacccccctttacccccccgggttacggggcccccccgttacccccgttacccgggttacccccgttaaccgggaacccggggtaccctaacccccgtaacccccgggttcccgggaaaacgtacccgggacccgtaaccgggtaccccgggcccccggggtttaaccggtccggggtttcccgttaaccgggttaccccggggtttagggttaaaccccgggtaacccggttttaaaaccccgtttccccgttaaacccgtttaaccgttacccctttaaacccggaaaccggtttaacccgggtaacggggcccggggtttaacccgggggaccggtttaaaccgggaaacccccgggggtaaaccggttccggtaaccgttaaaccgggtagccctaaggcggttcc

SEQ ID NO: 184487 - DNA, 821 bp, Homo sapiens
  misc_feature: GYAE6OF01BFK8P.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaagttgggctgagtcttgggttttccttgttgcttagttttggaaggtgtccagtgtgaggtgctaagttggtggaggtcggtgggggacggcctcgtccgaggtccggtcgggggtccctgacgctcctcgtgtgtacgcctcgtacgtaacctttccccgtttacgtcttagtagatcggagtcgtcgggtcccgccggacggtccgtaccggaagggggaacggggtccgtaggggtacgggtggggtaccgggaacccgaaacgtaaagtaaaacgacggtaaaaggaacgtaaggggtaaaacggtaaaagggaaagggtaagttaaggttagggtacgggtaaccgttggtaggtaacgggtaacggggttaccccgtttaccgaacctaacgttccgaccgtaagggaaaccgtaaccgaaaccggtaccgaaacgtaaaccctccggtagtacctactcgtacgaactaaagtcggaaactggtacgtaggaaaccggacggaccggtaacggtaccgtaccggtttactttaacgtttagttaccggcgtaagggccggaaaaggtaacggggtaacgggtccggggttacggggttcggtttacccgaacgggtttacccgggccgggggtaaccgtaacccggggtaaccgttcgggaaaccccgtccccgg

SEQ ID NO: 184488 - DNA, 708 bp, Homo sapiens
  misc_feature: GYAE6OF01BZUOB.37.57.F02.1.454.CMB.1.raw
  modified_base (309)..(309): a, c, t, g, unknown or other
  misc_feature (309)..(309): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgcttattttggaaggtgtccagtgtgaggtgcaattggtggagtcgtgggggagcctcgtccagccgtggggggtccctggagactctctgtgtagcctctgtaactttccccttacggtcttattggatgagctgggtccnccgaggcctccgaggggacgggctgggagtggggtacgaccaaacgagtaaagcgaagataggaaagtaagaaggagtagtggtaggaactcgtaggtacggaacgggtccgtttacaacctagttacctacgaacggaacgtaacccgaaaccggaccaaaggtaaaccccttccggtagaaccctaacttaccgttaggaaccttaaaagttacggaaaccagttaccgtagggaaacgtaacgggtacccgggaaacgggaacctacgggttaacctttaagtttttactaacggtcggacggacgaaaggaacggtaacgggtacggtcggggttaccgtttcgaaccgttacggtcgggggacctaacgggtaccccttgggtacctacccggg

SEQ ID NO: 184489 - DNA, 730 bp, Homo sapiens
  misc_feature: GYAE6OF01C3SKO.37.57.F02.1.454.CMB.1.raw
  modified_base (388)..(388): a, c, t, g, unknown or other
  misc_feature (388)..(388): n is a, c, g, or t
tcagtagtgtagatcacgaccggtgctcgatttagctcgatatagttgggtttgggggtctcagagaggagccttagccctggactccaaggccttttccacttggtgatcagcactgagcacagaggactcaccagtggtaagttggggctgagtcgtttgggtttttccttgttgtcttagttttggaaggtgtcagtgtgaggtgactaagttggtggaggtcggtgggggacgcctcgtccgaggccggttcgggggtccctggacgtcctccgtccgtgtcgtacgtccttcgttacgtaaccttttccccgtttacggtctttagttcggatggagtccgtcgggtcccgcgtacggctaccgggaggggacgggcgtgggnggttgggacgaccgaaacaagtaaggacgaagagtaggaagtaacggaaggtagtagtggtacgacgttgtaggtaggaacgggttcctttacaccgtatcccgtacgacgtaacgacctaacgaccgtaaacggaaccgtccgactactactcgtaacaacgtaaacgtcgaaacgtggttaccgaaggtcgaaccggacggaaacggtacctaggtactttaacgtttacgttacgcggtacacggggtaagaagggtacgggttggtacgggttcggttaccggaaacggtcgggtccccggggaaccggttacggtacccggttccggtacctcccgg

SEQ ID NO: 184490 - DNA, 764 bp, Homo sapiens
  misc_feature: GYAE6OF01BXXTK.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaagttggggctgagtcgttgggtttttccttgttgcttagttttggaaggtgtccagtgtgaggtgacaagttggtggagtcgtgggggacgcctcgtccgagccgtcgggggtccctggacgactcctccgtgtgtacgccttcgtgtaaactttccccgtttacggtctttagttcggattagacgtcgtcgggtcccgccgaggccgtccggaaggggaacggggcgtagggacggtgggtacggacccaaacgaacgtaaaagacgaaaggtagtaaggaaacgtaaaggaaagggtagtagtggtaggtaaccttcgtaggtacggaaacgggttcccgtttaccgaaccctagtttacccgtaaccgaacggaaacgaacccgtaaaccggaaccccgtaaaaggtaacccgttcccggtagaccctaacgttaccgtacgaaactaaggtacgaaaccgtagttacggtagaacggacggaccgggtaacgaaccggtacgttactttaagttttaaccgtagtggaccggtagtaaggacgggtaacgtcgggttcgggtacggtttacccgtcgttaaccgggcggggaacccgtacggggtaaccctggtaaccccg

SEQ ID NO: 184491 - DNA, 681 bp, Homo sapiens
  misc_feature: GYAE6OF01BTROQ.37.57.F02.1.454.CMB.1.raw
  modified_base (293)..(293): a, c, t, g, unknown or other
  misc_feature (293)..(293): n is a, c, g, or t
  modified_base (310)..(310): a, c, t, g, unknown or other
  misc_feature (310)..(310): n is a, c, g, or t
  modified_base (330)..(330): a, c, t, g, unknown or other
  misc_feature (330)..(330): n is a, c, g, or t
  modified_base (343)..(343): a, c, t, g, unknown or other
  misc_feature (343)..(343): n is a, c, g, or t
tcagtagtgtagatcacgaccggtgctcgatttagctcgatatagttgggtttgggggggtccctgagactctcctgtgtagcctctgaattcccctttacggcttattggatgagctgggtccgccaggctccaggggaaggggctggagtgggtggccaacatacgagggaggtggtggtacgaaaaactatgtggactctggtgcggggccgattcaccatctccagagacaacgaccaaaaactcactgtactctgacaaatcgggacggtcctgagatccgaggaccnggctgtgtattattggngcgagagtatttagactaanaagtttcgagtgntgggtatgatgtcttatgtactaccgtggggacctaagggacctagtcggtaccaccgttctacgtcaccgccctacccgaacgaccgggccctacggttcccggtcccctttcccccggcggtccccgtcccgtcgtccctaccggacgggacgtccccaacccggtccgaacggtaccgacaaccgtcgggtcccggtcccggtacgggtccgttccggacgttacgggacccgtaaacggtcccgtttaacctcctaaccgttaccgtaaacccgtaaccgttacgacgggaccgggttcgggaccgtacggaccgggaacgcgacgtacgtggc

SEQ ID NO: 184492 - DNA, 633 bp, Homo sapiens
  misc_feature: GYAE6OF01C8DLL.37.57.F02.1.454.CMB.1.raw
  modified_base (346)..(346): a, c, t, g, unknown or other
  misc_feature (346)..(346): n is a, c, g, or t
  modified_base (476)..(476): a, c, t, g, unknown or other
  misc_feature (476)..(476): n is a, c, g, or t
  modified_base (499)..(499): a, c, t, g, unknown or other
  misc_feature (499)..(499): n is a, c, g, or t
  modified_base (542)..(542): a, c, t, g, unknown or other
  misc_feature (542)..(542): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagtcttgggtttttccttgttgcttattttggaaggtgtccagtgtgaggtgcaagttggtggagtcgtgggggagcctcgtccagtccgtgggggtccctgagactccgtccgtgtgtacgcctctgtaacctttcccgttacggtcttagtggatgagtcgtgggccgcgaggcctaccggaggggaggcgtggnggtgggtcggaaccaagaagtaaaagcgtaaggagtaggaaagttaaagaaggtagtacgtggtagacgtgtagtggacggtccgtttcgctatcacgagacgtacgaaccgaccgaaagtcctaccgtnacgtatcgtacgacaaatcgaanatcgtagaacgaggaccggtagacgacgtctttagtttacgtnaggtcgacgggatacggaggtacgttcggggttacggttaccaccggttaggcgggtaacgaccgggttaacccgtcggtaccgtaccccg

SEQ ID NO: 184493 - DNA, 1031 bp, Homo sapiens
  misc_feature: GYAE6OF01BLT52.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcttgggttttccttgttgctattttggaaggtgtccagtgtgaggtgcaagttggtggagtcgtgggggacgcctcgtccgaggtccgtgggggtccctgacgactctccgtgtgtacgtcctgttagtaactttccccgtttacggtcctttagttcggatcggacgtccgtacggggtccccgaccgaacgggtccgttacccggaagggggtaacggggtccgttagggggaacgggtttcgggggttaccgggaacccgtaaaacgtaaacggttaaaaacggaccgtaaaagggtaacggttaagggggtaaaaacggttaaaacggggtaaaacggggttagggtttaaacgttaggggtttaacgggtaacctttaccggttaggggttaacgggtaaaccggggtttccccgttttaaccgaaaccccgtagtttaccccgttaacccgaagggtaaacccggaaacctaaacccgggtaacccgtaaaaacggttaaaccccggttcccggttaacgggaaccctaacgttacccgtaacggtaaacctaaaacgtttacggaaaacccttacgggtttaccctaagggaaaccggtaacgggtaaccccggggtaaacgggtaaaccccgtaacggggtttaacccttttaaagggtttttaaccgttaaaccccgggtggggtaaccgggtaccgggaaaacgggttaacggggtaaaaccgggggttacccgggtttacggggggttaaccccgggttttaaaccgtaaaccccggggtttaaccggggttaccccggggggtaaacccgtaaacccgggggggtttaacccccgtttccggggtaaaccccgtttaacccccccggg

SEQ ID NO: 184494 - DNA, 576 bp, Homo sapiens
  misc_feature: GYAE6OF01AK7S1.37.57.F02.1.454.CMB.1.raw
  modified_base (415)..(415): a, c, t, g, unknown or other
  misc_feature (415)..(415): n is a, c, g, or t
  modified_base (421)..(421): a, c, t, g, unknown or other
  misc_feature (421)..(421): n is a, c, g, or t
  modified_base (459)..(459): a, c, t, g, unknown or other
  misc_feature (459)..(459): n is a, c, g, or t
  modified_base (559)..(559): a, c, t, g, unknown or other
  misc_feature (559)..(559): n is a, c, g, or t
  modified_base (564)..(566): a, c, t, g, unknown or other
  misc_feature (564)..(566): n is a, c, g, or t
  modified_base (569)..(576): a, c, t, g, unknown or other
  misc_feature (569)..(576): n is a, c, g, or t
tcagtagtgtagatcacgaccggtgctcgatttagctcgatatagttgggtttggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctcagagacaacgccaagactccgtgcatctgacaaatgaacagtctagagagccgaggacacggtcttaattttattactgcgcgagagaaggacgtgggtcggtttcgacgtacggtcggggacgacgggaacccgtggcctaccgtcctcctacacgcctacccacgacggcccagtccgtcccttccccgnggcccnccctcgcctaccgaggcgccaccgtccgagacgcgacncggccggccgtgggcctcgccgtagtaccgaaggtccttaccttccacttaccgactaccgtagtcggaggccgggcgtacggacgaacgggccgtaagngtagnnncgnnnnnnnn

SEQ ID NO: 184495 - DNA, 875 bp, Homo sapiens
  misc_feature: GYAE6OF01B97B4.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccagtggaagttggggctgagtcgttggggtttttccttggttgtcttagtttgggtaaggtgtccaggtggtggaggtgacgtaagttgggtgggaggtcggtggggggacgccgtccggtccgacggtccgggttcggggggtccctaggtacgtaccttccgtccgttaggtcggttacgccttcgtacgttaaccttccccgttttaggtctttagttggtagtggacgtcggtccgggtccgacgtaggccgtacgggaggggacgggtcgtgggtacggtggggtaccgaaccgaaacgtaaagtaaacggactaaaggggaggttaaacggggaaaaggtaaagggtaaaggtaaggtacgttagggtaccggtacgttcggtaagggttacgggtaacgggtttccctttacaacctagtttacccgacgaacggtaacgaaccggtaacccgaaccggtaaacgtacccgtaccggtaacgtccgtaacgttccgtaaacgaacgtttaaacgtaccggtaaacgtcgttaacggtacggaaccgggtaacgaccgggtaacgggtaacccttaacgggtaacttttacggttagttaccggcggtaccgggaagtaaggggtaacggtaacgggtacgggttacggggtttcccggtaacgggttaccgggttacccgggtaccggggaacccgggtaacccgggttacccgtaccgggtcccgtaccccggg

SEQ ID NO: 184496 - DNA, 782 bp, Homo sapiens
  misc_feature: GYAE6OF01DBNKA.37.57.F02.1.454.CMB.1.raw
  modified_base (630)..(630): a, c, t, g, unknown or other
  misc_feature (630)..(630): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattgggctgagcttgggttttccttgttgcttattttggaaggtgtccagtgtgaggtgctaagttggtggagtcgtgggggacggccttccgtccagcccgttggggggtcccctaggagtacctctcctgtgtacgccttctgtaacctttccccgtttacgctttagttgatgacgtcgtcgggtccgccgaggtcctaccggagggggaagggcgtagggagggttggggtcggacccaaacgaaataaacggaccgaaaggtagtaaggggaaaagttaaaacggaaagggtaagttacgttaggtacggtaaccttcggttagtacgggtaacgggttcctttaccgacctacttccgtacaaggaccaaccgaaccggaacccaaacgtacccgttaccggtgacctattaccgtacgaactaaagttcgaaacgtacgttacgtaggacggaacggtacccgggaagtaccggtaaccggttnttttaacggttttactaccggttcggaccgacggtaaagggacgggtaaacggtacggggtttcggggttaccggtttacccggaagttaccggggtttacccggggaacccggttaaccgggaaccccggtcgggtaccccttaaccccgg

SEQ ID NO: 184497 - DNA, 704 bp, Homo sapiens
  misc_feature: GYAE6OF01EAEBF.37.57.F02.1.454.CMB.1.raw
  modified_base (592)..(592): a, c, t, g, unknown or other
  misc_feature (592)..(592): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcttgggttttccttgttgcttattttggagtgtcagtgtgaggtgcaattggtggagtcgtgggggagcctcgtccagccgtgggggtccctgacgactctcctgtcgtacgcctctagtaacctttccccgtttacggctttagttggatggacgtcgtgggtcccgccgaggccgtaccggaagggggaacggggtcggtgggtaggtggggtcgaccaaacgaagtaaacgcgaaagagtaagggaaagtaaaggaaggacgttagtggtacgtacgtcgtaggtacggaacgggttccttacacctattccacgaagacaacgaaccgacgaaacgtaacctcgacgcaactcgtagaactaaagtacgaaacgtacgtcgaaggaacgaacggccgggaagtaacccgtacggttatttaaggttttactaccggngtaccgggacggaaagaaggggtaacggtacgggttcggggttcggtttaacccggaagttaccggggtacggggaccccaaccggggttaccccgttggcccccgtaaccg

SEQ ID NO: 184498 - DNA, 901 bp, Homo sapiens
  misc_feature: GYAE6OF01DPSQ9.37.57.F02.1.454.CMB.1.raw
  modified_base (201)..(201): a, c, t, g, unknown or other
  misc_feature (201)..(201): n is a, c, g, or t
  modified_base (274)..(274): a, c, t, g, unknown or other
  misc_feature (274)..(274): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaagttggggctgagcttgggttttccttgttgcttagttttggaaggtgtccagtgtgaggtnctaagttggtggagtcgtgggggagcctcgccaggccgtcgggggtccctgacgactctcctgtgtacgcctntgtaacctttcccgtttaggctttacgttggtatgacgtcgtcgggtccccgcgaggcccgtaccggaaggggtacggggccgtagggtacgggttcggggtaggaacccctaaaagtaaacgtaaaaggacgaaaaggtaaggtaagggaaaaggttaaaggaaaggtaaggttagttaggtacggtaccttggtacgggtacgggtacggggttccctttacaaccgtacttaccgtaccgaagtaaccgaaaccgaacccgtaacccgaaaacggtaacccgttccggtaacgtaccgttaacgtaccgttaaccggaaacgtaaaacggttaccggtaaacgtaccgggttacgtaacggggtaaacggtaaccgggacccgggtaaacgggtaacccgttaaccggggttaacttttaacgttttaaaccggttacggtacccgggtaccgggtaaaccggggtaaaggaaacccggggttaaacggggtaccgggggttttacgggggttaaaccccgggttttacccggaacgggttaaccccgggttacggggggaaacccccggttaaaccgggggttaaacccccggtttccgggtaaccccggtttaacccccggg

SEQ ID NO: 184499 - DNA, 831 bp, Homo sapiens
  misc_feature: GYAE6OF01CM3Q3.37.57.F02.1.454.CMB.1.raw
  modified_base (148)..(148): a, c, t, g, unknown or other
  misc_feature (148)..(148): n is a, c, g, or t
  modified_base (188)..(188): a, c, t, g, unknown or other
  misc_feature (188)..(188): n is a, c, g, or t
  modified_base (826)..(826): a, c, t, g, unknown or other
  misc_feature (826)..(826): n is a, c, g, or t
  modified_base (830)..(830): a, c, t, g, unknown or other
  misc_feature (830)..(830): n is a, c, g, or t
tcagtagtgtagatcacgaccggtgctcgatttagctcgatatagttgggtctgggggaggcctcgtccagcctggggggtccctgagactctcctgtgtagccctctgaacttcccctttacggctttattggatgagctgggtccnccgaggctccgaggggaagggctggagtgggtggaccaanataaagcaagataggaaagtaaggaaggagtatggtggactcgtaggtaggaagggtcccgtttacaacctatcctccaggaacgacgaaaccgccaaagaacgtcgtagacatccgtagactaaagtagaaactagttaccgaggaaacgacggacccggtaacggaaccgtacggtactttaatttacgttacgtggacgtacggaaagtacggaaggtacggttggggtaccggttttaccgaacggttacggtacgggggtacccgtaacggggtaaccccgtggtacccgtaccgttcctacccgtacggccgtacccgtacccgaaaccggtaaccggaccccttacggtcccggttccccgttacccccgtggtcccccgtacccgtcggtacccgtaacccggacggaacccgaccgtaccccgtaaccggacgtaaccgacgtaacccgacgggtaacccgggtccccggtgggtaacccgttccggtaccggttaccgggtaaccgttaaaccgtacccgtttaaccgtacccgtaaccgtaccgttaaaccgtaccgttaaccgtaccggaccgggtaccgggttaccggacgggaaccggtaacggcccggtacgaactacggtancgtnc

SEQ ID NO: 184500 - DNA, 709 bp, Homo sapiens
  misc_feature: GYAE6OF01D57RP.37.57.F02.1.454.CMB.1.raw
  modified_base (224)..(224): a, c, t, g, unknown or other
  misc_feature (224)..(224): n is a, c, g, or t
  modified_base (695)..(695): a, c, t, g, unknown or other
  misc_feature (695)..(695): n is a, c, g, or t
  modified_base (697)..(700): a, c, t, g, unknown or other
  misc_feature (697)..(700): n is a, c, g, or t
  modified_base (702)..(702): a, c, t, g, unknown or other
  misc_feature (702)..(702): n is a, c, g, or t
  modified_base (704)..(706): a, c, t, g, unknown or other
  misc_feature (704)..(706): n is a, c, g, or t
  modified_base (708)..(709): a, c, t, g, unknown or other
  misc_feature (708)..(709): n is a, c, g, or t
tcagtagtgtagatcacgaccggtgctcgatttagctcgatatagttgggtttggggggtccctgagactctcctgtgtagcctctgaattcccctttacggcttattggatgagctgggtccgccaggctccaggggaaggggctggagtgggtggccaacataaagcaaagatggaagtaagaaggagtatgtggactctgtgaagggtccgtttcacatcnccagagacaacgcaagactccgtgcatctgacaaatagaacagtctgaagacgaccggaggacacggtacttatttacttactgcgcgaagaaggaaggtacgtcgggtcggtttcgacgtacgtggggccgacgggaacctcggtaccaccgttcctcctccgacgtccctaccgaacccgaacggggcccctacgttcccggttcccttccccccgtgggcccccgtccccgtgaccccgttccgaacgggtaccgacccgtaaccccgtccgggaaagcccggacgaaccggtaacgggcccccgggtaccccggttcggggtcccgttcggtcccgttcggggtaaccggtaaaccgggtacctttaaccttaacccgtacttaaccccgtaacctacccgttacgttacgggacgggtaccggggtacgtcgggaaccggtaacggggtcccacgtaagtaccggngnnnncncnnngnn

SEQ ID NO: 184501 - DNA, 797 bp, Homo sapiens
  misc_feature: GYAE6OF01DYCXE.37.57.F02.1.454.CMB.1.raw
  modified_base (627)..(627): a, c, t, g, unknown or other
  misc_feature (627)..(627): n is a, c, g, or t
  modified_base (695)..(695): a, c, t, g, unknown or other
  misc_feature (695)..(695): n is a, c, g, or t
tcagtagtgtagatcacgaccggtgctcgatttagctcgatatagttgggtttgaggtctcagagaggagccttagccctggactccaaggccctttccacttggtgatcagcactgagcacagaggactcaccatggaagttggggctgagtcgtttgggtttttcctttgtttgtctttagtttttgggaaaggttcgttccgtaggttggtggtagggtgacgtaaagtttggggtgggaggttcggtggggggacggtcccgttccggtcccgaggcccggttcgggggggtcccctggaacgtccttctccgtgtgtacgtccttcgtacgttaaccttttccccgttttacggtacttttagttggtagttacggagtccggttaccggggtccccgacccggtacgggccgttacccggggaagggggggtaaacggggtcggttagggtacgggttcgggtaaccggaacccaaaagtaaagtaaaaacgcgaaaaggaggtaaaggaaaggtaaaaggaaaggtagtagtggtggtaccttgtagggtcgggtacgggtccttacgaactatcccgtaacgacgaacgaaacaccggtaaccaaacgtacttccgganactgttacgagaaactaaactacgaaacgtgtacgtggaaacggccgagggtaaccgtacgaacgttnttaactttatccggagcggagtaaggacgggtaaggtcggttgggttaccggttacaacggttccggggacgggaccccggtaacggtccgtccggtacccg

SEQ ID NO: 184502 - DNA, 775 bp, Homo sapiens
  misc_feature: GYAE6OF01DXUW2.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccgagtgtgaggtgctaagttggtggagtcgtgggggaggcctcgtccaggtccgtgggggtaccctgacgactcgtcctgtgtacgtccttctaggtaactttccccgtttaggactttaagttacgggattacggacgtcgttcgggtccccgtccgaaggtcctaccggaagggggtaacgggggtcgtagggtaagggttggggtacgacccgtaaacgaagttaaaacgacgaaaggtagtaggggaaagtaaagggaaggtaaggttagtacggtgggtaacctcgttagggtacggtaacgggtcctttacgaacccgtattaccgtacccgaagaaccgaaacccgaaccgtacccaaaagtccgtacccggtgaccgttaactcggttaagaacctaaagttccggaaactggtactggaagtacccggaacgggaacggtactaccgggttaacttaagttttacgacgttacgacggaccggtaaggacggaaaggtcggttcggggaaccgttttaccggaacggttaccgggcggggtaacccgtacgggggtaaacccctgggttccccgtaacccg

SEQ ID NO: 184503 - DNA, 696 bp, Homo sapiens
  misc_feature: GYAE6OF01CD8BY.37.57.F02.1.454.CMB.1.raw
  modified_base (306)..(306): a, c, t, g, unknown or other
  misc_feature (306)..(306): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggagcctcgtccagccgtggggggtccctgagactctcctgtgtagcctctagaacttcccttacggcttattggatgagcgtgggtccnccgaggcctccgagggaagggctagggaggtgggtcggacccaaacgaagtaaaacgcaaaggagtagggaaagtaaagaaagggagtaagtggtggactcgtagtagggaaacgggtccgttttacaaccgtactcctaccgaagacgaaccaaccgaccaaaacgtaaccgtcccggtaacgtacgaacttccgtaggaaccaaaattacggaaactacggtactagggaacgacgggcccggaagggtaaccacgggtactttaagtttactacgtgggccgacgggtaagaaagggtaacgggtacgttcgggggtcccggtttaccgaaccggttaacgggtcgggggacccgaacggggtacccctggggtccctaacccccgg

SEQ ID NO: 184504 - DNA, 613 bp, Homo sapiens
  misc_feature: GYAE6OF01BWC98.37.57.F02.1.454.CMB.1.raw
  modified_base (288)..(288): a, c, t, g, unknown or other
  misc_feature (288)..(288): n is a, c, g, or t
  modified_base (346)..(346): a, c, t, g, unknown or other
  misc_feature (346)..(346): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccaggccgtggggggtccctggagactctcctgtgcagcctctggattcaacttttggtanctattggatggactgggtccgcagtctccgaggggagggctgggagtgggtggccaanatacgagggaggtggtggtaacgaaaactgtgtggactcgtggtggcggggcctattccgaccatcctcagagacaacgacccaaaactcacgtagtactctgacaaagtcggaccggtcctaggacgacgtacccggagggacccgtaacgggcgttaggttacgttagtttaagttgggtcggtacggaagggtagtaacgttttaagaaccgttaacgttaaaggttttccgaggttacgtacgttagggttatggtattacgg

SEQ ID NO: 184505 - DNA, 737 bp, Homo sapiens
  misc_feature: GYAE6OF01EWIIB.37.57.F02.1.454.CMB.1.raw
  modified_base (352)..(352): a, c, t, g, unknown or other
  misc_feature (352)..(352): n is a, c, g, or t
  modified_base (354)..(354): a, c, t, g, unknown or other
  misc_feature (354)..(354): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagcgtgggttttccttgttgctattttggaaggtgtcagtgtgaggtgcaattggtggagtcgtgggggagcctcgtccagccgtggggggtccctgagactctcctgtgtagcctctgaactttcccctttacggctttagttggattgaggtcgtgggtaccgccgaggcctaccgagggaagggctggagtgggtgccaananaaagcaagactaggaataaggaaggagtatggtagactcgtgtagaacgggtccgtttacacctatcctaccaacgtagaacctaacgaccaaacgaacctcggtacgacctattaccgtagtaaccaaagttacggaaaccgtagttccgttaacgggaaggaacccggaccggggtaagggtaacccggtaacgggaccctttttaaagttttaacgttaccggtacggtaccgggacggtaaacgggttaaagggaaaacccgggttacgggttccgggggggttaccggtttacccggtaaacccggttaccggggttacccggggggaacccgttaaacccggggggttaaacccccttcggggttaaaccccccggg

SEQ ID NO: 184506 - DNA, 873 bp, Homo sapiens
  misc_feature: GYAE6OF01CF9LN.37.57.F02.1.454.CMB.1.raw
  modified_base (152)..(152): a, c, t, g, unknown or other
  misc_feature (152)..(152): n is a, c, g, or t
  modified_base (660)..(660): a, c, t, g, unknown or other
  misc_feature (660)..(660): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggtaattggggctggngtcgttgggttttccttgttgtcttagttttggaaggtgtcagtgtggaggtgctaagttgggtggaggttcggtgggggacggccgtccgtccgacggtccgggtcggggggtaccctggacgaccttccgttccgtggtcgtacgccttcgttacggttaacccttttccccggttttaggtccttttaggttggtagttacggtacggtcggtttccggggacccgtacccggacgggtccgttaacggggaacggggggtaacggggtcggtacggggtaagggttggggtaccggaacctaaaacgtaaagtaaaaccgacgaaaaggtagtaaaggggtaaagtaaaggaaagggtagttacgtaggtaggtacctcggtagggtaacggtacggggtttacccgttaccaacccgttactaccctcgaaacgtaacgaacccaacccgaaccgtaaaccgtaaccggtttccgtaagtaccctcgtaaccgtaccgtaaanaaacgtacgtaaaacggtgttaaccgaaggaaccggaaccggggtacccggaaacggttacccgacgtttaacttaaccgttttaggacccgttcgggacgtaaccgggtaagggaaggttaccgggtaccgggttcgggttaccggttaccgaacgggttaccggggcggggaaacccgtagggttaccccgtagggtcccctaaccccggg

SEQ ID NO: 184507 - DNA, 237 bp, Homo sapiens
  misc_feature: GYAE6OF01DEUBA.37.57.F02.1.454.CMB.1.raw
  modified_base (223)..(223): a, c, t, g, unknown or other
  misc_feature (223)..(223): n is a, c, g, or t
  modified_base (225)..(225): a, c, t, g, unknown or other
  misc_feature (225)..(225): n is a, c, g, or t
  modified_base (228)..(237): a, c, t, g, unknown or other
  misc_feature (228)..(237): n is a, c, g, or t
tcagtagtgtagatcacgaccggtgctcgatttagctcgatatagttgggtctgggctgagctgggctaagctggacctggctgggcctccaccaagggcccatccggtccttcccctggcgccctgctccaggagcacctccgagagcacgagccggccctgggctgccgtggtacaaggtactacttccatctacactactgagcggctggacaaggcgananagnnnnnnnnnn

SEQ ID NO: 184508 - DNA, 709 bp, Homo sapiens
  misc_feature: GYAE6OF01B1VEF.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaagttgggctgagcttgggtttttccttgttgcttattttggaaggtgtcagtgtgaggtgctaagttggtggagtcggtgggggagcctcgtccgaggccggtggggggtccctggacgtcctcctccgtggtgtacgccttctgtaaccttttccccgtttacggctttagttggatgagtcgtgggtcccgccgaggcctaccggaggggaaggggctgggaggtcgggtcggaccaaagaagtaaaagcgaaagtagtaggaaagtaaaggaaggtagtagtggtacggacttcgtaggtaggtaacgggtccgttttaccgaacctagttcctaccgagaacgaaccgaaccgacccaaaaggtaacctccggtacgactacgttcgtagaacctaaagtcgaaacgtgtaccgtaggaacggtacgaccggaacgggacctaaccggtctttaatttacgtacgtcggacgacggaagtacggaagggtcgttcgggggttcgtttaccggaacttccgggggtacgggaccccggaacggggtaccctgggtccccttacccgg

SEQ ID NO: 184509 - DNA, 602 bp, Homo sapiens
  misc_feature: GYAE6OF01CBATB.37.57.F02.1.454.CMB.1.raw
  modified_base (591)..(591): a, c, t, g, unknown or other
  misc_feature (591)..(591): n is a, c, g, or t
  modified_base (594)..(602): a, c, t, g, unknown or other
  misc_feature (594)..(602): n is a, c, g, or t
tcagtagtgtagatcacgaccggtgctcgatttagctcgatatagttgggtttggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaaagaacctccgtgcatctgacaaatgaacagtctgagagccgaaggacacggtcttatttattacgtgccgcggagaggaaggacgtggggtccggtttcgactacggtcggggccgaacggggaaccctgggacctacccggtctccgtcacgccctaccgaaccgaacgggccctacgtccggtcccttcccccgtggcccgcccgtcgcctaccgacggacgccctaccgtccggagacgccgacacggcccggcccgtgggcctcgcccgtggtaccaacggtaccttacctccgtaactcctaacctacgtacgtcggaggtccggagtcggacgacgggccagagtgncannnnnnnnn

SEQ ID NO: 184510 - DNA, 928 bp, Homo sapiens
  misc_feature: GYAE6OF01CBR4R.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccagtggaagttggggctggagtcgtttgggtttttccttgttgcttagtttttggaaggtgtccagtggtgaggtgactaagttgggtggaggtcggtaggggggacggtcccgtcgtaccgacggtccgggtcggggggtcccctaggacgtaccttcgtccgtggtacggtaccgtccttacgttacggtaaacctttttcccccggtttacggtacttttaagttcgggtagttaggtacggtccggttaccgggggtcccgcccggtacgggtacccgtaccggggaaggggggaacggggttccggtaaggggtacgggttcgggggtaccgacccgaaaaacgtaaagtaaaacggacgaaaagggtaaggttaaaggggaaaaaggtaaaagggtaaagggtaacggttagttacgggtacgggtaacctttacgggttacggggtaaggtaaacccgggggtttccccgtttaaccgaaaccgtccgttacccgaaccgaacgaacggtaaccccgaaaccgtacccgaaaaacccggttacccgtccggtagacccgttaactcgttaacggaaacctaaagtaccggaaacgttcgttaacgaggaaccgggaacggtacccggagggaacccggtagttaccttttaagtttaccgtagtcggaccggtacggaaggtaaggtaacggggttccggtaggggtttacccgttaacgggtacccggtacggggttaccggggaaccggtaacccggggttacccgtccgggtccgttacccccgg

SEQ ID NO: 184511 - DNA, 702 bp, Homo sapiens
  misc_feature: GYAE6OF01BC9BH.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaaggtgtccagtgtgaggtgctaagttggtggagtcgtgggggaggcctcgtccgagccgtcggggggtccctgacgactctcctggtgtacgccttctagtaactttccccgtttaggcctttagtcggattgacgtcgtcgggtcccgccgtaggcctaccgaggggacgggtctagggaggtgggtcgaccaagaataaagccaaggagtagggaaagtaaggaagggtagtagtggtggtactcgttaggtacggtaacgggtccctttacacccgtattcccaccggaagacgtaaccgaccgaccgtaaacgtaaccgtccgtaggacaacgttccgaaggaacctaaagtccggaactaggttccgtaaggacggtaccgacccgggagtaccgggtaacgttacctttatttacgtactcggaccggaggtaaggacggtaaacgggtcggttcgggggtactttacccggacggttccgggacggggtacccaacggggtaccccttggtaaccccg

SEQ ID NO: 184512 - DNA, 796 bp, Homo sapiens
  misc_feature: GYAE6OF01B47HG.37.57.F02.1.454.CMB.1.raw
  modified_base (322)..(322): a, c, t, g, unknown or other
  misc_feature (322)..(322): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattgggctgagcgtggtttctgttgctagttttggaagtgtccagtgtgaggtgcaagttggtggagtcgtggggagtcttggtccagccgtggggggtccctagacgactctccgtgtgcagcctctggtacttacaacgttttgggtagtcttaagttgggtatgggacgttggggtcccnccgagttctccggaaggggtagggtctgggagtggggtcggacccaaagagtacgaagggtaggtgggttaggaaacgtaaaaaactgtgggtacggaccttagtggtaaggaacggggtcctaagttccaacgtattccgtacgacgaacgaccgaaaccgaccccaacgtaaactcctaagtttacgtacgttacgttacgaacgaaacttaacggaaactaacgtaaccgttggaaacgggaaccggtacccggggaaacgggttaaacccgaaccggggttacgttacgggtttaaccgggtttaaacgtttaaaccggttcgggtaaacgggtaccgggttaaacggggaaaggggttaaacggggaaccgggggttaaccgtttaaagggtttaaacgggttaaggtttaaaaacggggtcggggttaaaccgggttccgggggtttaacccctttttaaaaccccgg

SEQ ID NO: 184513 - DNA, 669 bp, Homo sapiens
  misc_feature: GYAE6OF01BBGS4.37.57.F02.1.454.CMB.1.raw
  modified_base (587)..(587): a, c, t, g, unknown or other
  misc_feature (587)..(587): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaagttggggctgagcgttgggtttttccttgttgcttattttggaaggtgtccagtgtgaggtgctaattggtggagtcgtgggggagcctcgtccagccgtgggggtccctgagactctcctgtgtagcctctgtaactttcccctttacggctttagttggatgagcgtcgggtccgccaggcctccgaggggaggggcgtgggaggtggggtcgaccaacagtaaagcaagagtaggaaagtaagaaggtagtagttggtaggtactcgtaggttacggaacggggttccgtttaccaccgtacttaccgtaccgaaggtaacgaaccctaaccggaccctaaacgtaacccgttccgtacgactacgtcttacgaactaaagtacgaaactaggtctaggaacgacggacccggaaggtaccgacggttacttagtttataccgnggcgaggaagaggaacggtgggttcggggtccggtttacggacgttacgggtcgggacgtaagggtcttccggtgtaccccg

SEQ ID NO: 184514 - DNA, 775 bp, Homo sapiens
  misc_feature: GYAE6OF01EGMOS.37.57.F02.1.454.CMB.1.raw
  modified_base (328)..(328): a, c, t, g, unknown or other
  misc_feature (328)..(328): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattgggctgagcttggttttccttgttgcttattttggaaggtgtccagtgtgaggtgctaagttggtggagtcgtgggggagcctcgtccacgccgtcgggggtccccagaccttctccgtgtcgtacgccttcgtagtacttccccgtttacggtcttacgttggatgtagtcgtcggtccgaccgnggccgtcggaggggagggtcgtgggaggtgggtacgaccgaacaagtaaacggacaaagtacgtaaggaaagtaaaggaagtaagtagtaggtacggtactcgtagtacgggtaacggtccgttcgaactactctacgaagaactaccgaacgacgaaacgtacccttcgaacgcaacgttcgacgtaaactaacgagtaacccaggtttaccgagggaaacgccgggtaaaccgagggaaacccgtaggttaacctttttaaagtttaccgttacccgaggggaccgaaacgggtaacggaaaacggttaagggtacccgggtttaggggttaccccgggttttaaaccgacggggtttttaaacccgggaccccggggggtaaccccggttaaccgggggttaaaaccccttccccgggggtttaacctaaccccccggttcccg

SEQ ID NO: 184515 - DNA, 835 bp, Homo sapiens
  misc_feature: GYAE6OF01DS2H6.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactacacagtggaagttgggctgagtcgttgggtttttccttgttgtcttagttttggaaggtgtccagtgtggaggtgctaagttggtggaggtcggtgggggacgtcctccggtccgaggtcccggttcgggggtccctggacgtaccttcctccgtgtgtacgtccttcgtacgtaaccttttcccccgttaggtctttaagttcggatggagtcgtcgggtccgccgaggtccgtccgggaaggggaacggggtcgtagggagggttggggtacgaaccaaacgaaagtaaacggacgaaaggtacgtaagggaaaaggtaaaggaaggtagttagtaggtaggtacttcggtaggtaacggaaccgggttccctttacgaacctgttacccgtacgaagaaccgaaccgtaacccggaacccgtaaaagtacccggttcgtacgactaacgtaccgtaacgaaactaaatacggaaacgttacgtacgtaagggaacgtaacccggcgggaaaccgtaccggtaacgttacgttttaagttttaaccgacggtacggaccgaaacgggtaaagggaacgggtaaacggggttacccgggtacggggttttaaccgggttaccgtaacccgggtttacggggtaccccgggggaacccgttaaacccgggggttacccccttgggtaacccccgttacccccgg

SEQ ID NO: 184516 - DNA, 644 bp, Homo sapiens
  misc_feature: GYAE6OF01A3HIU.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttcctgttgctattttagaaggtgtccagtgtgacgtgcaactggtggagtcgtgggggaggcttggtccagccgtggggggtccctgagactctcctgtgcagcctctggattcaacgtttggtagctaattggatggactgggtccgccagtctccgagggagggctgggagtgggtgaccaacagtacgagggaggtggtaggtaacgaaaaactgtagtggactcgtgtggcgggcattccactatctcagacgacaacgacccaaaactcactagtactcgtagacaaagtcgggacgaccgtagacgacgtaccggaggaccgacgggtacttggttagttattaacgttgggtacgtacggtaacggtaaggttaacgttttaagaaaccgttaaacggttaaaaacggttttccgggaaacggtttaacgggtaaaccggtttaaaggggtttaacgttaggggttaaattaccgggg

SEQ ID NO: 184517 - DNA, 822 bp, Homo sapiens
  misc_feature: GYAE6OF01BHOVI.37.57.F02.1.454.CMB.1.raw
  modified_base (204)..(204): a, c, t, g, unknown or other
  misc_feature (204)..(204): n is a, c, g, or t
  modified_base (637)..(637): a, c, t, g, unknown or other
  misc_feature (637)..(637): n is a, c, g, or t
tcagtagtgtagatcacgaccggtgctcgatttagctcgatatagttgggtttggggtctcagagaggagccttagccctggactccaaggcctttccacttggtgatcagcactgagcacagaggactcaccatggaattggggctgagctgggttttcctgttgcttattttggaagtgtccagtgtgaggtgatagttggnggtagtcggtaggggacgtccgttcgtccgaggtccggtcgggggtcctagacgtactctcttggtatacgtccgtagtacgtaacctttaccccgttaggtctttagtggaatcggtacgtggttccgggaccccgacgtaggtcccgacgggaaaggggggacggtcgtagggtacgggtcgggtaccgaaccaaagtaagtaaacggcaaaaggttcgaaggggtaaaacgtaaagggtaaaggtagttaagtgggtacggtaccttaggtacgggttaaggggaaaccgggtttcccttaacaaacccgttagtaccctaccggaaggaaacccgaaccaaaccggtaacgaaaacggtccccgttcggaccgactaagttccgtaagaaactaaacgtcaaacgtttcggatacggaaggtaaccccncgggtaaagtaccgtacgttatttttaacgttactccggacggaacggtacgaaaacggggtaaacgggaccgggttaaacggttcggggtttacccgtttaaccgggaaaccccctttaggggggacccccgggggaaccctttaaaacccggggggtccttcccgggttaaccccggtacccg

SEQ ID NO: 184518 - DNA, 672 bp, Homo sapiens
  misc_feature: GYAE6OF01ENDWQ.37.57.F02.1.454.CMB.1.raw
  modified_base (312)..(312): a, c, t, g, unknown or other
  misc_feature (312)..(312): n is a, c, g, or t
  modified_base (316)..(316): a, c, t, g, unknown or other
  misc_feature (316)..(316): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
  modified_base (666)..(667): a, c, t, g, unknown or other
  misc_feature (666)..(667): n is a, c, g, or t
  modified_base (671)..(671): a, c, t, g, unknown or other
  misc_feature (671)..(671): n is a, c, g, or t
tcagtagtgtagatcacgaccggtgctcgatttagctcgatatagttgggtctgggggaggcctcgtccagcctgggggggtccctgagactctcctgtgtagcctctgaacttcccctttacggcttattggatgagctgggtccgccaggctccgagggaaggggctggagtggggtggaccaaacataaaagcaaagatgggaaagtaagaaggtagtatgtggactcgtggtagaacgggtccgtttacaccatctccgagagaaccaaccgcaacgacctccgtgcatctgacaaagtgaacagtcngagngccgagacagctatttatacngcgngagagagctgggtcgttacgactacgtcggggccaacggggaccctggtccaccgttcctcgtcacgtccctacccgaaccgaaacgggtccccaagtttcccggttccccttacccccgtcggtcccgtcccccttcggcccgtaccgagggtaccacccgtacccgtaccggacgacgccgaacctcgggcccgtacccgtgggcctcggtcccgtagggtaccgtaacggtacttacccgttaccgacttaccgtacctacgtactacgggtacgggccgggtaccggcgggtacgaaaccggggccgaactacgtaacggnnggcnc

SEQ ID NO: 184519 - DNA, 896 bp, Homo sapiens
  misc_feature: GYAE6OF01DH366.37.57.F02.1.454.CMB.1.raw
tcagtagtgtagatcacgaccggtgctcgatttagctcgatatagttgggtttgggggtctcagagaggagccttagccctggacctccaaggtccctttccacttggtgatcagcactgagcacagaggactcaccagtaggaagttggggctgagtcgttcgggtttttccttgttgctttagttttggaaggttcgtcaggtgtggaggtgactaaggttggtcggtaggtcgggtggggggacgcccgttcggaccgtacggtccgggtacggggggtccctgacggtacctccgttccgtggtacgtacgccttacgtacgttaaccgttttccccgtttaggttctttaggttggacttggacggtccggttcgggtaccccgaccgtacgggccgtaaccggggagggggtacggggtcgtagggggtacggtcggggtaaccgaacctaaaaccgtaaaggtaaaaccgaagtaaaggtaaggtaacggaaaaaggtaagggtaaacggtaggttacgttagggtaaccgtacggttcgtaaggggtaacgggtaccggtttaccccgttacgtaacctacgtttacccgaacccgaaagaaccgtaaaccccgaaccgtaaaccgtaaaaccgttcccgtaccgggtagacctacgtacgttaacgaaacgtaaaacgtgtaaaccgaggttaccgacggaacgtaaccggaccgggaacgtaccgtaccggtttacttaacgtttacgtacccggaggtaccgggagtaaaagggagggtaaacgtttcccggggtacggttaccggtttaaccggaccgggttaacccggggacggttaaacccccggacgggttaccccgttccgggaccgtttaccccccggg

SEQ ID NO: 184520 - DNA, 967 bp, Homo sapiens
  misc_feature: GYAE6OF01AUE9V.37.57.F02.1.454.CMB.1.raw
tcagtagtgtagatcacgaccggtgctcgatttagctcgatatagttgggtttggggtctcagagaggagccttagcccgtggactccgaaggtcctttccacttggtgatcagcactgagcacgagaggactcacagtggaagttggggctgagcgttgggttttccttgttgtctttagttttggaaggttcgtccgagttgtggtaggtgtcgtaagttgggtgggtacgtcgggtagggggacgtccgttccgtccgacggtcccgggtcgggggttccctggacgtaccttcgtccgttgttcgtacgccttacgtacgttacccgtttccgttacgtacttagttggactggacgtcggttccggtccccgaccgtacggccgtacgggaaggggtacgggtcggtacgggaggggttacggggacccgtaaccggaaaaccgtaaagtaaaccggtaacgtaaaggaaggttaaggggaaaaaggttaaaggggaaaagggttaggtttaacggttagggtaccgggtttaacgtttacgggttacgggttaacggggttaaaccccggggtttaccccgtttaaccggtaaccccgttacgtttaacccccgtaaccggtaaccggaaaccgtaaaccggtaaacccgtaaacccggtaaaccgtaaacccggtacccggtacgtacccgtaaccgttaccgtaacgaaacgtaaacgtaacgtaaaccgtacgttaccggtaacggaaccggtaaccgggaaccggaaccggtaaccggtacggttacgtttaaccgttacgttacggtactacgggggggggggggggtaacgtaacgggaacgggtaaccgggtacggggttacgggtttacccgggttacccggttaaccggtaccgggtccgggtaacccgggttaacccggtaacccgggttacccggttcccggtaccccgg

SEQ ID NO: 184521 - DNA, 735 bp, Homo sapiens
  misc_feature: GYAE6OF01EXNK3.37.57.F02.1.454.CMB.1.raw
  modified_base (268)..(268): a, c, t, g, unknown or other
  misc_feature (268)..(268): n is a, c, g, or t
  modified_base (729)..(729): a, c, t, g, unknown or other
  misc_feature (729)..(729): n is a, c, g, or t
  modified_base (731)..(731): a, c, t, g, unknown or other
  misc_feature (731)..(731): n is a, c, g, or t
  modified_base (733)..(733): a, c, t, g, unknown or other
  misc_feature (733)..(733): n is a, c, g, or t
  modified_base (735)..(735): a, c, t, g, unknown or other
  misc_feature (735)..(735): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctggggtccgccaggctccgagggaaggggctggagtggggtggccaacataaagcaagatggaaagtaagaaggagtatgtggactctgtgaagggcctttcaccatctcagagacaacgcaagactccgngcatctgacaaatgaacagtactgagacgccgaaggacacggtcttaatttaacttacgtggccgtacgaaggaacggaaaggtacggttggggtccggtttaccgaacgtaaccgggtcggggtacccgaaacggggtaaccccgttacgggtacctaaccccggttccttccccgtacgtaccgtccccgtacccgtaaacccggaaacccgggccccgtaacgttcccgggttcccgttccccccggttccggcccgtcccccgttcgtacccgtccgtaacggaccgaccccgtaacccgtacccgaacggtacggacccaacggccggcccgggtccccggtcgggtccgtacggtcccgtaccgggtaaccgtaaccggaccttacccgtacctacgtaccgtactaaccgtacgtacggcgggtcggcggtcggaccgaggcctacgacgtagngngngn

SEQ ID NO: 184522 - DNA, 627 bp, Homo sapiens
  misc_feature: GYAE6OF01CAUPS.37.57.F02.1.454.CMB.1.raw
  modified_base (256)..(256): a, c, t, g, unknown or other
  misc_feature (256)..(256): n is a, c, g, or t
  modified_base (274)..(274): a, c, t, g, unknown or other
  misc_feature (274)..(274): n is a, c, g, or t
  modified_base (441)..(441): a, c, t, g, unknown or other
  misc_feature (441)..(441): n is a, c, g, or t
  modified_base (460)..(460): a, c, t, g, unknown or other
  misc_feature (460)..(460): n is a, c, g, or t
  modified_base (614)..(614): a, c, t, g, unknown or other
  misc_feature (614)..(614): n is a, c, g, or t
  modified_base (618)..(619): a, c, t, g, unknown or other
  misc_feature (618)..(619): n is a, c, g, or t
  modified_base (621)..(627): a, c, t, g, unknown or other
  misc_feature (621)..(627): n is a, c, g, or t
tcagtagtgtagatcacgaccggtgctcgatttagctcgatatagttgggtttgggggtccctgagactctcctgtgtagcctctgaatttcccctttacggcttattggatgagctgggtcccgccaggctccaggggaaggggctggagtggggtggccaacataaaagcaagatggaaagtaaaggaaggagtatgtggactctgtgaagggcctttcaccatctccagagaacaacgccaaagaactccgtncatctgacaaaatgaacngtctggagagccgaagacacggtcttatttatactgcgcgagagaggcgtgggtcgtttcgacgtacgcggggaccaacgggtaaccctggtaccaccggtcctccgtcaccgccctacccgaaccgaacgggccccacggtccggttccccttcccccgcggcccncccgtgcctaccgaggccncctacctcggacgacgaccgacgacggccggcccgtgggtcctcgcccgttaggtaccgaaacggtaccttaccttcccgacttaccgtacctaacgttaaccctgggaccgggcgggacgttcggacggaaaccggccgtaacgtaagtagangtcnncnnnnnnn

SEQ ID NO: 184523 - DNA, 875 bp, Homo sapiens
  misc_feature: GYAE6OF01DJ9ML.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatgggaattggggctgagcttgggttttccttgttgcttattttggaaggtgtccagtgtggaggtgctaattggtggagtcggtgggggagccgtcgtccgagccggtgggggtccctgagctcgtcctggtcgtagcctctagtaaactttccccgtttaagcctttagttacggatagaacgcgtcgggtcccgccgaggtccgtaccggagggggaacggggctggggaggtaggggtcgaaccaaacgaaataaacggacgtaaaggagtaggaaagtaaaggaaacgggaagttagtggtacggaactggtaggtaggtaaacggggtccctttacgaaacctacgttccaacgtaaacggacgaaaccgtaacccgaaacccgtaaaacggtaaccgtacccggttacgaacctaacggtttacccgttagaaaaccgttaaaacgtaacggtaaaacccggtacggtttactaagggtaacgggaacccgggaccccgggaaagggtacccggtaaaccgggttaaccttttaaacgtttttaacgttaaccggtaccgggtaaccgaccgggaaaacgggttaacggaaaaacgggggttaacccgggtttcgggggttaaacccgggttttaacccgggtaaaccgttaaacccgggggggtccggggttaaacccgaaaacccgggggggttttaaacccccctggggtacccccgttaaacccccgggg

SEQ ID NO: 184524 - DNA, 899 bp, Homo sapiens
  misc_feature: GYAE6OF01D69QR.37.57.F02.1.454.CMB.1.raw
  modified_base (607)..(607): a, c, t, g, unknown or other
  misc_feature (607)..(607): n is a, c, g, or t
tcagtagtgtagatcacgaccggtgctcgatttagctcgatataggttgggtttgggggtctcagagaggagccttagccctggactccaaggcctttccacttggtgatcagcactgagcacagaggactcaccatgggaagttggggctgagtcgttggggtttttccttggttgtctttagttttgggaaggttcgtccgtaggtggtggagggttgacgtaagttgggtggaggttcggtgggggacggtcccgtccggtcccgacggtccgggtcggggggtccctggacgtccttccgtccgttggttcgtacgcctcgttacgttaacccgtttccccgttacggtctttagttggatgtacggtcgttcgggtccccgccggtacggtccgtaccgggaagggggtacggggtcgtggggtacgggtgggtccggaaccaaacgtaaagtaaaacgacaaaggtagtaagggtaaaaggtaaaggaagggtagttaagtggtaggtaccttggtagggtacgggtaaccgggttccttacaaccgtaacttccgaacgaagaaccgaaccaaccgggactaaaaccgggctaccgggtnacctacgtacgtagaaactaagtaccgaagtcgggtaccgagaaacgggaacccgggtaccggtaaacgggtaaccttccgggtttaaacttttaagttttaccgttaaccgggagggtaacccggaacggggtaaacgggtaaaacggggggtaaccgggttcggggggttaccgggggttttacggggtttaacccctaaccccgggggttaacggggggttccgggggaaaccccggtttaaaccccgggggggttaacccttccggtaacccccggttaacccccggg

SEQ ID NO: 184525 - DNA, 804 bp, Homo sapiens
  misc_feature: GYAE6OF01BGCJ2.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattgggggctgagcgttgggttttccttgttgcttagttttggaaggtgtccaggtgtgaggtgctaagttgggtggaggtcggtggggggacggcccttcggtccgacggtccgggttcgggggggtcccctggacgtaccttccgtccgtggtagtacgccttctcgtaaccttttccccgtttaggtctttagttaggtatcggtaggttcggggtcccgtaccgtagggttaccggaagggggtaacggggtcggtggggagggttcggggtacggacccgaaacgtaagtaaaaggcgaaaggagttagggaaacggtaggaaagtaaacgtagttaagtaggtacggtactggtaggtaacgggaacgggacctacttaccgactaccttacgacccgaaggaacctaacccgaacccgtaccctaaagtaaaccgtactaagtttaacgtacttaaccgtagaaaacctaaaacgtcgaaaaccgtacgtaaccggtaaggaaccgggtaacggaccccgggaaacggtaaccggtacggtcgttaagggtacctttagtacgtggtacggaaggtagggaacggtaggggacgtaacggttaggttaacggaggttaaacggtcgggtacgttacccggtactttaccgttaaaccg

SEQ ID NO: 184526 - DNA, 910 bp, Homo sapiens
  misc_feature: GYAE6OF01CDZBV.37.57.F02.1.454.CMB.1.raw
tcagtagtgtagatcacgaccggtgctcgatttagctcgatatagttgggtttgaggtctcagagaggagccttagccctggactccaaggtcctttccacttggtgatcagcactgagcacaggagactcaccagtagggaagttggggctggaggtcgttcgggtttttccttgttgtcttagttttggaggtgtccgaggtgtgaggtgactaagttgggtggaggtcggtggggggacggccttcggtccgaggtccgggtcggggggtccctggacgtacctcgtccgtgtggtacgtccttactacgtaacctttcccggtttacggtctttagttcggtagttcggacggtcggttcggggtacccgccgacgggccgtaccgggaagggggacgggtcggtggggtagggtcggggtacgaaccgaaaacgtaaagtaaaaggacgaaaggtaaggtaagggtaaaaagtaaaggggtaaagggtaggttaacggtagggttacgggtaccgtttacggttaggggtaacggggtaaccggggtttcccgtttaacccgaacccgtaccgtttaacccggaacccggaagggtaaaccgaaacccggtaaacccgggaaccggtaaaacccgggttaacccttccgggtaacgtaacccttacgtaccgttaaccggaaacttaacggacgtaaaacggttccggttacgaaccgggaacggggtaacccgaaccggggaagtaacccgggttaacgtttactttaacgttttaacggaccgtcgggaaccgggtagaaacgggtaggtaaccggggttgggttacggggtacccggttacgtaaacgggtcccggggacgggtaacccccggtaacgggtcccggttcgggtaaacccccg

SEQ ID NO: 184527 - DNA, 755 bp, Homo sapiens
  misc_feature: GYAE6OF01CHGOB.37.57.F02.1.454.CMB.1.raw
  modified_base (655)..(655): a, c, t, g, unknown or other
  misc_feature (655)..(655): n is a, c, g, or t
tcagtagtgtagatcacgaccggtgctcgatttagctcgatatagttgggtttggggtctcagagaggagccttagccctggacctaccaaggcctttccacttggtgatcagcactgagcacagaggactcaccatggaattgggctgagcgttgggttttccttgttgtacttagttttggaaggtgtccagtgtggaggtgctaagttggtggagtcggtgggggacgtccgtccggtccgaggccggttcggggggtcccctaggacgtaccttcgtccgtaggttgtacgtccttcgttaggtaaccttttcccccgtttaggtcttttaagttcggtatggacggtacggttcgggtacccgccgacggtcctaccggaaggggaacgggtcgtgggagggttcgggtacggaccccaaagaagtaaacgcgaaaagacgttaggggaaagtaaaggaaggtagtagtggtcggacttcgtaggtacgggtaacgggttcctttacgaaccgtacgttaccgcgtaaggaacgaacccgaaccgaaccgaaacgtaacccgtcgtacgactacgtccgtagaacctaaagtacgaactggtacgtaggagacgaccggaacgtacgacggttacttagtttacgtacgnggtaccgacggaaggaacggtacgggtacgttcggggtaccgttaccgaacggttaccgggtaccgggaccgtaccgggtaaccctggtcccgtaccccg

SEQ ID NO: 184528 - DNA, 750 bp, Homo sapiens
  misc_feature: GYAE6OF01DNFCN.37.57.F02.1.454.CMB.1.raw
  modified_base (351)..(351): a, c, t, g, unknown or other
  misc_feature (351)..(351): n is a, c, g, or t
  modified_base (414)..(414): a, c, t, g, unknown or other
  misc_feature (414)..(414): n is a, c, g, or t
  modified_base (549)..(549): a, c, t, g, unknown or other
  misc_feature (549)..(549): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaagttgggctgagtcgttgggtttttccttgttgtcttagttttggaaggtcgtcctaggtgtggaggtgctaagttgggtggagtcggtgggggacgtcctcgtccgacggtccggtcgggggtccctgacgcttccgtcgtagtgtacgtccttcgtacgtaacctttccccgtttacggtctttagtcggatcggacgtcggtcgggtccncgacggcgtccgggaaggggacgggcgtgggaggtgggtacgaccaaagaagtaaagcaaagngtaaggaaagtaaggaagtagtaagtggtacgtactggttggtaacgggtacggttcctttaccaaccgtatccctaacgaagaaccgaaccaaccgaaccaaacggtaccgtccggtactactacttaccgtanaaacgtaaacgtacgtaaacgtacgttacgtaacgggacgtaaacccggccgggtaaagtacccgtaaaggtttaactttaacgtttacgtaccggttcgaaccggtacggaaggtaaccgggaacggttcggttccggggtaccgttacgaaccggttcgggtacccgggtaacgtaacccgggtacctgggtaaccccg

SEQ ID NO: 184529 - DNA, 710 bp, Homo sapiens
  misc_feature: GYAE6OF01AJ074.37.57.F02.1.454.CMB.1.raw
  modified_base (586)..(586): a, c, t, g, unknown or other
  misc_feature (586)..(586): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattgggctgagcttgggttttccttgttgctattttggaaggtgtcagtgtgaggtgctaagttggtggagtcgtgggggagcctcgtccaggccgtggggggtccctggacgactcgtcctggtcgtacgcctctagtaacttcccgtttacggcttaagttcggatgagtcgtcgggtccgccgtacggcctaccggaggggtaacggggcgttgggagggttgggtacggaccaaacaagtaaaagcaaggagtaggaaaggtaaggaacggtagttacgtggtacggtactcgtagggtacggaaacgggttccttaacgaccgtagttaccgtaccaaggaccggaacaaccgtaacgaaacgtaacctccggtagactacgtactcgaaataaagtacgaactagtgtaacgaggaaccgacggaaggacgtaaccggttnttaacgtttagtaaccgcggacggtaccgaaggtaacggaacgggttcgtcggggttacggtttacccgaaactcggggtccggggaacccgtaacgggtacccctttcggggccttaacccgg

SEQ ID NO: 184530 - DNA, 567 bp, Homo sapiens
  misc_feature: GYAE6OF01BRP28.37.57.F02.1.454.CMB.1.raw
  modified_base (370)..(370): a, c, t, g, unknown or other
  misc_feature (370)..(370): n is a, c, g, or t
  modified_base (480)..(480): a, c, t, g, unknown or other
  misc_feature (480)..(480): n is a, c, g, or t
  modified_base (559)..(559): a, c, t, g, unknown or other
  misc_feature (559)..(559): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaaggggctggagtgggtggccaacatacagggaggtggtggtacgaaaaactatgtggactctgtgcggggccgattcaccatctccagagacaacgaccaaaaactcactgtatctgcaaatggacggcctgagatccgaggacacggctgtgtattattgtgcgagagatttagactacaaagttttcgagtgactggtatgatgcttangactaccgtggggacccaaagggaccagtcggtcaccgtctcttcacgccctccaccgaacgggcccagtccggtccttccccgtcggccgtccctcgcctccgacggcnccacccgtccgagacgcaccgacgccggcccgtgggcctcgccctggtcaacggtactacttcccatctacactatcgnggcggtcg

SEQ ID NO: 184531 - DNA, 792 bp, Homo sapiens
  misc_feature: GYAE6OF01A4UVT.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccataggaattggggctgagtcgttgggtttttccttgttgcgtttagttttggaaggttcgtccgtaggtggtggaggtgacgtaagttgggtaggtagtccggtgggggacgtccttaccggtccgaggcccgggttcgggggtcccctaggacggtacccttcgttccgttagtggttacgtccttcgttacgtaaccttttccccgttaggtctttagtaggatcggacggtccgtcgggtaccgaccgagggtcctacggaagggggtacggtcgtgggtaaggtcggggtaccgaaccgtaaaagtacgtaaaacgacgaaaagggtattaaggggaaaagtaaggtaaggtaagttaagtcgggtgaaccgttggtacgggttaacggaaccgggtttcctttaccgaaaccgttcttacccgaacgtaacggaaccgaaccgaaaccgacccgtaaaactccggtacccgtaagccgtaagttcctaaaggaacccttaaagaccggtaaccgtagtaccgtaaggaccgacgtacggaacgtacgacgttactttacgtagtggacgtcggaagtgaaacggtcgtaggtccgggttattaccgacggttacggaccggttacggaacccggtttcgtgtcccggttaccg

SEQ ID NO: 184532 - DNA, 885 bp, Homo sapiens
  misc_feature: GYAE6OF01AEJXP.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagcttgggtttttccttgttgctattttaaaggtgtcagtgtgaggtggaggtgttggagtcgtgggggaggtcgttggtacgggtccgtggggggtccctggacgactcgtcctgtgcagcctcgtaggaataattattacacaaactaccgcctatcgtacttccggttcgggtccccgccgacggcctaccggaacgggggtaaggggcgttagggaggttcggggtcctcgacgtcccgtagtttcccgggacgtaaggttgggttcgggtacgggcccgaccgacctaacgtaccggaccgtacggtacccgttaccggtacggggtaaccggggttccccggtttacccgaccccggtttccgtacccgaaggacggtaactaaaccgtttacccggaaacggtaaccctacgtttacttaacgttacgttacccgtaggaaccttaaagtccgggtaaacacccggttacccggttaaggaacccggtaaccgggaccccggtaaacccggtaaaccggacccgggttaacccttaaaacgtttacgtttaaaacggttttacgttttaccgggttaacccgggtaaaacccgggtaaaaccccccgggtaaaaccccccggtttaaacgggttaccccgaaaccccgtttaacggttaacgggtttaccgggttacgttttaccggttttttaaccgggaccggttttacgggggtaaaccccgggggg

SEQ ID NO: 184533 - DNA, 746 bp, Homo sapiens
  misc_feature: GYAE6OF01BUFVU.37.57.F02.1.454.CMB.1.raw
  modified_base (271)..(271): a, c, t, g, unknown or other
  misc_feature (271)..(271): n is a, c, g, or t
  modified_base (611)..(611): a, c, t, g, unknown or other
  misc_feature (611)..(611): n is a, c, g, or t
tcagtagtgtagatcacgaccggtgctcgatttagctcgatatagttgggtttgaggtctcagagaggagaccttagccctggactccaaggcctttccacttggtgatcagcactgagcacagaggactcaccatggaattggggctgagcttgggttttccttgttgcttattttggaaggtgtccagtgtggaggtgcaagttggtggaggtcgtgggggaggcctcgtccaggccgtgggggtccctgagactctctgtgtagcctntgtaactttccccttaggcttattggatgagcgtcgggtccgcgaggctccgaggggaggggctgggaggtgggtcggaccaaacgtataaaagacgaaagtagtaaggaaagtaaaggaaagggtagttacgtgggtacgtaacgttgtgggttaggtaacgggttcccttttaccaaccgtattcccgtacccaaagggaaccgaaccctaaaccggacccctaaaacggtaacccttccgggcggtaacctattccgtaacgaacccgaaaagttcgaaaccgagtttaccgtaagggaacggtacccggccgggaaacggtacggtaacccggttntttaaacttttacggtacccgtaggacccggtacggaaaggacgggtaaacgggtacggttccggggggttacgttacccggaaccgttcgggggacggggtaccccaacgggggtccccgttcggttaccccgg

SEQ ID NO: 184534 - DNA, 756 bp, Homo sapiens
  misc_feature: GYAE6OF01BNCSH.37.57.F02.1.454.CMB.1.raw
  modified_base (337)..(337): a, c, t, g, unknown or other
  misc_feature (337)..(337): n is a, c, g, or t
  modified_base (752)..(752): a, c, t, g, unknown or other
  misc_feature (752)..(752): n is a, c, g, or t
tcagtagtgtagatcacgaccggtgctcgatttagctcgatatagttgggtctgggggaggcctcgtccagcctgggggggtccctgagactctcctgtgtagcctctgaacttcccctttacggctttattgggatgagctgggtccgccaggctccgagggaaggggctgggagtgggtgaccaacataaagcaagatggaagtaagaaggagtatgtggactctgtggaagggtcctttcaccatcctccagacgacaacgccaagaactccgtgcatctgactaaatgaacagtctagagacggccgaggacgacggtccttatttacgtacnggcgacgaaggaggaaggtcgtggggtccgttttacgaccgttacggtcgggggacctaacgggggtaacccctgggtacccaccggtttccctaccgtcgaccgtcccctacccgaaccggtaacgggtcccctaagttcccgggttacccctttccccccggacgggcccctaccccgttcgaccccttaccggacggacccgccctacccgtacggacgacgcccaacgaccggccggtaccccgggttggggacccttacgggcccgtttacggggtaacccgtaaacgggttaacccctttacgtttaccccgaactttcccgtaaacccttaccggtacccgttagggacccgggtaccgggggtacgttacggggaccgaaagggtcccgtaaacgtagtacggctancgcg

SEQ ID NO: 184535 - DNA, 697 bp, Homo sapiens
  misc_feature: GYAE6OF01EBAO7.37.57.F02.1.454.CMB.1.raw
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (661)..(661): a, c, t, g, unknown or other
  misc_feature (661)..(661): n is a, c, g, or t
  modified_base (686)..(697): a, c, t, g, unknown or other
  misc_feature (686)..(697): n is a, c, g, or t
tcagtagtgtagatcacgaccggtgctcgatttagctcgatatagttgggtttggggggtccctgagactctcctgtgtagcctctgaacttcccctttacggcttattggatgagctgggtcccgccaggctccagggaaggggctggagtgggtggccaacataaagcaagatggaagtaaagaaggagtatgtggactctgtgaaggcctttcaccatcnccaganacaacgccaaagaactccgtgcatctgacaaaagtgaacagtctaggaacgacggaccgaacgggaacgacgggacctttaatttttactaacgtcggaccggtacggaagaacggaaagggtacggttcggggttccggtttaccgaccgtaaccgggtcgggggacccgtaaaccggggaaccccgttcgggtacccctaccggttccctacccgtcaccgtccctacccaaacccggagggcccctacgttcccggttaccctcccccggtcgccccgtaccccgtgcccttaccggaaggacccgccctaccgtccgaacgacgcaacccgagggccccgtaccggtgggcctccggtaccgtggtaccgaacggacctttaccgaccttaagtaccctaactaccgttacgtacgcggtccgggtanaccggggtacacggcctagcgtagnnnnnnnnnnnn

SEQ ID NO: 184536 - DNA, 883 bp, Homo sapiens
  misc_feature: GYAE6OF01BLMM9.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccagtggaagttggggctgagcgtttgggtttttccttggttgtctttagtttttgggaagggttcgttccgtaggttggtgggtaagggtcgtagtaaaggtttggggtgggtaggttccgggttggggggacggtccgtccggtcccgacggtcccgggtcggggggtccctggacgccttcgtccgtgttcgtacgtccttcgtacgtaacccgttttcccgtttacggtactttaggttcggagtggacgtcggtccgggtccccgcggacggccgtaccgggagggggacgggcgtagggtggtcgggtacggacctaagaaagtaaacggacgaaaggtaacggtaaggggaaaagtaaggtaaacgggtagttaagtaggtacggtacgttcggtaggggtacggtaacggggtttcctttaccgaccttacgtacctacgacggtaaccgaacctaaccggaacccgtaacggtaacccgttccggtaagtacctacgtacccgtagaaaccgtaaaagtccgaacggtacgttaccggtaagggaaccgtaccgggacccggaaacgggtacgtaaccgggttacttttaacgttaacgttccggtacggaccggtacggtaaacggtaacggtaacggggttaccgggttcggggtttaacccgtcggtaaccggggttaaccgggttccggggaccccggttaacccggggaacccgtttccccgggtccgttaccccgg

SEQ ID NO: 184537 - DNA, 734 bp, Homo sapiens
  misc_feature: GYAE6OF01D6ZKF.37.57.F02.1.454.CMB.1.raw
  modified_base (364)..(364): a, c, t, g, unknown or other
  misc_feature (364)..(364): n is a, c, g, or t
  modified_base (380)..(380): a, c, t, g, unknown or other
  misc_feature (380)..(380): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattgggctgagtcgttgggttttccttgttgcttagttttggaaggtgtccagtgtgaggtgctaagttggtggagtcgtgggggacgcctcgtccaggtccggtcggggggtccctggacgtactctccgtgtcgtacgccttctagtaacctttccccgtttaggtctttagttgatgagcgtcgggtcccgcgaggccgtaccggaggggaacgggcgtggnggtcgggtcgaccaanagtaaagcaagagtaggaagtaaggaaggtagtagtggtggtaactcgtaggtacggaacggttccgtttaccaacctacttcctaccgaaggtaaccgaacctaaccggacccgaaaacgtaccctttcccgggatacctacttcgtacggaaactaaaagtggaaaccgtagtccgtaagggaacgaccgggccgggtaaaggcccgttaaacggttcttttaaagttttacccgtacggtcgacgggtaacggtaaacggaagggtaacggtacgggttcgggttacccgggtttacgacggtaacgggtccggggaacccctacgggtaacccgttcgggcccgttcccg

SEQ ID NO: 184538 - DNA, 723 bp, Homo sapiens
  misc_feature: GYAE6OF01EX8M2.37.57.F02.1.454.CMB.1.raw
  modified_base (254)..(254): a, c, t, g, unknown or other
  misc_feature (254)..(254): n is a, c, g, or t
  modified_base (335)..(335): a, c, t, g, unknown or other
  misc_feature (335)..(335): n is a, c, g, or t
  modified_base (378)..(378): a, c, t, g, unknown or other
  misc_feature (378)..(378): n is a, c, g, or t
  modified_base (715)..(715): a, c, t, g, unknown or other
  misc_feature (715)..(715): n is a, c, g, or t
  modified_base (721)..(721): a, c, t, g, unknown or other
  misc_feature (721)..(721): n is a, c, g, or t
tcagtagtgtagatcacgaccggtgctcgatttagctcgatatagttgggtctgggggaggcctcgtccagcctggggggtccctgagactctcctgtgtagcctctgaattcccctttaggctttattggatgagctgggtccgccaggctccgagggaaggggctggagtgggtgaccaacataaaagcaagataggaaagtaagaaggagtatgtggactctgtgaacgggtcctttcacctatctcaganacacgccaagactccgtgacatctagacaaaatgaaactagtctagaagacgccgaaggacacggtcttaatttagtaccnggccgacgaaggagaaggctaggggtcgtttacgacttacggnggggtacccaacggggtaaccctgggtaccgtaccgttccttcccgtagaccgtacccctacccgaacgaaacgggccctaagtcccggttacccttcccccgtacggcccgtaccccctcggccctaccgaacgggtacgacccaacccgttaccggaacggtaccgaccgacgaaccggcccggtccccgtgggtacccgttcggcccgtagggtaaccaaaccgggttcttaacccgtacccgttaacttaccgtaacccgtacgttaaacgtcgggaacggtacccgggacggttcggaacccggtaaacggtccgtaaccgaacgttacggntacgtncg

SEQ ID NO: 184539 - DNA, 735 bp, Homo sapiens
  misc_feature: GYAE6OF01D7762.37.57.F02.1.454.CMB.1.raw
  modified_base (125)..(125): a, c, t, g, unknown or other
  misc_feature (125)..(125): n is a, c, g, or t
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (263)..(263): a, c, t, g, unknown or other
  misc_feature (263)..(263): n is a, c, g, or t
  modified_base (722)..(722): a, c, t, g, unknown or other
  misc_feature (722)..(722): n is a, c, g, or t
  modified_base (729)..(735): a, c, t, g, unknown or other
  misc_feature (729)..(735): n is a, c, g, or t
tcagtagtgtagatcacgaccggtgctcgatttagctcgatatagttgggtttggggggtccctgagactctcctgtgtagcctctgaacttcccctttacggcttattggatgagctgggtccnccaggctccgaggggaagggctgggagtgggtggaccaacagtaaaagcaaagataggaaagtaagaaggagttatggtggactcgtgtggaagggtcctttcacatcncaganacaacgcaagactccgtgcatcgngacaaagtgaactgtcaggagacggccgaaggacgacgtactttaatttactacgtggaccgacggtaaggaaaggaacgggtacggtcgggggttccggtttaccgaacggttaccgggcggggaacccgtaaccgggtaacccgttcggacccgtacccggttcctccgtaccgaccgtaccccgtacccgaaacccggaccggggtaccccttaacggttccccggttccccgttccccccggcggtaccccgtccccggttcgacccgttaccggaacgggtaaccaccccgtaacccgtccgaacggtacccgaccgtaacccgcgggtccccggtcccgggttagggtccccgttacggtccggtacggtacgtaaccgtaccgtaccttacgtacctaccttacgacgtacgcggacgccgggtacgacggacgaccggactacgtacgtgncagtcannnnnnn

SEQ ID NO: 184540 - DNA, 895 bp, Homo sapiens
  misc_feature: GYAE6OF01CWE22.37.57.F02.1.454.CMB.1.raw
tcagtagtgtagatcacgaccggtgctcgatttagctcgatatagttgggtttggggtctcagagaggagccttagccctggactccaaggcctttccacttggtgatcagcactgagcacagaggactcacagtaggaagttgggctgagtcgttggttttccgtgttgtacgttagttttggaaggtcgtaccgtaggttggtgaggtgacgtaagttgggtaggtacgtcggtggggacgtccgttacgtccggacggtcccgggttcgggggttccctaggtacgtaccttccgttccgtggtcggtacgtcccgttacgttacgttaacccgtttttccccggttacggtacgttttaacgttacgggtagttacggtacggtccggttaccgggtccccgaccggtaacggtcccgttaacgggaacgggggacgggttcggtaaggggttacgggttacggggtaacccgtaaaccaaaacgttaaacgtaaaaccggtacggtaaaaggtacggtaaagggtaaaggtaaaaggtaagggtacgttaaggttgtacggtacgtgtacggtagggtaaccgtttccgttaactaaccgtactccgaaccgtaagtaaccgaacgaccgtaacgtaacgtaacccgtccgtagaaccgttacgtcgtaacgaaattaaacgaacgtaacctcggttaagacgggtaacggtaccccgaacgggtaacggtaacccgtttacgtttaaactttaacgttacgtttaaccggccgaaacggtagtaaacggaaacgggttcgggtacgggtttccggttacgttaccgggtaacccgttaacggggtacccgggtaacgacccgggttaaacccgtgtaaccccgttcccg

SEQ ID NO: 184541 - DNA, 624 bp, Homo sapiens
  misc_feature: GYAE6OF01A6JEA.37.57.F02.1.454.CMB.1.raw
  modified_base (127)..(127): a, c, t, g, unknown or other
  misc_feature (127)..(127): n is a, c, g, or t
  modified_base (453)..(453): a, c, t, g, unknown or other
  misc_feature (453)..(453): n is a, c, g, or t
  modified_base (463)..(463): a, c, t, g, unknown or other
  misc_feature (463)..(463): n is a, c, g, or t
  modified_base (494)..(494): a, c, t, g, unknown or other
  misc_feature (494)..(494): n is a, c, g, or t
  modified_base (584)..(584): a, c, t, g, unknown or other
  misc_feature (584)..(584): n is a, c, g, or t
  modified_base (614)..(614): a, c, t, g, unknown or other
  misc_feature (614)..(614): n is a, c, g, or t
  modified_base (616)..(624): a, c, t, g, unknown or other
  misc_feature (616)..(624): n is a, c, g, or t
tcagtagtgtagatcacgaccggtgctcgatttagctcgatatagttgggtttggggggtccctgagactctcctgtgtagcctctgaatttccccctttacggcttattggatgagctggggtccnccaggctccaggggaaggggctggagtggggtggccaacataaagcaaagatagggaagtaagaaggagtatgtggactctgtagaagggtccgtttacaccatcctaccgagaagaccaacgccaaagaacctccgtgacctatccagacaaaatcgaaactagtctagagacgccggaggaccacgtacttatttatactggcgacgagaaggaggtacgtgggtccggttacgaactacggacggggccgaacgggtaaccctggacctaccgtctcctacacgccctacgaccgaacggccctagtccggtcccttcccggngccgtccctnccgtacaaggcaccgtaccgccgaaggtacnccgaaccgacggcccggacccgtgggcctcggtccgtagaccgtaaggccctttactccgaactctaaccacgttcgacggaggtccggngtacggactaaacgggccaagtacgtgacncnnnnnnnnn

SEQ ID NO: 184542 - DNA, 838 bp, Homo sapiens
  misc_feature: GYAE6OF01APTGO.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaattgggggctgagcttgggttttccttgttgcttattttggaaggtgtccagtgtgaggtgcgtaagttggtggacggtcggtggggggacggtccctcggtccacggccggttggggggtcccctggacgtaccttccttcccgttggtcgtacgtcccttactacgtaaccgtttacccccgtttacggtctttagttggtatcggacgtcggtcgggtcccgccgaggtccgtaccggaggggtaacggggcgtaggggtagggtgggtcgaccaacgtaagtaaacgacaagtagtacggaaaggtaaggaagggagtagtggtagtgttcgtaggtggtaaccgggttaccctttacaccgtacttcccgtaccgaagtaccgaacccgaacccgtaccggaaacgtaccctcggtgactaacgttccgaagtacctaaacggtacgtaacgtacgtacgtacgggaacggtaccggacccgggtaaggtaaccggttaaccggttaccttttaaggtttaaccctttacggaccgggaccccgggaaacgggtaaagggtaaccggggttaccgggttaacccgggggtttccggggtttaacccggttttaaccggtaacccgggttaccggggttaccccggggggaaaccccggttaccccgggggtaccccgttcggggtaaccccccgg

SEQ ID NO: 184543 - DNA, 862 bp, Homo sapiens
  misc_feature: GYAE6OF01CNS1L.37.57.F02.1.454.CMB.1.raw
  modified_base (640)..(640): a, c, t, g, unknown or other
  misc_feature (640)..(640): n is a, c, g, or t
tcagtagtgtagatcacgaccggtgctcgatttagctcgatatagttgggtttgaggtctcagagaggagccttagccctggactccaaggccttccacttggtgatcagcactgagcacagtaggactcacagtggaagtggggctgagtcgttgggtttcctgttgtcttagttttggaaggtcgtcctagttgtgaggtgactagttgggtggtacgtgggtgggggacgtccgttcggacgtacgggtccgggttcggggggtcccctaggtaccgtacttccgtaccgttggtacgttacgtccgttacgttaaccgttaccgtttacccgttagttcgttaaggtaggtacgtagtccggtccggttccgggcccgtaccggtacggtaccggtaccgggaacggggtacgggtacggtacggggtacgggtacgggtaaccgaaccgtaaagtaacggtaaacggtaacgtaaagggtaggtaaaggtaaagggtaaacggtaagggttacgttacggtacggtacggttaacggttcggttacggtacgggttaaccggttacctaccaacggtccgtaccgtaacgaaggtaccgaaacccgtaaccgtacgtaaaccgtacgtccggtanaccgtacgtacgtaacgtaactaacggaacgtaccggaacgttacggaacggaacggtaaccggtaccgtaaccggttaaccgttaccggttactttaacggttacgtaccggtacgggaacccgtaaggaacggggttacgtaaccggggtaacggttcccgggttaaccgttaccgtacggtacgggtacccggacggttacccggtccggtccgtcccg

SEQ ID NO: 184544 - DNA, 869 bp, Homo sapiens
  misc_feature: GYAE6OF01BGGPX.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaagttggggctgagtcgtttgggtttttccttgttgtcttagttttggaaggtgtcctaggtgtaggaggtgactaagttgggtgggacggtcggtaggggggtacggtcccgtcggtccgtacgggtccggtccggggggtccctggacgtccttcctccgtgtgtacgtccttgtacgtaacctttcccgttagtcttagttggtagtgacggtcggtcggtcccgacgacgggtccgtaccgggaagggggtacgggcggttagggtaggggtcgggtacgaaccgtaaacgtaagtaaaacgagtaaaggtaaggtaaagggtaaacgtaaaggggtaagggtaagttacggtagggttacggttaccgtagggtttaacggggtaacgggttaccggggtttaccctttacccgaaccggttacttacccggtaaccgtaaaggaacccgaaaccgtaaacccggaaaccccgtaaaaccggaccgttccggtaagtcctaacgtcgtaaactaagtaaacgtacgtaaacgtcgtaggtaaacggacgaacggtaccggacggtaaccgtacgttactttaagtttacgtacgacggtacccggaaagggtaggtaaacggtaggggttaacggggttcggggttaaccgttcccgggttaaaaccgggtcggggttaccccggggaaacccggtttaaccccggggtccttccggggtaaccccg

SEQ ID NO: 184545 - DNA, 871 bp, Homo sapiens
  misc_feature: GYAE6OF01BNEGC.37.57.F02.1.454.CMB.1.raw
  modified_base (354)..(354): a, c, t, g, unknown or other
  misc_feature (354)..(354): n is a, c, g, or t
tcagtagtgtagatcacgaccggtgctcgatttagctcgatatagttgggtttggggtctcagagaggagccttagccctggactccaaggcctttccacttggtgatcagcactgagcacagaggactcaccatggaagttggggctgagtcgttgggtttttccgttgttgtcttagttttggaaggtgtccgtagtgtgaggtgctaagttggtggtagtcggtggggagccgttcgtccgaggtcccgtcgggggtccctggacgtactcctccgtgtgtacgtccgtcttacgtaaccttttccccgtttacggtactttacgttggtatggagtcgttcgggtccccnccggtacggaccgtcccggaaggggacggggtcggtagggtacgggttaggggtccggaaccgaaacgtaaagtaaaacggacgtaaaggtaggtaacgggtaaaaggtaaagggaaaggtaaagtttagtagggttacgggtaactttcggtacgggttaacgggaaccggggtttccccgtttaaccgtacccgttacgttacccgtaccggaacggtaaccgtaaaccgaaaccccggaacccgtaaacggtaacccgtccgtaccgaaccgttacgttaacgtacgtaaaccgtaaagtaccggtaaatacggtacccgtaaggaacggaacgggtacccggaaacggttaaccgccggtttaacttttaaacgtttacgttaaccggtcggaccggtaaacgagggtaaacgggttaacgggtaccggtttcggggttaccggttaccgttaaccggtacgggtacccggggaacgttaaaccccgggtacgttccgggtacctaccccggg

SEQ ID NO: 184546 - DNA, 626 bp, Homo sapiens
  misc_feature: GYAE6OF01CBDJ1.37.57.F02.1.454.CMB.1.raw
  modified_base (267)..(267): a, c, t, g, unknown or other
  misc_feature (267)..(267): n is a, c, g, or t
  modified_base (313)..(313): a, c, t, g, unknown or other
  misc_feature (313)..(313): n is a, c, g, or t
  modified_base (321)..(321): a, c, t, g, unknown or other
  misc_feature (321)..(321): n is a, c, g, or t
  modified_base (357)..(357): a, c, t, g, unknown or other
  misc_feature (357)..(357): n is a, c, g, or t
  modified_base (371)..(371): a, c, t, g, unknown or other
  misc_feature (371)..(371): n is a, c, g, or t
  modified_base (487)..(487): a, c, t, g, unknown or other
  misc_feature (487)..(487): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcgtggtttcgtgttagctatttgaaggtgtcagtgtgaggtgacaagttggtggagtcgtggggacgcctcgtccagccgtggggggtccctgacgactctccgtgtcgtagcctntaggaactttccccgtttaggcttagttggatgagtcgtgggtccncgaggtcnccggaggggtagggctagggagtgggaggcccaaanagtaaaacgcgaanagtggaaacgcgtaaagtaaatacgtaatggtaggacttgaggtgaaggggtccattcaactactctacacagacaaacggacaagaatactaatcttttagacctaaatacgaanacgttacgagacgaggtacgagtaccgacggactagtacgttattacgtacgtaagagaagaacgtaaggacggttacggggaccgtaaacgggaacccgttacggtaccgtaacccgtccgttacccgcgtaacccgg

SEQ ID NO: 184547 - DNA, 1199 bp, Homo sapiens
  misc_feature: GYAE6OF01CGUUX.37.57.F02.1.454.CMB.1.raw
  modified_base (246)..(246): a, c, t, g, unknown or other
  misc_feature (246)..(246): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattgggctgagcgttggttttccttgttgtcttattttggaagtgtccagtgtgaggtgcaattggtggagtcgtgggggacgcctcgtccagtccgtgggggtcccngacgtacctctccgtgtgtacgcctcgtacgtaccttccccgtttacggtctttagttggactgacgtcgttcgggcccgcgacggtccgtaccggaggggaacggggtcgtagggtaggtcgggtacggaccaaacgtaagtaaacgacgaaggagtaggaacgacgaaagtaaacttaacgtatcgggtacgtacgttcgtagggtacgggtaccggggtaccgtacgtttaacccgaaccttaaccgtttaccccgtaaccccgtaaacccgtaaaccgggtaaaacccccaaaaaccccgggtaaaacccgttaaaaaaacgggtttaaaaaacccgtttaaacccgtttttaaaaaacccccggtttttttttaaccccgggttttttttttttaaaaccccgggaaaaaaaaccccgggtttttaaaaaaaaccggttttaaacccccgggggtttttaaaaaaaaaccccgggtttaaaaaccccggggggggtttttttttaaaacccccggggggtttttaaaaaccccggggggggttaaaaaaaaaaccggggggggttttttaaaacccccccggggggggttttaaaaaaacccccggggggggggtttaaaaaacccccccggggggttaaaaaacccccccgggggtttaaaaacccccccccggggggggggtttttaaaaaccccccctttttaaaaaccgggggtttttttttaaaaaccccccggggggtttttttaaaaaacccggtttttttttaaaaaacccccccggggggttttttaaaaacccgggggggtttttaaaaaaaaaacccccccgggggggttaaaaaaaaccggggggtttaaaaaaaccccccgggggttttaaaaaaaaaaccccccggggggttttaaaaccccccggggggggggtttttaaaaaaacccccccc

SEQ ID NO: 184548 - DNA, 797 bp, Homo sapiens
  misc_feature: GYAE6OF01APJ8V.37.57.F02.1.454.CMB.1.raw
  modified_base (298)..(298): a, c, t, g, unknown or other
  misc_feature (298)..(298): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagtcttgggtttttccttgtttgacttagtttttagggaaggtcgtaccgagttgtgaggtgctaagttgggtgacgtcggtgggggacggtcctcgtcgacggtcccggtgggggtaccctggacgtacgtcctacgttgtacgtacnccttacgtacgtaccgtttcccccgttaggttcttagttcgggtattcggagtccgtcggggtccgaccgacggtccgtacgggaagggtacggggctgggaggtcgggtacgacaacagtaaacgagaacgtagacggtaaaggtaacggaaggtaagttagacggtacggtacttacggtagggtacgggtaaccgggttccgtttaccgaaccgttacgttacccgtaccgtaacggaaccggaacccgtaacccggtaaaccgaaacccggtaaaccgttcccgtacggtaactaacgttcgtaacgaacgtaaacgttacgaaacgtcgtacgtacggacgtaaccggacgacgtacgtaacgttcttattacgtcgtacggcggaaacgtacggaaacgggtaggttccgggttacggttaccggttacggtaccggttacggggtacccgggaaccgggtaacccgggtacccgttaccgggaccctcccgg

SEQ ID NO: 184549 - DNA, 833 bp, Homo sapiens
  misc_feature: GYAE6OF01AGMD0.37.57.F02.1.454.CMB.1.raw
tcagtagtgtagatcacgaccggtgctcgatttagctcgatatagttgggtttgggggtctcagagaggagccttagccctggactccaagcctttccacttggtgatcagcactgagcacagaggactcaccagtggagttggggctgagtcgttgggttttcctttgttgtcttagttttgggaagggttcgtacctaggtgtcggaggtggctaagttgggtggagttccggtgggggacgtccgtcggtccgacggccggttcgggggtccctggacgtaccgtccgtccttaggtcgcgtaccgcccgtgtaggtacttacctacccgttacgtaggtacgtacttacgaagtctagttacggtaacgggttccggcccggccgaccggtccggtacgggacgggggtacgggtcggtcgggtacgggttcggttacgttccgacgttaacccggtaagtttacggtaacgggtttcggtttaacgggttactttaacggtacttacgttaacccgtaccgaccgtaacggttacccgttaggaacgggtttacggggaaccgggggttaacccacggtttaccctaaaccgagttaccccgtaacgaaccgggtaacggaacctaaacccgggtaccctaaaacgtaccctaacggtaacccttccgtaactttaccggcctaagaagaaccggaactaacgttccgaacgtaggacccggtacggaaccggtacggcccgtagttacggttagttaacccgttgggtacgtcgaacccgggagttacccccggtacccttcccgacgaccgtaggcctaaacgggg

SEQ ID NO: 184550 - DNA, 742 bp, Homo sapiens
  misc_feature: GYAE6OF01ESHUZ.37.57.F02.1.454.CMB.1.raw
  modified_base (288)..(288): a, c, t, g, unknown or other
  misc_feature (288)..(288): n is a, c, g, or t
  modified_base (738)..(738): a, c, t, g, unknown or other
  misc_feature (738)..(738): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaaggggctggagtgggtggccaacataaaagcaagatggaagtaagaaggagtatgtggactctgtgaagggccgtttcaccatctccagagacaaccgccaagaactccgtgcatctgacaaatgaacngtctgagagccgaggacacggcttatttattactgcgcgagagaaggcgtgggcggtttcgacgtacgtcggggccaacggggaaccctggtccaccggtctcctcgacgtccctcccgaaccgaacgggccccaacgttccggttcccttccccccgtcgggccccgtccccgttcggtccccgttacccgaacgggacgaccccgaaccccgtaccccggaacggaccgaccgaaccgaaccgggccccgggtccccggttcggggtcccgttaccgggccccggttacggggttaacccgaaacgggttaacccgttaaccctttacccgtaaccgttacccttaaacccgtacccgtttaaaccgtcgggtaaccggggtaccgggggcccggtacggggaacccgaaacggggtacccggtaacccgtaaacggttaaggctcgngacg

SEQ ID NO: 184551 - DNA, 797 bp, Homo sapiens
  misc_feature: GYAE6OF01DRQ1D.37.57.F02.1.454.CMB.1.raw
  modified_base (174)..(174): a, c, t, g, unknown or other
  misc_feature (174)..(174): n is a, c, g, or t
  modified_base (230)..(230): a, c, t, g, unknown or other
  misc_feature (230)..(230): n is a, c, g, or t
  modified_base (718)..(718): a, c, t, g, unknown or other
  misc_feature (718)..(718): n is a, c, g, or t
tcagtagtgtagatcacgaccggtgctcgatttagctcgatatagttggggtttgggggtctcagagaggagccttagcctggactccaaggcctttccacgttggtgatcagcactgagcacagaggactcaccatggaattggggctgagtcgttgggtttttccttggttnacttagttttggaaggtgtccagtgtggtacggtgctaagttgggtggagttcggngggggacgccgtccggtccgaggtccggttcggggggtccctggagtaccttctcctggtgtacgccttcgttacgtaaccgtttccccgtttacggtctttagttcgagtggagtcgtcggtccgcgtacggcgtaccggaggggacggacgtgggtacggtacgggtacggaacctaaacggtaataaacggaccgaaaggagggtaacggtaaagtaaacgggtaacggggaagttacggtagggttcgggaacttcggtttaagggtagggtaacccgggtttaccgtttacaaacccggttctacccgtttaaccggaacggaaccggtaaacccgaaccggtaaccgtaaaacccgggtaaaccgtcccggtagtaaccggtaccttacgtagaaacccgttaaagcgtaaacccgaggttacaacggacgggtaacggccggaacggtacgtacggtactttaaggtttacctcggtacgngtaccgggaataggacggtaggcgggtttcgtacccgcggttacgggaggtaccggaaccggttccgcgtacccgtccg

SEQ ID NO: 184552 - DNA, 880 bp, Homo sapiens
  misc_feature: GYAE6OF01ADON7.37.57.F02.1.454.CMB.1.raw
  modified_base (219)..(219): a, c, t, g, unknown or other
  misc_feature (219)..(219): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgacgcgttgggttttccttggttgctttagttttgggaaggttcgtccaggtgtgaggtcgctaagttgggnggtagtcggtgggggacgtcctcggtccgaggtccggtgggggtccctgacgtactcgtctgtcgtacgcctcgtgtaacctttccccgtttaggctttacgtggatcggtacgtccggtacgggtcccgacgacgggtccctaccgggaagggggtaacggggccgttagggggacggttcgggggtaccgaacccctaaaagtaaagttaaacgggacgaaaaggtaggtaaagggaaacggtaaaagggtaagggtaaggtttaccgtagggttacgggacctttacggtagggttaacgggtaaaccggggttcccctttaaccgaacccttaccgttacccgtaaccggaaacggaaccgaaaccccggaaccgtaaaccccgaaacggttaaacccccggttccggaacgttacccgtacgttacggtaccgtaaaactaaaggtacggtaacctacgggtttacaacgggaacggtacgggaacccgggtaacggtaacctaccgggtttacctttaatttaccggtacgtacgggacgtaaccgggtaaggaacgggttaaccgggttccgggttacggggttacccggtttaccggaaccggttacgggggacccggaacccgggtaccggttcccgtacgggttacccccg

SEQ ID NO: 184553 - DNA, 801 bp, Homo sapiens
  misc_feature: GYAE6OF01BENI1.37.57.F02.1.454.CMB.1.raw
  modified_base (576)..(576): a, c, t, g, unknown or other
  misc_feature (576)..(576): n is a, c, g, or t
  modified_base (611)..(611): a, c, t, g, unknown or other
  misc_feature (611)..(611): n is a, c, g, or t
  modified_base (620)..(620): a, c, t, g, unknown or other
  misc_feature (620)..(620): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcgttgggttttccttgttgtcttattttggaaggttgtcctaggtgtggaggttgcgtaagtttgggtgggtaggttcgggtggggggacggtcccgttccggttcccgacgggtcccgggttcggggggggttaccccctggacgtaccgtttccgttcccgttggttcggttacgccttaccgttacggtaaccttttcccccggtttaacgggtcttttacggtttagggtactgggtacgtccggttcggggtccccgccggaacggtccgttaccgggaagggggacggggtcgtggggaggttcggggtacggaccaaagtaagtaaacggacgaagtagtagggaaaacggttaaggaagggtaataggtggtacggtacttcggtaggtaggaaccggttccgttaccactcttacncgtaagacgaacaccgtacaaacggtcctccgtanctatacganacaagtacgaacgtgtaccgaggacggacggaccggagtacgtcgttaatttacgttactaccgggcgccggaacggtagtaaccgggacgttacggggttcgggtttccgggtacgtacggttaccgggggtccgggaaccccggttaaccggttaccggttccggtcccgttaccccgg

SEQ ID NO: 184554 - DNA, 889 bp, Homo sapiens
  misc_feature: GYAE6OF01B12K1.37.57.F02.1.454.CMB.1.raw
tcagtagtgtagatcacgaccggtgctcgatttagctcgatatagttgggtttgggggtctcagagaggagccttagccctggactccaagcctttccacttggtgatcagcactgagcacagaggactcaccagtggaagttggggctggagtcgttgggtttttccttgttgcttagttttaggaaggtgtaccagtggtgtaggtgctaagttgggtggagtcggtagggggcgtccgttcgtaccgaggtcccgggttcggggggttccctaggacgtaccgttccgttccgttaggtcgtaccgtccttcgttacgttaacccgttttacccccgttttacggtaccttttaggttgggtagtcggacggtccgttcgggtccccgaccggtacggtccgtacgggaagggggtacgggtcggtaggggtacgggtggggtaccggaacctaaacgtaagtaaacgacgaaaggtaacggtaaggggtaaaggtaaaagggaaacggtaaggttaacgtagggttacggtacttacggttagggtacgggtaacggggttcccttaccggacctacgtcctaacgacgtaacgaaccgtaaccgacctaaacgtaaccgacggtctactacgttcaacgaacgtaacgtaacgtaacgtagtacgtacggaacggtaacggaccgggaacgtaccggtaacgttacttttaacgttacgttccggtacgccgggtaaagtaacgggtaacgggttaaacgggtccggggtttaaacggggttcccggtttaaccggtaacccgggttaacgggggttcccgggggaaacccgggttaaccccggggttaaacccggtttcccggttaaccccgggttacccccg

SEQ ID NO: 184555 - DNA, 789 bp, Homo sapiens
  misc_feature: GYAE6OF01B9TYQ.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaagttggggctgagcttgggttttccttgttgcttagttttggaaggtgtcctagtgtgaggtgactaattggtggagtcgtaggggggacgcctccggtccaggtccggttcggggggtcccctaggacgtactccgtcctggtgtacgtcctctagtaactttcccccgtttaggtcttaacgttggatcggacggccgtcggggtccccgcgtaacggcctaccgggaaggggacggggtccgtagggtcggttggggaccggtacccaaaagtaagtaaaacggcgaaaaggtacgtaaggggtaaaagtaaaggaaagggtacggttaagttggtaacggttaccgttacgtggtacgggtaaccgggtcccggtttaccaaccgtacgtcctaccgaggaccgtaaccgaacccgtaccaaacgaccgttaccggtagctacgtacgtcgaactaaaggtagaacgttagaccgttgaacgggtacgaccgggaacggtaccggtacggttacttaagtttaccgtacgtccggacgaccgtaaaggtacggtaaacgggtcggttacggggtttcccggtaacggttaaccggtaccggtcgggggtaacccggaccgggtaacccgtcggttcccggtacccg

SEQ ID NO: 184556 - DNA, 801 bp, Homo sapiens
  misc_feature: GYAE6OF01D1AK0.37.57.F02.1.454.CMB.1.raw
  modified_base (568)..(568): a, c, t, g, unknown or other
  misc_feature (568)..(568): n is a, c, g, or t
  modified_base (638)..(638): a, c, t, g, unknown or other
  misc_feature (638)..(638): n is a, c, g, or t
tcagtagtgtagatcacgaccggtgctcgatttagctcgatatagttgggtttgggggtctcagagaggagcttagccctggactccaaggcctttccacttggtgatcagcactgagcacagaggactcaccagtggaagttggggctgagtcgtttgggttttccttgttgtacttaagttttgggtaaggttcgtccgtaggttgtaggtaggtgtacgtaaggttgggtgggtaggttcggtaggggggacggtccgttaccggtccggtaccgggtcccgggtccggggggtttccctacggtacgtaccgttccgttccgtaggttcgtacgtccttcgtacgttaaccgtttccccgtttacggtacttagttaggtatggtacgtcggtcggtcccgacgtaggtccgtacgggaggggtacgggtcgtagggtaggtcggggtacgaacctaagtaaaggtaaccgaaggaaacgagtaagggtaaacgtaaaggtaaagggtataggttgtacggtactcgtaggtacgggtacggttccttaccacgtcttcaacgnggaacaaccgtaccaacgataccgtcgagtactacgtaagaaccaaagtaactacgtaaaccgtaggttnaagggaaccggtccggaacgtacggtaaccggttagttaacttttatttacgaggaccgtgtaaacggacgaaacgggttccggttagggggttcgttaaccggtttaaaccgaggtccccggggtgggaaaaccccgtttccggggacccttgtcccaaccg

SEQ ID NO: 184557 - DNA, 920 bp, Homo sapiens
  misc_feature: GYAE6OF01BTNO9.37.57.F02.1.454.CMB.1.raw
  modified_base (359)..(359): a, c, t, g, unknown or other
  misc_feature (359)..(359): n is a, c, g, or t
  modified_base (393)..(393): a, c, t, g, unknown or other
  misc_feature (393)..(393): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagcgttgggttttccttgttgcttagttttgggaaggtcgtccagtggtggaggtgcgtaagttgggtggaggtcggtagggggacgtcctcgtccgaggtccggtcggggggtccctggacgtaccttccgtccgtggttacgtacgtcccttacgtacgttaacctttcccccgtttacggtctttagtggatggagtcgtcgggcccncgacggccgtacggaggggtacggtcgtaggggnggtcgggtacgaccgaaactaagtaaacgacgaaggtaggtaaagggtaaacggtaaaggaaagggtagttaggtacgggtacggtacttcgggtaggtaacggggtaccggtttacccgttaccgtaccggtaaacctttccggtaacgtaaccggtaaaccgaaacccgtaaacccggtaaacccggtaaaacggtacccgttacccggacgtaccgttaacgtttaccggaaccgttaaaacgtaaaccggtaacgtaaaccggttacggtaaccgggtaacgggtaaccgggaccggggaacccgtaaccggggttaaccggttaacccggtttactttttaacggtttaaacccgttcggacggttaacccgggaaacgggaagggttaaacggggaccgggtttaaccggggtttccgggggtttacccggtttaaaccgggtaacccgggtttacccggggggacccgggtaaaccccgggtaacccggggtttaccccgggttcgggttaaccccccgg

SEQ ID NO: 184558 - DNA, 637 bp, Homo sapiens
  misc_feature: GYAE6OF01BY31R.37.57.F02.1.454.CMB.1.raw
  modified_base (285)..(285): a, c, t, g, unknown or other
  misc_feature (285)..(285): n is a, c, g, or t
  modified_base (316)..(316): a, c, t, g, unknown or other
  misc_feature (316)..(316): n is a, c, g, or t
  modified_base (320)..(320): a, c, t, g, unknown or other
  misc_feature (320)..(320): n is a, c, g, or t
  modified_base (618)..(618): a, c, t, g, unknown or other
  misc_feature (618)..(618): n is a, c, g, or t
  modified_base (624)..(624): a, c, t, g, unknown or other
  misc_feature (624)..(624): n is a, c, g, or t
  modified_base (628)..(628): a, c, t, g, unknown or other
  misc_feature (628)..(628): n is a, c, g, or t
  modified_base (630)..(630): a, c, t, g, unknown or other
  misc_feature (630)..(630): n is a, c, g, or t
  modified_base (632)..(632): a, c, t, g, unknown or other
  misc_feature (632)..(632): n is a, c, g, or t
  modified_base (634)..(637): a, c, t, g, unknown or other
  misc_feature (634)..(637): n is a, c, g, or t
tcagtagtgtagatcacgaccggtgctcgatttagctcgatatagttgggtttggggggtccctgagactctcctgtgtagcctctgaacttccccctttacggcttattggatgagctgggtccgccaggctccagggaagggctggagtgggtgccaacataaagcaagatggaagtaagaaggagtatgtggactctggtagaagggtcccgtttcaccgatcctaccgagacgaacaacgccaaagacctccgtgcaattcgtagacaaatgaactagtcngagacgccggagacgacggtctatttatacngcgngagagaaggtcgtcgggtcggttcgactcggtgggccgacgggaaccctggtccgtaccgtcctcctcacgccctaccaccgaacggccctagttcccgtcccttcccccgtggaccccgtcccgtcgcccgtaccgacggccgcccgtacctaccggagaccgaccgaccgacggcccggtccgtacggccgtccggtacccgttcgggtacgaaccggtaccctttaccttacccgtacttacctacgttaacctacgtacggcggcggtcgtcggacggtacggaccgactacgngtacgnacgncnangnnnn

SEQ ID NO: 184559 - DNA, 836 bp, Homo sapiens
  misc_feature: GYAE6OF01ALC5H.37.57.F02.1.454.CMB.1.raw
  modified_base (609)..(609): a, c, t, g, unknown or other
  misc_feature (609)..(609): n is a, c, g, or t
  modified_base (686)..(686): a, c, t, g, unknown or other
  misc_feature (686)..(686): n is a, c, g, or t
tcagtagtgtagatcacgaccggtgctcgatttagctcgatatagttgggtttgggggtctcagagaggagccttagccctggactccaaggcctttccacttgtgatcagcactgagcacagaggactcaccagtaggaagttggggcttaggaggccgtttgggttttttccgtttcggttggtccttaagtttttgggaaacggttggtccctaagtggtggaggttgctaagttgggtggacgtcggtgggggacggtccttcgtccgtacggccgggtcggggggttccccgtgacggtacttccgtcgtggttgtagtcctcgtcgtactttcccgttacggtctttagtggtatgacgtcgtccggccggtcgtacggactccggaggggtacggggattggggaacgttcggggacggtccgaacgtaaagtaacgtaacggtaactaaggtaggggaaaaggtaacggtaaaagggtagttaacggtggtaggtaccgttggtcggtaagggtaccgggttacgtttaccgaaccttcgtaccggtaccgtaagtaaccggtaccaaccggtaccgaaacggttaaccgtccggtaacgntaaccgtcgtacggtactaacggtacgaaccgttagtcccgtaaggaaccggcgggaaacccgtaacgggtaaccgngggttaacccttttaaacggtttacgttaacgttccggacgtaccgggaagtaaccgggtaaaggtcccgggttacggggttcgttaccggaacgtttacccgggaacgggtacccggtaacggggtacccctggtttacccgggacccc

SEQ ID NO: 184560 - DNA, 1044 bp, Homo sapiens
  misc_feature: GYAE6OF01BFUEN.37.57.F02.1.454.CMB.1.raw
tcagtagtgtagatcacgaccggtgctcgatttagctcgatatagttgggtctgggggaggcctcgtccagcctggggggtccctgagactctcctgtgtagcctctgaacttccctttagcttattggatgagctgggtccgcaggctcgagggagggtctggagtgggtcgacctaacataaagcaaagataggaaagtaacggaggtagtatggtaggtactcgtaggtacggaacgggttccctttaaccgaccattacctaccgaaggaacaacgaaccgtacctaaaggtaacccgttccgtagactaagttccgtaggaactaaaatcggaaactacgttacgaggaacgaccgggaccgtaacgggaacctacgggttacttttaaacgttttaacgttaccgacgggaacggtacggaaaggtaacggtaacgggtacggtttacggggttaacccggttttacgaaacccggttaggggttacccgggggaaaccgtaaccggggttaaccccttgggtaaaccccgttacccggtttaccctacccgtaacgtaacccccgtccccgttaaaccccgaaacccgggtaaaccgggccccctttaacgggtttacccccggttacccccgtttcccccgggtacggacccccgttaccccgttaccgggtaccccgtaaccgggtaacccggtaaccgttaacccccggtaaccccgttaacccggggtaaaccgggaacccgtaacccggttaaacccgggaccccggtttaccccgggggtacccccgttaaaccgggttacccggttacccgggttaaacccggttaacccggggttaaacccgggtaaaaccgggttttacccttaaacccggtttacccgtaaacccgtttacccgtaaaccgtttaacccggttaaacggggttaacccgggtaacgggggttacccgggtaacccgggtacggggtaaacccggtaaacccgggttaccggaaacccttaaggtaacggctaaacgggccctaaagg

SEQ ID NO: 184561 - DNA, 868 bp, Homo sapiens
  misc_feature: GYAE6OF01CAU4S.37.57.F02.1.454.CMB.1.raw
  modified_base (121)..(121): a, c, t, g, unknown or other
  misc_feature (121)..(121): n is a, c, g, or t
  modified_base (214)..(214): a, c, t, g, unknown or other
  misc_feature (214)..(214): n is a, c, g, or t
  modified_base (229)..(229): a, c, t, g, unknown or other
  misc_feature (229)..(229): n is a, c, g, or t
  modified_base (737)..(737): a, c, t, g, unknown or other
  misc_feature (737)..(737): n is a, c, g, or t
  modified_base (766)..(766): a, c, t, g, unknown or other
  misc_feature (766)..(766): n is a, c, g, or t
tcagtagtgtagatcacgaccggtgctcgatttagctcgatataggttggggtttgggggtctcagagaggagccttagccctggactccaagtcctttccacttgtgatcagcactgacncacgagacggactcaccatagggtaagttggggctggaggttcgtttgggtttttcctttgttgtctttagttttgggtaagggttcttccgngtggtggtaggtcgngttaaggttgggtgggtaggttcgggtcggggggacgtcccgtccggtaccgaccggtccggggtcggggggttccccaggacgtccttccgtcccgtggtcgtacggtcccttacgtacgtttacccttttaccccggttacgttactttaggttaggtagttacggacggtccgggtcccgggtacccgccggacggtcccgtacggggtaacggggaggggtcgggtaggggtgggtacggggacctaacccgaaaaggtaaacgaaagaacgtaaaggtaacggaaaggtaaaaggtaaaggggaacggtaagttaggtagggtaccgtagttacggttacggggtacgggtaaaccgggtttcccttaccgactaccgttaccgaacctaacggaacccgtaaaccggaacccggtaacccgaaacgtcccggtacccgtataaccgtactttaccgaacgtaaactaaacggccggtaatacgttacgagaccggtaaccgngaaccggtatacgttaactttagttaccncggtaggacgaaggttacggaacggtcgggttacggggcggttcacccggtaggtaaccggtcccgaaaccggggtagtaccccggtcgtacccggtacccc

SEQ ID NO: 184562 - DNA, 830 bp, Homo sapiens
  misc_feature: GYAE6OF01CFJ1Z.37.57.F02.1.454.CMB.1.raw
  modified_base (320)..(320): a, c, t, g, unknown or other
  misc_feature (320)..(320): n is a, c, g, or t
  modified_base (348)..(348): a, c, t, g, unknown or other
  misc_feature (348)..(348): n is a, c, g, or t
tcagtagtgtagatcacgaccggtgctcgatttagctcgatatagttgggtttgggggtctcagagaggagccttagccctggactccaaggcctttccacttgtgatcagcactgagcacagaggactcaccagtggaattggggctgagcgtggttttcctgttgctatttggaaggtgtccagtgtgaggtgcaattggtggagtcggtggggaggctcgtccagccgtgggggtcctgagactctcctgtgtagcctcgtgtaacctttcccttacggtcttaattcggatggtagcgttcggcgaccgaggtccnccgtagggacggcgtaggtggttacggnggacccaaacgtaaggtaaaacgccgtaaaagagtaaggtaaacggtaaagaagggagttaaggtaggacgtaccgtagtgggttaacggaacgggtcccggtttacaaccggtactttacccgaccgtaacgacgggaaacctaaaccgggtacccgtaaaccggaaccgtttacccccgggagtaacccggttaacgtacccgttaacggaccttaaaaacggtaccgttaaaacgcgtaacccgttaaggggaaccgaaccgggtaaccggaaaccgggtcggtaaacccggggacttttaaacgtttttaaaccggccgtttaagggacccggtttcccgggaaaaagccggggttaaaaggtacccggggttacgggttaccgggtttacccgtaaaacgtttcccggggggtaaaccgggtccccggggaaaaggttaaacccccccggggttggtacccccggtttaacccccgg

SEQ ID NO: 184563 - DNA, 803 bp, Homo sapiens
  misc_feature: GYAE6OF01BE53B.37.57.F02.1.454.CMB.1.raw
  modified_base (148)..(148): a, c, t, g, unknown or other
  misc_feature (148)..(148): n is a, c, g, or t
  modified_base (221)..(221): a, c, t, g, unknown or other
  misc_feature (221)..(221): n is a, c, g, or t
  modified_base (800)..(800): a, c, t, g, unknown or other
  misc_feature (800)..(800): n is a, c, g, or t
tcagtagtgtagatcacgaccggtgctcgatttagctcgatatagttggggtctgggggaggcctcgtccagcctgggggggtccctgagactctcctgtgtagcctctgaacttcccctttacggcttattggatgagctgggtccncaggctccgagggaagggctgggagtgggtggaccaacataaacgcaaagatggaaagtaagaaggagtatgnggtactctggtgaacggtccgtttcacctatctcagagaacaacgcaagtaacctccgtgctatctagactaaatgaacgtagtctgaagacggccggaaggtacaaccgggtactttaacgttttatttaaccgtcggacggtaccgaacggaaggaacgggtaccggttacgggggttacccgggttttaccggaaccggtttaacgggtaccgggggggtaacccgaaaccgggggtaacccccgtagggggttacccaacccggttccctttaccccggaccacccgggtccctaaccccgaaccggaaaccggggcccctaacgggttcccggtttaccccctttccccccgtgggtcccccggtccccttcggaccccgttacggacgggaccgtaccccgaccgtacccggaagacggacccacggaacgggccccgggttaccgtcggggcttccgggcccttacggggacctaaacgggtccttaccgtaccgtataccgttaaccgacttacgtacgggaacgtcccgggtacgtcgggaaccgtacgggaccgtcttaaagcgcgtancga

SEQ ID NO: 184564 - DNA, 509 bp, Homo sapiens
  misc_feature: GYAE6OF02GQTMA.37.57.F02.1.454.CMB.1.raw
  modified_base (424)..(424): a, c, t, g, unknown or other
  misc_feature (424)..(424): n is a, c, g, or t
  modified_base (503)..(503): a, c, t, g, unknown or other
  misc_feature (503)..(503): n is a, c, g, or t
  modified_base (507)..(509): a, c, t, g, unknown or other
  misc_feature (507)..(509): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggctatttatactgcgcgagagaaggactgggcggtttcgactacgtggggccagggaaccctggtcaccgtctcctcagcctccaccaaggcccatcgtctcccctgcgcctgctcagncacctcgagagcacagcggcctgggctgcctggtcaaggactacttcatctacactactgagcgggctggcaaggcgcntagnnn

SEQ ID NO: 184565 - DNA, 501 bp, Homo sapiens
  misc_feature: GYAE6OF02GPO2I.37.57.F02.1.454.CMB.1.raw
  modified_base (496)..(501): a, c, t, g, unknown or other
  misc_feature (496)..(501): n is a, c, g, or t
tcagtagtgtagatcacgaccggtgctcgatttagctcgatatagttgggtttgggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggctatttattactgcgcgagagaaggactgggcggtttcgactactggggccagggaaccctggtcaccgtctcctcagcctccaccaagggcccatcggtcttccccctggcgccctgctccaggagcacctccgagagcacagcggccctgggctgcctggtcaaggactacttccatctacactactgagcgggctggcaggcgcatagnnnnnn

SEQ ID NO: 184566 - DNA, 534 bp, Homo sapiens
  misc_feature: GYAE6OF02IEO2W.37.57.F02.1.454.CMB.1.raw
  modified_base (510)..(510): a, c, t, g, unknown or other
  misc_feature (510)..(510): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggtttccttgttgctattttggaggtgtccagtgtgaggtgcaattggtggagtctgggggaggcctcgtccagcctggggggtccctgagactctcctgtgtagcctctgaattccccttacggcttattggatgagctgggtccgccaggctccgaggggaaggggctgggagtgggtggccaaacataaagcaagatggaagtaagaaggagtatgtggactctgtgaagggccgtttcaccatctccagagacaacgccaaagaactccgtgcatctgacaaatgaacagtctgagagccgaggacacggctattatactgcgcgagagaaggactgggcgtttcgactcgnggggccaggggaccctggtcaccg

SEQ ID NO: 184567 - DNA, 530 bp, Homo sapiens
  misc_feature: GYAE6OF02I0YPD.37.57.F02.1.454.CMB.1.raw
  modified_base (522)..(522): a, c, t, g, unknown or other
  misc_feature (522)..(522): n is a, c, g, or t
  modified_base (527)..(530): a, c, t, g, unknown or other
  misc_feature (527)..(530): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaaggggctggagtgggtggccaacataaaagcaagatggaagtaagaaggagtatgtggactctgtgaagggccgtttcaccatctccagagacaacgccaagaactccgtgcatctgcaaatgaacagtctgagagccgaggacacggctatttatactgcgcgagagaaggactgggcgtttcgactacgtggggccagggaaccctggtcaccgtctcctcacgcctcaccaagggcccagtcggtccttcccctggccgtccctgcctccgaggacgccacctccgacgacgcacacgccggcctgggcctgcctggaccaaggcctactcatctacactactgacgcggctggcaggcncatgnnnn

SEQ ID NO: 184568 - DNA, 503 bp, Homo sapiens
  misc_feature: GYAE6OF02INKH1.37.57.F02.1.454.CMB.1.raw
  modified_base (475)..(475): a, c, t, g, unknown or other
  misc_feature (475)..(475): n is a, c, g, or t
  modified_base (497)..(503): a, c, t, g, unknown or other
  misc_feature (497)..(503): n is a, c, g, or t
tcagtagtgtagatcacgaccggtgctcgatttagctcgatatagttgggtttgggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggctatttattactgcgcgagagaaggactgggcggtttcgactactggggccagggaaccctggtcaccgtctcctcagcctccaccaagggcccatcggtcttcccctggcgccctgctccaggacgccacctccgagagcacagccggccctgggctgccctggtcaggactacttccatctacactacngagcggctgcagggcgcatagnnnnnnn

SEQ ID NO: 184569 - DNA, 543 bp, Homo sapiens
  misc_feature: GYAE6OF02GEOWF.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcgtggtttcgtgtaggctatttggaaggtgtccagtgtgaggtgcaattggtggagtctgggggaggcctcgtccagcctggggggtccctgagactctcctgtgtagcctctgaattcccctttacggcttattggatgagctgggtccgccaggctccagggaaggggctgggagtgggtggccaacataaagcaagatggaagtaagaaggagtatgtggactctgtgaagggccgtttcaccatctccagagacaacgccaagaactccgtgcatctgacaaatgaacagtctgagagccgaggacacggcttagtttattactgcgcgagaggaaggactggggcggtttcgacgtacgtcggggaccagggaccctggtctacccg

SEQ ID NO: 184570 - DNA, 538 bp, Homo sapiens
  misc_feature: GYAE6OF02IQ4LE.37.57.F02.1.454.CMB.1.raw
  modified_base (536)..(536): a, c, t, g, unknown or other
  misc_feature (536)..(536): n is a, c, g, or t
tcagtagtgtagatcacgaccggtgctcgatttagctcgatatagttgggtctgggggaggcctcgtccagcctggggggtccctgagactctcctgtgtagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactgggccacggaaccctggtcaccgtctcctcagcctccaccaacggcccatcggtccttcccctggccaccctcctccaagacgccacctcgtcgggggcacgacgccggcccgtcgggctcgccgtcggtcaacggactacttccactctaccactactgagcggctggcaggcgnag

SEQ ID NO: 184571 - DNA, 552 bp, Homo sapiens
  misc_feature: GYAE6OF02IAVNL.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctggggggtccctgagactctcctgtgtagcctctgaattcccctttacggcttattggatgagctgggtccgcaggctccagggaaggggctgggagtggggtggccaacataaaagcaagatggaaagtaagaaggagtatgtggactctgtgaaggggccgtttcacctatctccagagacaacgccaaagaacctcgtgcatctgcaaatgaacagtctgagagccgaggacacggctatttatactgcgcgagagaaggactggggccggtttacgacgtacgtggggccctaggggaaccctgggtactacccgg

SEQ ID NO: 184572 - DNA, 540 bp, Homo sapiens
  misc_feature: GYAE6OF02GVFXP.37.57.F02.1.454.CMB.1.raw
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacngtcngagagccgagacacggcttaatttatactgcgcgagaggaaggacgtgggcggtttacgactacgtggggaccagggaccctggtcctaccg

SEQ ID NO: 184573 - DNA, 517 bp, Homo sapiens
  misc_feature: GYAE6OF02I25V8.37.57.F02.1.454.CMB.1.raw
  modified_base (299)..(299): a, c, t, g, unknown or other
  misc_feature (299)..(299): n is a, c, g, or t
  modified_base (360)..(360): a, c, t, g, unknown or other
  misc_feature (360)..(360): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcgtggtttctgttgctatttagaaggtgtccagtgtgacgtgcaactggtggagtctgggggaggcttggtccagcctggggggtccctgagactctcctgtgcagcctctggattcaactttggagctattggatggactgggtccncagtctccagggagggctggagtgggtgccaacatacagggagtggtggtacgaaaaactntgtggactctggtgcggggccgattccaccatctccagagacaacgccaaaaactcactgtatcttgcaaagtggacgctgagatccgaggacacggctgtgtattattgtgcgagagtatttagactaactaagtttcgagtgactggtatgatcg

SEQ ID NO: 184574 - DNA, 560 bp, Homo sapiens
  misc_feature: GYAE6OF02H65JV.37.57.F02.1.454.CMB.1.raw
  modified_base (557)..(560): a, c, t, g, unknown or other
  misc_feature (557)..(560): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgacaaatgaacagtctgagagccgaggacacggctattttatactgcgcgagagaaggactgggtcgtttcgactacgtggggccacgggaaccctggtccaccgtctcctcacgccctccaccgaacgggccctaagttccggtccttcccccgtcggcccgccctcgcctccgacggacgccaccctccgacgacgcaccagccggcccgtggctcgccgtgtcaacgactactccatctaccactactgacggccgggctcggacacggcgacgagtagnnnn

SEQ ID NO: 184575 - DNA, 537 bp, Homo sapiens
  misc_feature: GYAE6OF02F8PMP.37.57.F02.1.454.CMB.1.raw
  modified_base (534)..(537): a, c, t, g, unknown or other
  misc_feature (534)..(537): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggctagtttatactgcgcgagagaaggactggggcggtttcgactactggggccaggggaaccctggtcaccgtctcctcagcctccaccaagggcccatccggtccttcccctggccgcccctgcctccagggacgccaccctccgagacgcacacgccggccctgggctgcctggtcaaggacttacttccatctacactactgagcgggctggcaaggcgcagtagnnnn

SEQ ID NO: 184576 - DNA, 542 bp, Homo sapiens
  misc_feature: GYAE6OF02IRK95.37.57.F02.1.454.CMB.1.raw
  modified_base (515)..(515): a, c, t, g, unknown or other
  misc_feature (515)..(515): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggtttccttgttgctattttggaggtgtccagtgtgaggtgcaattggtggagtctggggggaggcctcgtccagccgtggggggtccctgagactctcctgtgtagcctctgaattcccctttacggcttattggatgagctgggtccgccaggctccgagggaggggctggaggtgggtggccaacataaagcaagatggaagtaagaaggagtatgtggactctgtgaagggccgtttcaccatctccagagacaacgccaagaactccgtgcatctgcaaatgaacagtctgagagccgaggacacggcttattatactgcgcgagaggaaggactggggtcggtttcgacgtacgnggggccacgggaccctggcctacccgg

SEQ ID NO: 184577 - DNA, 222 bp, Homo sapiens
  misc_feature: GYAE6OF02H3BYU.37.57.F02.1.454.CMB.1.raw
  modified_base (220)..(222): a, c, t, g, unknown or other
  misc_feature (220)..(222): n is a, c, g, or t
tcagtagtgtagatcacgaccggtgctcgatttagctcgatatagttgggtctgggctgagctgggctaagctggacctggctgggcctccaccaagggcccatcggtcttcccctggcgccctgctccaggagcacctccgagagcacagcggccctgggctgcctggtcaaggactacttccatctacactactgagcgggctggcaaggcgcatagnnn

SEQ ID NO: 184578 - DNA, 551 bp, Homo sapiens
  misc_feature: GYAE6OF02IR7CZ.37.57.F02.1.454.CMB.1.raw
  modified_base (342)..(342): a, c, t, g, unknown or other
  misc_feature (342)..(342): n is a, c, g, or t
  modified_base (453)..(453): a, c, t, g, unknown or other
  misc_feature (453)..(453): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctggggggtccctgagactctcctgtgtagcctctgaattcccctttacggcttattggatgagctgggtccgccaggctccgaggggaaggggctggagtgggtggccaanataaagcaagatggaagtaagaaggagtatgtggactcgtgtgaagggccgtttcacctatctccaagacgacaacgccaaagacctccgtgcatctgacaaatcgaaacngtctgagacgccgaaggacacggtctatttatactgcgacgagaggaaggcgtgggcgtttacgacgttacgtggggaccacgggaccctggtacccg

SEQ ID NO: 184579 - DNA, 545 bp, Homo sapiens
  misc_feature: GYAE6OF02H6ZDA.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctggggggtcccctgagactctcctgtgtagcctctgaattcccctttacggcttattggatgagctgggtccgcaggctccgagggaaggggctgggagtgggtggccaacataaagcaagatggaaagtaagaaggagtatgtggactctgtgaagggccgtttcaccatctccagagacaacgccaaagaactccgtgcatctgcaaatgaacagtctgagagccgaggaccacggcttaatttattactgcgagagagaaggacgtggggcggtttcgactacgtggggccaggggaccctggtccaccg

SEQ ID NO: 184580 - DNA, 540 bp, Homo sapiens
  misc_feature: GYAE6OF02F20RT.37.57.F02.1.454.CMB.1.raw
  modified_base (479)..(479): a, c, t, g, unknown or other
  misc_feature (479)..(479): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctggggggtccctgagactctcctgtgtagcctctgaattcccctttacggcttattggatgagctgggtccgccaggctccgagggaaggggctgggagtggggtggccaacataaagcaagatggaagtaagaaggagtatgtggactctgtgaagggtccgtttcacatctcagagacaacgccaagaactccgtgcatctgacaaatgaacagtctagagacgccgaggacacgctatttatacngcgcgagagaaggacgtgggtcgtttacgactacggtggggaccacgggtaccctggtacc

SEQ ID NO: 184581 - DNA, 566 bp, Homo sapiens
  misc_feature: GYAE6OF02IZQ06.37.57.F02.1.454.CMB.1.raw
  modified_base (341)..(341): a, c, t, g, unknown or other
  misc_feature (341)..(341): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctggggggtccctgagactctcctgtgtagcctctgaacttccccctttacggcttattggatgagctgggtccgcaggctccgagggaggggctggagtgggtggccaanataaagcaagataggaagtaagaaggagtatgtggactctgtggaagggtccgtttcaccatcctccagagacaacgccaagaactcgtgcatctgacaaatcgaacagtctaggagagacccgaaggaccgacggtcttaatttatactgcgacgaggaggaaggacgtggggtcggtttacgacgttacggtacggggcccaacggggtaccctgggtacccg

SEQ ID NO: 184582 - DNA, 260 bp, Homo sapiens
  misc_feature: GYAE6OF02HPP3F.37.57.F02.1.454.CMB.1.raw
  modified_base (232)..(232): a, c, t, g, unknown or other
  misc_feature (232)..(232): n is a, c, g, or t
  modified_base (250)..(260): a, c, t, g, unknown or other
  misc_feature (250)..(260): n is a, c, g, or t
tcagtagtgtagatcacgaccggtgctcgatttagctcgatatagttggggtttgggacagacttcactctcaccatcagcagactggagcctgaagattttgcagtctatcactgtcagcagtatggtgactcaaagacgttcggccaagggaccaaggtggaaatgaaacgaactgtggctgcaccatctgtcttcatcttccgcatctgaatctacactactgagcggntggacaaggcgacatagnnnnnnnnnnn

SEQ ID NO: 184583 - DNA, 619 bp, Homo sapiens
  misc_feature: GYAE6OF02IDJXQ.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaggtgtccagtgtgaggtgcaatttggtggagtcgtggggggaggcctcgtccagccgtggggggtccctgagactctcctgtgtagcctctgtaactttcccctttaggcttattggatgagctgggtccgcaggctccgaggggaaggggctgggagtgggtggccaaacgataaagcaaaggataggaaagtaaggaaggagtatggtaggactctggtagaagggggtcctttacacctatctccagacgaaccaacgaccaaagaacctccggtgcattctagacaaatgaaactagtctgaacgagccggaggacacggtcttaagtttatactgcgacgaaggagaaacgggtacgtcgggggtaccggttttaccgaacgttacgggtacgggggacccaacgggggtaaccccttcggggtaccctaccccgg

SEQ ID NO: 184584 - DNA, 536 bp, Homo sapiens
  misc_feature: GYAE6OF02F1PEZ.37.57.F02.1.454.CMB.1.raw
  modified_base (507)..(507): a, c, t, g, unknown or other
  misc_feature (507)..(507): n is a, c, g, or t
  modified_base (533)..(536): a, c, t, g, unknown or other
  misc_feature (533)..(536): n is a, c, g, or t
tcagtagtgtagatcacgaccggtgctcgatttagctcgatatagttgggtctgggggaggcctcgtccagcctgggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggctatttattactgcgcgagagaaggactgggcggtttcgactacgtggggccagggaaccctggtcaccgtctcctcagcctccaccaacgggcccatccggtccttcccccgtggccgcccctgcctccaggacgccacctccgagacgcacagccggccctgggctgcctggtcaaggactactccatctacactacngacgcgggctggacaaggcgcatagnnnn

SEQ ID NO: 184585 - DNA, 584 bp, Homo sapiens
  misc_feature: GYAE6OF02IX6Z2.37.57.F02.1.454.CMB.1.raw
  modified_base (238)..(238): a, c, t, g, unknown or other
  misc_feature (238)..(238): n is a, c, g, or t
  modified_base (291)..(291): a, c, t, g, unknown or other
  misc_feature (291)..(291): n is a, c, g, or t
  modified_base (579)..(579): a, c, t, g, unknown or other
  misc_feature (579)..(579): n is a, c, g, or t
  modified_base (583)..(583): a, c, t, g, unknown or other
  misc_feature (583)..(583): n is a, c, g, or t
tcagtagtgtagatcacgaccggtgctcgatttagctcgatatagttgggtctggggggaggcctcgtccagcctggggggtccctgagactctcctgtgtagcctctgaattcccctttacggcttattggatgagctgggtccgccaggctccagggaaggggctggagtgggtggccaacataaaagcaagatggaagtaagaaggagtatgtggactctgtgaagggccgtttnaccatctccagagacaacgccaagaactccgtgcatctgcaaatgaacagtcngagagccgaggacacggcttatttattactgcgcgagagaaggactgggcgtttcgactacgtggggccaggggaaccctgggtcaccgtctcctcacgtccctccaccgaagggcccagttccggtccttcccccgtggccgccccgtgcctccgacggacgccacccgtccgagcgcacgacgccggcccgtgggctcgccgttagggtacaacggtaccttacttaccaatacctactactactacggacggtccggacgtggaccgaaggccgacgagtacggnagtnc

SEQ ID NO: 184586 - DNA, 561 bp, Homo sapiens
  misc_feature: GYAE6OF02GZU3T.37.57.F02.1.454.CMB.1.raw
  modified_base (339)..(339): a, c, t, g, unknown or other
  misc_feature (339)..(339): n is a, c, g, or t
  modified_base (433)..(433): a, c, t, g, unknown or other
  misc_feature (433)..(433): n is a, c, g, or t
  modified_base (456)..(456): a, c, t, g, unknown or other
  misc_feature (456)..(456): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctggggggtccctgagactctcctgtgtagcctctgaacttcccctttacggcttattggatgagctgggtccgccaggctccgagggagggctggagtgggtgccaanataaagcaagataggaagtaagaaggagtatgtggactctgtgaagggtccgtttcaccatctccagacgacaacgaccaaagaacctccggtncattctagacaaatgaacagtcngagcgaccgaggacacgtacttatttatactgcgacgaggaaggaaggtacgtggggtcgtttacgaacgttcggtcggggacccaaggggacccctggtacccg

SEQ ID NO: 184587 - DNA, 536 bp, Homo sapiens
  misc_feature: GYAE6OF02GLYW5.37.57.F02.1.454.CMB.1.raw
  modified_base (483)..(483): a, c, t, g, unknown or other
  misc_feature (483)..(483): n is a, c, g, or t
  modified_base (513)..(513): a, c, t, g, unknown or other
  misc_feature (513)..(513): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctggggggtccctgagactctcctgtgtagcctctgaattcccctttacggcttattggatgagctgggtccgccaggctccagggaaggggctgggagtgggtggccaacataaagcaagatggaagtaagaaggagtatgtggactctgtgaagggccgtttcaccatctccagagacaacgccaagaactccgtagcatctgacaaatgaacagtctgagagccgaggacacggctatttatactgcgngagagaaggactgggtcgtttcgactacgnggggccagggaccctggctaccg

SEQ ID NO: 184588 - DNA, 625 bp, Homo sapiens
  misc_feature: GYAE6OF02IQ3O7.37.57.F02.1.454.CMB.1.raw
  modified_base (261)..(261): a, c, t, g, unknown or other
  misc_feature (261)..(261): n is a, c, g, or t
  modified_base (300)..(300): a, c, t, g, unknown or other
  misc_feature (300)..(300): n is a, c, g, or t
  modified_base (459)..(459): a, c, t, g, unknown or other
  misc_feature (459)..(459): n is a, c, g, or t
  modified_base (469)..(469): a, c, t, g, unknown or other
  misc_feature (469)..(469): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggtttcctgtgctatttggaggtgtccagtgtgaggtgcaattggtggagtcgtgggggaggcctcgtccagccgtgggggtccctgagactctcctgtgtagcctntgaacttccccttaggcttagtggatgagctcgggtccnccgaggtctccgaaggggagggctgggagtgggtggaccaacgagtaaaggcaaggatagggaaagtaaggaagggagtagtaggtacggactcgtggtaggaaacggggtccgtttacacccgatccgtaccagaacgacaacgccaaagacctccgngacatcgtanacgaaatgaaacngtcngaagacgtccgaaggacgtaccggacttaagtttagtaaccgtgccgaccggaaggaacggacgggtaacgtcggggtaccggtttaccgacgttacggtcgggaccctaagggggaaccccctgggtaccctacccgg

SEQ ID NO: 184589 - DNA, 502 bp, Homo sapiens
  misc_feature: GYAE6OF02FX6XW.37.57.F02.1.454.CMB.1.raw
  modified_base (495)..(502): a, c, t, g, unknown or other
  misc_feature (495)..(502): n is a, c, g, or t
tcagtagtgtagatcacgaccggtgctcgatttagctcgatatagttgggtttgggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggctatttattactgcgcgagagaaggactgggcggtttcgactactggggccagggaacccctggtcaccgtctcctcagcctccaccaagggcccatcggtcttccccctggcgccctgctccaggagcacctccgagagcacagcggccctgggctgcctggtcaggctacttccatctacactactgagcgggctggcaggcgcatagnnnnnnnn

SEQ ID NO: 184590 - DNA, 528 bp, Homo sapiens
  misc_feature: GYAE6OF02JC03P.37.57.F02.1.454.CMB.1.raw
  modified_base (524)..(525): a, c, t, g, unknown or other
  misc_feature (524)..(525): n is a, c, g, or t
  modified_base (527)..(528): a, c, t, g, unknown or other
  misc_feature (527)..(528): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggctatttatactgcgcgagagaaggactgggcggtttcgactactggggccagggaaccctggtccaccgtctcctcagcctccaccaagggcccatcgtcttcccctggcgccctgcctccaggagccaccctccgagacgcacagccggccctgggctgcctggtcaaggctacttccatctacactactgacgcgggctcggcaaggccgcatagnngnn

SEQ ID NO: 184591 - DNA, 730 bp, Homo sapiens
  misc_feature: GYAE6OF02JXR19.37.57.F02.1.454.CMB.1.raw
  modified_base (349)..(349): a, c, t, g, unknown or other
  misc_feature (349)..(349): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagccgtggggggtccctgagactctcctgtgtagcctctgaattcccctttacggcttattggattgagcgtgggtccgccaggcctccgaggggaaggggctgggaggtgggtggccaanagtaaagcaagatggaaagtaagaaggagtagtggtaggactcgtaggtgaaggggtccgtttacgaccgtatccgtcccgaaggacggaaccaaaccggacccaaaaggtaaacccttcccggtagaccaacgttccgttacggaacctaaaagttcggaaaacctggttacctagggaacggacgacccgggaagggtaacccacgggttaccttaagttttaacgttaaccgtggaccgtaccgggaaggtaacgggaacggggttaccgttacggggggtacccggtttttaccgggaaccgtttaccggggttaccggggggtacccctaaaccggggggttaacccccgttggggtacccccttaacccccgggg

SEQ ID NO: 184592 - DNA, 600 bp, Homo sapiens
  misc_feature: GYAE6OF02H50KE.37.57.F02.1.454.CMB.1.raw
  modified_base (520)..(520): a, c, t, g, unknown or other
  misc_feature (520)..(520): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctggggggaggcctcgtccagcctggggggtccctgagactctcctgtgtagcctctgaattcccctttaggcttattggatgagctgggtccgcaggctccgaggggagggctgggagtgggtggccaacataaagcaagatagggaagtaaggaaggtagtagtgtaggactcgtggtaggaaggggtcccgtttacacctatcctccgagacgaacaaccggacccaaaggaaacctccggtagcctactctcgacaaatgaacagtactggagacgccgaagggaccacgggcttaatttattacngcgcgaagaggaacggacgtggggtaccggtttacgacgtacggtcggggaccacgggggtaaccctgggtcctacccgg

SEQ ID NO: 184593 - DNA, 626 bp, Homo sapiens
  misc_feature: GYAE6OF02GJ99O.37.57.F02.1.454.CMB.1.raw
  modified_base (415)..(415): a, c, t, g, unknown or other
  misc_feature (415)..(415): n is a, c, g, or t
  modified_base (445)..(445): a, c, t, g, unknown or other
  misc_feature (445)..(445): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctggggggtccctgagactctcctgtgtagcctctgaacttcccctttacggcttattggatgagctgggtccgccgaggcctccgaggggagggctgggaggtgggtggaccaacagtaaagacaagataggaaagtaagaaggagtagtgtggactgtgtggagggtccgtttcaccatccnccaagacgacaacgccaaagacctccgtanccatctgacaaatcgaaacagtctagaaggacgaccggaaggaccgaacggtcttaaagttttattaacgtcggacgacggaaggaacggaacgggtaccggttgggggtaccgttttaccggaccgttacgggtccgggggacccgtaaggggtaaccccgttcgggtaccctaccccgg

SEQ ID NO: 184594 - DNA, 559 bp, Homo sapiens
  misc_feature: GYAE6OF02GW4SN.37.57.F02.1.454.CMB.1.raw
  modified_base (556)..(559): a, c, t, g, unknown or other
  misc_feature (556)..(559): n is a, c, g, or t
tcagtagtgtagatcacgaccggtgctcgatttagctcgatatagttgggtctgggggaggcctcgtccagcctgggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcgccatctccagagacaacgccaagaactccgtgcatctgcaaatgaacagtctgagagccgaggacacggctatttattactgcgcgagagaaggactgggcggtttcgactacgtggggccaggggaaccctggtccaccggtctcctcagccctccaccaagggcccatccggtccttcccctggccgccctcgctccgaggacgccacccgtccgagacgcacgacgccggcccgtgggcctcgcctgggtcaacggacttaccttccatcctaccactacgtcgacggccgggctggaccgaaggcgacagtagnnnn

SEQ ID NO: 184595 - DNA, 812 bp, Homo sapiens
  misc_feature: GYAE6OF02FGDW5.37.57.F02.1.454.CMB.1.raw
  modified_base (317)..(317): a, c, t, g, unknown or other
  misc_feature (317)..(317): n is a, c, g, or t
tcagtagtgtagatcacgaccggtgctcgatttagctcgatatagttgggtttggggtctcagagaggagccttagccctggactccaaggcctttccacttggtgatcagcactgagcacagaggactcaccatggaattggggctgagtctgggttttcctgttgctattttggaagtgtccagtgtgaggtgctaagttggtggagtcgtggggacgcctcggtccgagccgtgggggtccctgagtctctcctgtgtacgcctctgtaaccttcccgttacggtcttagttggatggacgtcgtcgggtcccncgaggcgtaccgagggtaacgggtcgtaggtacggtagggtacgaccaaaagtaagtaaacgacgtaaaggaaggtaaggaaacggtaaggtaaggtagttaacgtgggtacgtacgttcgtacggtaacgggtaaaccgggttccctttaccgaacctacgttacccgtaacgaacggaaaccgaacccgtaaacccggaaccctaaaaccggtacccttacccgggttacgaacctaacgtttacgtaaaccggaaaccttaaaacggtacccgtaaaacggttcggttaacccggtaaggtaaacccgggaaccgggtaaacccgggtaaaccggttaaaccgttaaccgggtttacttaaacgttttaacggaccgtacggggacggttacggaaggtaacgggttaacggtccgggttacggggttacccgtttaccggacgttaccggggtaccggacccggtacggtacccgtcggtaccctaccccg

SEQ ID NO: 184596 - DNA, 635 bp, Homo sapiens
  misc_feature: GYAE6OF02IUAV6.37.57.F02.1.454.CMB.1.raw
  modified_base (456)..(456): a, c, t, g, unknown or other
  misc_feature (456)..(456): n is a, c, g, or t
tcagtagtgtagatcacgaccggtgctcgatttagctcgatatagttggggtttgggggtctcagagaggagccttagccctggactccaaggcctttccacttggtggactcagcactgagcgacacgaggactcaccatggaattcggggctgagctgggttttccttgttgctatttggaagtgtaccagtgtgaggtgcctaagttggtggagtcgtgggggaggcttggtacgaggcccgggggggtcccttggacggacctcgtcccgtgtgaagcctcgtggtattcctacgtttgacaagtgtcgccagtcgacctcgggtccgccaggccgtaccgaggggaacggggtctagggacgtgggtctcgagtttacgttaggtcggtacgtggttagtagtcacgagattacgcagactcgtagtaacgggtccgttacacctattccncgtagacgaactaattccaacgacgcacgctagttactttgcctacatacgaactgcctagacgtaccgacgaggaccgacggactaatagttattacgttagtcgtaacgtaaacctttcgtttagaccgtttggttaacttaccttaccccgtagttacgtaccctacgtaccgggg

SEQ ID NO: 184597 - DNA, 563 bp, Homo sapiens
  misc_feature: GYAE6OF02HD1X4.37.57.F02.1.454.CMB.1.raw
  modified_base (342)..(342): a, c, t, g, unknown or other
  misc_feature (342)..(342): n is a, c, g, or t
  modified_base (453)..(453): a, c, t, g, unknown or other
  misc_feature (453)..(453): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggagcctcgtccagccgtggggggtccctggagactctcctgtcgtagcctctgaacttccccttacggcttattggatgagctgggtccgcaggctccgagggaaggggctggagtgggtgccaanataaagcaagatggaagtaagaaggagtatgtggactcgtgtgaagggtccgtttacacctatcctacgagaacgacaacgccaaagactccgtgcatctgacaatgaacngtctgagacgccgaagacacggtcttagtttactacgtgcgacgagacggaaggctggggtcgtttacgacgttacggtcggggacccagggtaaccctggtcctacccg

SEQ ID NO: 184598 - DNA, 546 bp, Homo sapiens
  misc_feature: GYAE6OF02GE4GB.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtggggggtccctgagactctcctgtgtagcctctgaattcccctttacggcttattggatgagctgggtccgccaggctccagggaaggggctgggagtgggtggccaacataaagcaagatggaagtaagaaggagtagtgtggactcgtgtgaagggccgtttcaccatctccagagacaacgccaagaactccgtgcatctgcaaatgaacagtctgagagccgagacacggctattattactgcgcgagaggaaggactggggcgtttcgactacgtggggaccaggggaaccctggtacctacccgg

SEQ ID NO: 184599 - DNA, 625 bp, Homo sapiens
  misc_feature: GYAE6OF02G2GE3.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctggggggtccctgagactctcctgtgtagcctctgaattccccttacggcttatggatgagctgggtccgccaggctccgagggagggctggagtgggtggccaacagtaaatcaagataggaagtaagaaggagtatgtggactcgtgtaggaagggtccgtttcaaccattccctaccgaagacgaaccaaaccggtccaaaagaaccgtccgtagaccaattctagaccaaaagttgaaacagttcaggaacgacgacccgggaaggaccgacggtacttaagttttaactacgtggaccgcgaaggaacggtaacgggacggttggggtacccggtttgaaccgttaccgggtcgggggacccctaacgggggtacccctgggtaccccg

SEQ ID NO: 184600 - DNA, 595 bp, Homo sapiens
  misc_feature: GYAE6OF02JQT12.37.57.F02.1.454.CMB.1.raw
  modified_base (325)..(325): a, c, t, g, unknown or other
  misc_feature (325)..(325): n is a, c, g, or t
  modified_base (391)..(391): a, c, t, g, unknown or other
  misc_feature (391)..(391): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (445)..(445): a, c, t, g, unknown or other
  misc_feature (445)..(445): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcgtggtttctgtgctatttggaaggtgtcagtgtgaggtgcaattggtggagtcgtgggggaggcctcggtccaggccgtggggggtccctgaggctcgtcctgtgtagcctctgaattccccttacggcttattggatgagcgtggtccgccaggctccagggaggctggagnggtggcaacagtaagcaagatggaagtaagaaggagtatagtggactctaggtgaagggccgtttnaccgtacttcgaccagagtacaacgcaaggaaactccggtnactanccgttaanactaagtacgtaatcgtagagagacgaccggagactacgtacttaattacgtacgtgacggacgaggaacggtaacggtacgtcgggttacgttaccgtacgtaccgggtacgggacccgtaagggtaccccgttacgggacccgtaccg

SEQ ID NO: 184601 - DNA, 568 bp, Homo sapiens
  misc_feature: GYAE6OF02FP7LE.37.57.F02.1.454.CMB.1.raw
  modified_base (432)..(432): a, c, t, g, unknown or other
  misc_feature (432)..(432): n is a, c, g, or t
  modified_base (453)..(453): a, c, t, g, unknown or other
  misc_feature (453)..(453): n is a, c, g, or t
  modified_base (458)..(458): a, c, t, g, unknown or other
  misc_feature (458)..(458): n is a, c, g, or t
  modified_base (491)..(491): a, c, t, g, unknown or other
  misc_feature (491)..(491): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagcctggggggtcccctgagactctcctgtgtagcctctgaattcccctttacggcttattggatgagctgggtccgccaggctccgagggaaggggctggagtgggtgccaacataaagcaagatggaagtaagaaggagtatgtggactctgtgaagggtccgtttcaccatcctcgagacgaacaacgacaagacctcgngcatcgtgacaaatacgaacngtcgngagacggcgagacgacgtactaatttactacgngcgacgaagaggaaggacggtcggggtcgttacgacgtcgggtcggggaccgacgggacccgttcggacctacccgg

SEQ ID NO: 184602 - DNA, 789 bp, Homo sapiens
  misc_feature: GYAE6OF02I19FT.37.57.F02.1.454.CMB.1.raw
  modified_base (264)..(264): a, c, t, g, unknown or other
  misc_feature (264)..(264): n is a, c, g, or t
  modified_base (310)..(310): a, c, t, g, unknown or other
  misc_feature (310)..(310): n is a, c, g, or t
tcagtagtgtagatcacgaccggtgctcgatttagctcgatatagttgggtttgtaggtctcagagaggagccttagccctggactccaaggcctttccacttcggtgatcagcactgagcacagaggactcaccatggaattgggctgagctgggttttcctgttgctattttggaaggtgtccagtgtgaggtgcaattggtggagtctgggggagcctcgtccagccgtggggggtccctgagctctccgtgtgtagcctntgaacttccccttaggcttattggattgacgtcgtcggggttcccnccgtaggccttccgaacgggggaaggggccttagggggacggttgggggtaccgggcccctaaaacgagttaaaacgggcctaaaaggagttagggaaaaaggtaaagggaaagggaggttaagtggtacgggtacttcgtaggttagggaaacggggtcccgttttacaacccgtattcccgtacccgaggaacggtaacccaaacgtacccgaaaagtaacccgtcccggtaggaccctaagttcccggtagaacctaaaaacgttacggaaaccgaacgttaccgttagggaacgacccgggtacccgggaaagggtacccggaacgggtacctttaaagtttttaagtacccggttaggcccgtaacgggaacgggtaacggtaaaaggggccgtttacgggggtaccgtttacccgggtaacttacccgggagggggtacccccgtaaggggtaacccccgtgggttaacccgg

SEQ ID NO: 184603 - DNA, 608 bp, Homo sapiens
  misc_feature: GYAE6OF02I0I8O.37.57.F02.1.454.CMB.1.raw
  modified_base (338)..(338): a, c, t, g, unknown or other
  misc_feature (338)..(338): n is a, c, g, or t
  modified_base (398)..(398): a, c, t, g, unknown or other
  misc_feature (398)..(398): n is a, c, g, or t
  modified_base (423)..(423): a, c, t, g, unknown or other
  misc_feature (423)..(423): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctatttggaggtgtccagtgtgaggtgcaattggtggagtcgtgggggaggcctcgtccagcctggggggtccctgagactctcctgtgtagcctctgaacttcccctttacggcttattggatgagctggtccgcaggctcgagggaggggctgggagtgggtggccaanataaagcaagataggaagtaaagaaggagtagtgtggactctgtgaagggccgtttcacntctccagagacaacgcaagactcgngcatctgactaaagtcgaacagtctaggaacgacggaccggaggaccacgggtctaagttttacttactggaccgaggaacggaagggaaacggtacgggttacggggtacccgggtttttacggaacccgtttaacgggtccgggggacccctaaggggggtaacccccgttgggtaacccccg

SEQ ID NO: 184604 - DNA, 547 bp, Homo sapiens
  misc_feature: GYAE6OF02FNQZO.37.57.F02.1.454.CMB.1.raw
  modified_base (545)..(547): a, c, t, g, unknown or other
  misc_feature (545)..(547): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggctatttattactgcgcgagagaaggactgggcgtttcgactacgtggggccagggaccctggtcaccgtctcctcagccctccaccgaacgggccccatccggtccttccccctcggccgcccctgcctcccaggacgcaccctccgacgagccacagccggcccgtgggcctcggcctggtcaacggacctacttccatcctacactactggacgcgggctggcgaaggcgcatagcnnn

SEQ ID NO: 184605 - DNA, 624 bp, Homo sapiens
  misc_feature: GYAE6OF02F1HZJ.37.57.F02.1.454.CMB.1.raw
  modified_base (444)..(444): a, c, t, g, unknown or other
  misc_feature (444)..(444): n is a, c, g, or t
  modified_base (510)..(510): a, c, t, g, unknown or other
  misc_feature (510)..(510): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtggggggtccctgagactctcctgtgtacgcctctgaacttcccctttacggcttattggatgagcgtgggtccgccaggctccgaggggagggctggaggtgggtggccaacataaagcaagagtaggaagtaaggaaggagtatggtggactgtgtggaacgggtcctttacacctatctccaagacgacaacgccaagactccgtancatctgacaaagtcgaaacagtctagagacggccgaaggaccacgggtacttaatttacgttacgngccgacgaaggaaggtaacgggtacgttcgggggtaccggttttaccggaaccgtttacggggtaccgggggtacccgaacggggtaacccccggttgggtacccgtaccccgg

SEQ ID NO: 184606 - DNA, 643 bp, Homo sapiens
  misc_feature: GYAE6OF02IU75U.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgcttattttggaaggtgtccagtgtgaggtgcaattggtggagtcgtgggggaggcctcgtccagccgtggggggtccctggagactctcctgtgtagcctctgaacttcccctttacggctttattggatgagtcgtgggtccgcaggctccgaggggaagggctggagtgggtcggaccaaacataaagcaagataggaaagtaaggaaaggtagtagtcggtggactcgtaggtaggaacggggtcctttacgacctattccaccaagacgaacaaccgaccaaagaactccgtagctatcgtagactaaaagcgaaacagtactagaacggacgtaccggaacgacgaccgtattaacgttttaataccgtgacgtacgaaggaacggaacggacggtcggggttaccgtttaccgaacggtacggtcgggggaccccgtaacggggtaaccccttggtaccccgtacccgg

SEQ ID NO: 184607 - DNA, 698 bp, Homo sapiens
  misc_feature: GYAE6OF02IOJXX.37.57.F02.1.454.CMB.1.raw
  modified_base (330)..(330): a, c, t, g, unknown or other
  misc_feature (330)..(330): n is a, c, g, or t
  modified_base (697)..(697): a, c, t, g, unknown or other
  misc_feature (697)..(697): n is a, c, g, or t
tcagtagtgtagatcacgaccggtgctcgatttagctcgatatagttgggtctgggggaggcctcgtccagcctggggggtccctgagactctcctgtgtagcctctgaacttcccctttacggcttattggatgagctgggtccgccaggctccgaggggaaggggctggagtgggtggccaaacataaaagcaagatggaagtaagaaggagtatgtggactctggtaggaagggtccgtttcaccatctccagagacaacgccaaagactccgtgcatctgacaaaatgaacagtctgagagccgaggacacggtctaatttatacngcgacgaagagaaggacgtggggcggtttcgaactacggtgggggacccaaggggaaccctgggtaccaccgtcctaccgtcacgtccctaccaaccggacggcctacgtccggtcccttccccgtggcccgtccccgtcgtacccgtaccggaacgggaccgacccgtaacccgtaccggaacggaccgaccgaaccggaccgggtcccgggcccgtcggggtccttccggtcccgtacgggtaaccgaaacgggttaacccttaacccgtttaccaaccgttaccctaacctaccgttaacggtcggaaccgggtccgggtacggtacgggaaccgaacgggcccgtactaacggtacggcacgnc

SEQ ID NO: 184608 - DNA, 507 bp, Homo sapiens
  misc_feature: GYAE6OF02IMDT7.37.57.F02.1.454.CMB.1.raw
  modified_base (497)..(507): a, c, t, g, unknown or other
  misc_feature (497)..(507): n is a, c, g, or t
tcagtagtgtagatcacgaccggtgctcgatttagctcgatatagttgggtttgggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggctatttattactgcgcgagagaaggactgggcggtttcgactactggggccagggaaccctggtcaccgtctcctcagcctccaccaagggcccatcggtcttccccctggccgccctgcctccaggagcacctccgagagcacagcggccctgggctgcctggtcaaggactacttccatctacactactgagcggctggcaggcgcatagnnnnnnnnnnn

SEQ ID NO: 184609 - DNA, 673 bp, Homo sapiens
  misc_feature: GYAE6OF02GXQ6J.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtggggggtccctgagactctcctgtgtacgcctctgtaacttcccctttacggcttattggatgagcgtgggtccgccaggcctccgaggggagggctggaggtgggtgaccaagataaagcaagataggaagtaagaaggagtagtggtggactcgtgtaggaacgggtccgtttacacctatcctaccagacgaaccaacggccaaagacctcgtgacattctagacaaatcgaaactgtctaggacgacgacccgaaggaccgtaacgggtactttaagttttaacgttaccgtggacccggtacggaaagggtaacgggaaacgggtaccggttacgggggggttacccggttttttaccgggaaaccggtttaccggggtaccgggggggaacccccgtaaacggggggtaaccccccgttggggtaaccccccg

SEQ ID NO: 184610 - DNA, 604 bp, Homo sapiens
  misc_feature: GYAE6OF02HKD3E.37.57.F02.1.454.CMB.1.raw
  modified_base (457)..(457): a, c, t, g, unknown or other
  misc_feature (457)..(457): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctggggggaggcctcgtccagcctggggggtccctgagactctcctgtgtagcctctgaattcccctttacggcttattggatgagctgggtccgcaggctccgaggggaaggggctgggagtgggtgccaacataaagcaagatggaaagtaagaaggagtatggtgactctgtggaacgggtccgtttacaccatcctccgaagagaacaaccgcaagaactccgtgcatctagacaaatgaacngtctgagacgccgagaccacgggtcttaagtttactacgtggccgacggaaggaacgggaaaggtccgtgggggtccggttttacggaacccgttacgggtcgggggaccccgtaacgggggtaaccccttgggtaccctaccccgg

SEQ ID NO: 184611 - DNA, 596 bp, Homo sapiens
  misc_feature: GYAE6OF02HQLPQ.37.57.F02.1.454.CMB.1.raw
  modified_base (369)..(369): a, c, t, g, unknown or other
  misc_feature (369)..(369): n is a, c, g, or t
  modified_base (585)..(585): a, c, t, g, unknown or other
  misc_feature (585)..(585): n is a, c, g, or t
  modified_base (588)..(596): a, c, t, g, unknown or other
  misc_feature (588)..(596): n is a, c, g, or t
tcagtagtgtagatcacgaccggtgctcgatttagctcgatatagttgggtttggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaaagaactccgtgcatctgcaaatgaacagtctgagagccgaggacacggctatttattactgcgcgagaggaaggacgtggggcggtttcgactacgtggggccaggggaaccctggtccaccgtctcctcncgcctccaccgaacgggccccagtccggtccttcccccgtggcccgccctgcctccgacggacgccaccgtccgaacgacgacacgacggcccggcccgtcgggcctcggcccgttgggtaccgaaacggtacccttaccgtttacccgaacttccttaaccacttaccgtcggacgggacgggccgtcgggaccgaagggccgaccgaatacggncannnnnnnnn

SEQ ID NO: 184612 - DNA, 577 bp, Homo sapiens
  misc_feature: GYAE6OF02G5O3Z.37.57.F02.1.454.CMB.1.raw
  modified_base (268)..(268): a, c, t, g, unknown or other
  misc_feature (268)..(268): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
  modified_base (508)..(508): a, c, t, g, unknown or other
  misc_feature (508)..(508): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtggggggtccctggagactctcctgtgtagcctntgaacttcccctttacggcttattggatgagcgtggtccgccaggctccgaggggaacggggctgggaggtgggtcggccaaacagtaaacgcgaaagagtaggaaagtaagaaggagtatggtagactcgtgtgaagggtccgtttcaccatcctaccgagacgacaacgccaaagaacctcgtgacatctgacaaatgaacngtacngaagacgcgagacaggtcttaattactacgngcgagagagaaggctgggtccgttcgaacgtacggtgggaccgacgggtaaccctggtaccctacccgg

SEQ ID NO: 184613 - DNA, 738 bp, Homo sapiens
  misc_feature: GYAE6OF02FRFRN.37.57.F02.1.454.CMB.1.raw
  modified_base (342)..(342): a, c, t, g, unknown or other
  misc_feature (342)..(342): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggtttccttgttgctattttggaggtgtccagtgtgaggtgcaattggtggagtcgtgggggaggcctcgtccagccgtggggggtccctgagactctcctgtgtagcctctgaactttccccttaggcttattggatgagctgggtccgccaggctccgagggaagggctgggagtgggtggccaanataaagcaagatggaagtaagaaggagtatgtggactcgtagtagaaggggtccgtttacacctatcctaccgaaggacgaaccaaaccggacccaaagtaacccgttcccggtaggaccctaacgttccgtagaaacctaaaagttacgaaaccgtaggtttaccgtagggaacggaaccgggacccgggaaagggaacccggtaccgggttaaccttttaaatttttaacgttaaccggtagggtacccgggacggtaagggaaacggggtaaacgggttaccgggttccggggggtttaacccgggtttttaacggaacccggtttacggggttacccggggggacccgtaaacccgggggtaccccgttacggggtaccccttaaccccggg

SEQ ID NO: 184614 - DNA, 601 bp, Homo sapiens
  misc_feature: GYAE6OF02F9OUJ.37.57.F02.1.454.CMB.1.raw
  modified_base (420)..(420): a, c, t, g, unknown or other
  misc_feature (420)..(420): n is a, c, g, or t
  modified_base (442)..(442): a, c, t, g, unknown or other
  misc_feature (442)..(442): n is a, c, g, or t
  modified_base (596)..(596): a, c, t, g, unknown or other
  misc_feature (596)..(596): n is a, c, g, or t
  modified_base (599)..(599): a, c, t, g, unknown or other
  misc_feature (599)..(599): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggcctttcaccatctccagagacaacgccaagaactccgtgcatctgacaaatgaacagtctgagagccgagacacggctatttatactgcgcgagagaaggactgggcgtttcgactacgtggggccagggaccctggtccaccgtctcctcacgccctccaccgaacgggcccagtccggtccttccccgnggccgccctgcctccgaggacnccacccgtccggacgacgccaacgacgccgggcccctggggtccctcggcccgttagggtaccgaaacgggtaccttaaccgttcccaacttaccgtaacctacgtaacgtggaacggtccggggacttcggacgaacgggtccgacacgtagntcngc

SEQ ID NO: 184615 - DNA, 696 bp, Homo sapiens
  misc_feature: GYAE6OF02GZKKY.37.57.F02.1.454.CMB.1.raw
  modified_base (250)..(250): a, c, t, g, unknown or other
  misc_feature (250)..(250): n is a, c, g, or t
  modified_base (691)..(691): a, c, t, g, unknown or other
  misc_feature (691)..(691): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcgtggtttctgtgctatttagagtgtccagtgtgaggtgcagctggtggagtcgtgggggagcctggtcaagcctggggatccctgagctctcctggtncagtccctgtggacttccacctttcagtacgctatagcatgaactgggtccacgagggtcctccggaagggggtaacggggcgttggggaggtttggggtccttacacttaccgtaagttaggtaacggttaggttcgggtttaacttacaagttaacttaacctacggacaacggtaccttacgaacggggtagggaacgggggggtaccctaacgttttacccgaacccgtaacgttacccttacccgaaaggaaccggaaacccaaaccgggtttacccaaaaacggttaaccctttaccgaacctttaggttaaacttccgttaacggaacctaaaagtacggaaacctaacgccgttaggaacggtaacgcccggaaggacccgtaggaccttggtacgttacttagtcgagacgtagacccgtccctactacccncgacg

SEQ ID NO: 184616 - DNA, 523 bp, Homo sapiens
  misc_feature: GYAE6OF02HU0SW.37.57.F02.1.454.CMB.1.raw
  modified_base (383)..(383): a, c, t, g, unknown or other
  misc_feature (383)..(383): n is a, c, g, or t
  modified_base (446)..(446): a, c, t, g, unknown or other
  misc_feature (446)..(446): n is a, c, g, or t
  modified_base (473)..(473): a, c, t, g, unknown or other
  misc_feature (473)..(473): n is a, c, g, or t
  modified_base (517)..(517): a, c, t, g, unknown or other
  misc_feature (517)..(517): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctggggggtccctgagactctcctgtgtagcctctggtttcatctttagcaactacgccatgagctgggtccgccaggctccgagggaaggggctgggagtggggtctcaggtattactggtagtggtaataccgcatactacgcagactcgngacggccgtcaccgtctccagagacaattaccaagtaactacggtctatcgtagaaatgaacngctagagagaccgaggacacggccctnttactactgtagcgagagatcgagacggatagagcagcagcctntgtacg

SEQ ID NO: 184617 - DNA, 256 bp, Homo sapiens
  misc_feature: GYAE6OF02I60VX.37.57.F02.1.454.CMB.1.raw
  modified_base (250)..(256): a, c, t, g, unknown or other
  misc_feature (250)..(256): n is a, c, g, or t
tcagtagtgtagatcacgaccggtgctcgatttagctcgatatagttgggtttgggacagacttcactctcaccatcagcagactggagcctgaagattttgcagtctatcactgtcagcagtatggtgactcaaagacgttcggccaagggaccaaggtggaaatgaaacgaactgtggctgcaccatctgtcttcatcttcccgccatctgaatctacactactgagcgggctggcaaggcgcatagnnnnnnn

SEQ ID NO: 184618 - DNA, 611 bp, Homo sapiens
  misc_feature: GYAE6OF02JF9Z4.37.57.F02.1.454.CMB.1.raw
  modified_base (263)..(263): a, c, t, g, unknown or other
  misc_feature (263)..(263): n is a, c, g, or t
  modified_base (358)..(358): a, c, t, g, unknown or other
  misc_feature (358)..(358): n is a, c, g, or t
  modified_base (457)..(457): a, c, t, g, unknown or other
  misc_feature (457)..(457): n is a, c, g, or t
  modified_base (481)..(481): a, c, t, g, unknown or other
  misc_feature (481)..(481): n is a, c, g, or t
  modified_base (486)..(486): a, c, t, g, unknown or other
  misc_feature (486)..(486): n is a, c, g, or t
  modified_base (505)..(505): a, c, t, g, unknown or other
  misc_feature (505)..(505): n is a, c, g, or t
tcagtagtgtagatcacgaccggtgctcgatttagctcgatatagttgggtttgagggtctcagagaggagccttagccctggactccaaggcctttccacttggtgatcagcactgagcacagaggactcaccatggaattggggctgagctgggttttccttgttgctatttggaaggtgtccagtgtgaggtgcaatggtggagtctgggggagcctcgtccagcctggggggtccctgagactctcctgtgtacgcctntgaattcccctttaggcctttattggatgagcgtgggtccgccgaggcctccgagggaaggggctgggagtggggtcgccaacataaagcaaganggaaagtaagaagggagtaagtggaggtacgtcgtgtacggaaggggtccgttttacaccctagtcctccgaagagaaccgaacgccaaagacctccgnacctatcgagaccaaatcgaaacngtacngagacggaccgaggaaccncggacttaattttagtacgtcggacgcggaaggaaggtaacgggctagggggccgttttacggaacgttacggtcggggacccgacggggtaacccctggtacccg

SEQ ID NO: 184619 - DNA, 526 bp, Homo sapiens
  misc_feature: GYAE6OF02HAEDQ.37.57.F02.1.454.CMB.1.raw
  modified_base (515)..(526): a, c, t, g, unknown or other
  misc_feature (515)..(526): n is a, c, g, or t
tcagtagtgtagatcacgaccggtgctcgatttagctcgatatagttgggtttggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaaatgaacagtctgagagccgaggacacggctatttatactgcgcgagagaaggactgggcggtttcgactacgtggggccagggaaccctggtccaccgtctcctcacgcctccaccaacgggccccagtccggtcttcccccgtggccgccctgcctccgaggcgccaccctccgagacgcacgagccggccctgggctcgcctggcaaggctactccatctacactactgacgcgggctggcagggcacgatacgnnnnnnnnnnnn

SEQ ID NO: 184620 - DNA, 539 bp, Homo sapiens
  misc_feature: GYAE6OF02F9QPT.37.57.F02.1.454.CMB.1.raw
  modified_base (336)..(336): a, c, t, g, unknown or other
  misc_feature (336)..(336): n is a, c, g, or t
  modified_base (453)..(453): a, c, t, g, unknown or other
  misc_feature (453)..(453): n is a, c, g, or t
  modified_base (486)..(486): a, c, t, g, unknown or other
  misc_feature (486)..(486): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcgtggtttctgtgctatttggaggtgtcagtgtgaggtgcaattggtggagtcgtgggggaggcctcgtccaggccgtggggggtccctggagactctcctgtgtagcctctggattcaactttggtagctattggatggactgggtccgcagtctccgagggagggctggagtggggtgccaantacgagggaggtggtaggtaacgaaaaacgtagtgtgggactcgtggtgcgggggccattccactagtctccagacgacaacgaccaaaactcactgtatctgacaagtcggacgcngagatccgagacgacgcgtgtgttattagttgngtcgagagtattagacttaactaacgttgagtagtacgtggtatgtatgtacg

SEQ ID NO: 184621 - DNA, 547 bp, Homo sapiens
  misc_feature: GYAE6OF02HQ6MN.37.57.F02.1.454.CMB.1.raw
  modified_base (307)..(307): a, c, t, g, unknown or other
  misc_feature (307)..(307): n is a, c, g, or t
  modified_base (372)..(372): a, c, t, g, unknown or other
  misc_feature (372)..(372): n is a, c, g, or t
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
  modified_base (533)..(533): a, c, t, g, unknown or other
  misc_feature (533)..(533): n is a, c, g, or t
  modified_base (537)..(537): a, c, t, g, unknown or other
  misc_feature (537)..(537): n is a, c, g, or t
  modified_base (540)..(540): a, c, t, g, unknown or other
  misc_feature (540)..(540): n is a, c, g, or t
  modified_base (542)..(547): a, c, t, g, unknown or other
  misc_feature (542)..(547): n is a, c, g, or t
tcagtagtgtagatcacgaccggtgctcgatttagctcgatatagttgggtttgggggtccctgagactctcctgtgtagcctctgaattcccctttacggcttattggatgagctgggtccgccaggctccagggaaggggctgggagtgggtggcccaaacataaaagcaagatggaaagtaagaaggagtatgtggactctgtgaagggcctttcaccatctccagagacaacgccaaagaacctccgtgcatctgacaaatgaacatctgagagccgaggacacggcttaatttattactgcncgagagaaggacgtgggcggtttcgactacgtggggccaacgggaccctggtcaccgtcctcctnacgcctccacagggcccatcgtcttccccnggccnccctgctccaggacgccacctcgagacgcacacggccgccgtgggcctcgccgtcggtaccaaggaccttactacccatcctaacactacctgcgacggcgtggacgtaagggccgtagactaagngcancgncnnnnnn

SEQ ID NO: 184622 - DNA, 593 bp, Homo sapiens
  misc_feature: GYAE6OF02HHYHC.37.57.F02.1.454.CMB.1.raw
  modified_base (587)..(587): a, c, t, g, unknown or other
  misc_feature (587)..(587): n is a, c, g, or t
  modified_base (591)..(592): a, c, t, g, unknown or other
  misc_feature (591)..(592): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggctatttatactgcgcgagagaaggacgtgggcggtttcgactacgtggggccagggaaccctggtcaccgtctcctcacgccctccaccgaacgggcccacgttccggtcccttcccccgtgggcccgtccccgtcgtccctccgacgggacgccctacccgtccgagacgccacgcgccggcccgtgggcctcggcccgtggtacaacggtaccttacctccatcctacaccttacgtacggacggccgggtctcgggacgaacgggccgacgagtacgngtcnnc

SEQ ID NO: 184623 - DNA, 560 bp, Homo sapiens
  misc_feature: GYAE6OF02F90WM.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagccgtggggggtccctgagactctcctgtgtagcctctgaacttccccttacggtcttattggatgagctgggtccgcaggctccgagggaaggggctggagtgggtggccaacataaagcaagataggaagtaagaaggagtatggtggactctggtaggaaggggtcccgtttacaccatcctaccagacgaacaacgccaaagaactccgtagcatctgacaaatgaacagtctagagacgcggaggacacggcttattactacgtgcgacgagaggaaggacgtggggtcgtttacgactacgcggggccagggaccctggcacccg

SEQ ID NO: 184624 - DNA, 748 bp, Homo sapiens
  misc_feature: GYAE6OF02GBPOH.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggtttccttgttgctattttggaaggtgtccagtgtgaggtgcaattggtggagtcgtgggggaggcctcgtccagcctggggggtccctgagactctcctgtgtagcctctgaacttcccctttacggcttattggatgagctgggtccgccaggctccgagggaggggctggaggtgggtcggccaacagtaaagcaaagatggaaagtaagaaggagtagtggtaggacttcgtagtaggaaggggtcccgttttacacctattccgtaccaaggacgtaacgaaaccgacccaaacggaacctcccggtacgccgtaacttcgttacggaaccctaaagttaccggaaaaccgtggtaccgttagggtaacggaacggtacccgggaagggtaacccggaaccgggtccttttaaacgtttttaacgttaaccgttacgggtccggtacgggtaacggtaacggggtaaacgggtaaccggttaccggggggggtaccggttttttaaccggaaccgtttaaccgggttccgggggggtaccccggtaaccgggggtaacccccgttaggggtaccccgttaaccccggg

SEQ ID NO: 184625 - DNA, 552 bp, Homo sapiens
  misc_feature: GYAE6OF02I44U0.37.57.F02.1.454.CMB.1.raw
  modified_base (436)..(436): a, c, t, g, unknown or other
  misc_feature (436)..(436): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagccgtggggggtccctggagactctcctgtgtagcctctgaacttcccctttacggcttattggatgagctgggtccgccaggctccagggaagggctggagtgggtggccaacataaagcaagatggaagtagaaggagtatgtggactctgtgaagggccgtttcaccgatctccgagagacaacgccaaagactcgtgcatcgngcaaatgaacagtctgagacgccgaggacacgggcttaatttactactgaccgtgaagagaaggtactggggcgtttcgacttacgtcggggaccacgggaccctggtccacccgg

SEQ ID NO: 184626 - DNA, 665 bp, Homo sapiens
  misc_feature: GYAE6OF02JANR3.37.57.F02.1.454.CMB.1.raw
  modified_base (332)..(332): a, c, t, g, unknown or other
  misc_feature (332)..(332): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagccgtggggggtccctgagactctcctgtgtagcctctgaactttccccctttaacggctttagttggatgagtcgtggtccgccaggctccgagggaggggcngggagtgggtggccaacataaacgcaaggatggaaagtaagaaaggagtagtgtaggactcgtgtggaacgggtccgtttacaaccgtatcctccgaagtacgaaaccaaccggaccaaaacggaacttccgtcgacctaattcctagaaccaaagtgaaacctaggttactaggaagaccggaccgaagggacctacgggactttaaactttaacgttaccgttggacgacggtaaggaagggtaaacggtaccgggtaggggtccggttttaaccgacggttaccgggtaccggggacccggaaccggggtaaccccgttgggtaaccccg

SEQ ID NO: 184627 - DNA, 591 bp, Homo sapiens
  misc_feature: GYAE6OF02ICZYU.37.57.F02.1.454.CMB.1.raw
  modified_base (576)..(576): a, c, t, g, unknown or other
  misc_feature (576)..(576): n is a, c, g, or t
  modified_base (578)..(578): a, c, t, g, unknown or other
  misc_feature (578)..(578): n is a, c, g, or t
  modified_base (582)..(582): a, c, t, g, unknown or other
  misc_feature (582)..(582): n is a, c, g, or t
  modified_base (585)..(585): a, c, t, g, unknown or other
  misc_feature (585)..(585): n is a, c, g, or t
  modified_base (587)..(591): a, c, t, g, unknown or other
  misc_feature (587)..(591): n is a, c, g, or t
tcagtagtgtagatcacgaccggtgctcgatttagctcgatatagttgggtttggggggtccctgagactctcctgtgtagcctctgaattcccctttacggcttattggatgagctgggtccgccaggctccgggcatggggctgcagtgggtctcaagtactagtgctcctggtaatagagcagactacgcagactccgtgaagggccggttcaccatctccagagacaattccaaagaacacgctctatctgcaaatgaacagcctagagagaccgaagacgacggcgtatattactgtgtagaaaggcgtggggagtggggggactacgtggggccgagggaacccgtggtcaccgtctcctcagccctccaccaacgggcccacgttccggtcccttccccgtcggccgtcccgtcgcctccgaggacgccacccgtccgagacgcacgacggccgcccgtcgggctcgccgttaggtaccaacgggtccttaccgttaccactacctaaccacttaccgtcggtacggccggggtacgtcgggtacgaacgggccgtacaagttacggcngngacncgngnnnnn

SEQ ID NO: 184628 - DNA, 560 bp, Homo sapiens
  misc_feature: GYAE6OF02IHQ8N.37.57.F02.1.454.CMB.1.raw
  modified_base (524)..(524): a, c, t, g, unknown or other
  misc_feature (524)..(524): n is a, c, g, or t
  modified_base (558)..(560): a, c, t, g, unknown or other
  misc_feature (558)..(560): n is a, c, g, or t
tcagtagtgtagatcacgaccggtgctcgatttagctcgatatagttgggtctgggggaggcctcgtccagcctgggggggtccctgagactctcctgtgtagcctctgaattcccctttacggcttattggatgagctgggtccgccaggctccagggaaggggctggagtgggtggccaaacataaagcaagatggaagtaagaaggagtatgtggactctgtgaagggccgtttcaccatctccagagacaacgccaaagaactccgtgcatctgcaaatgaacagtctgagagccgaggacacggcttatttattactgcgcgagagaaggactgggcgtttcgactacgtggggccagggaacctggcaccgtctcctcagcctccacgaacggcccagtccgtccttccccgtgcgccctgctccaggcgcacctccgagacgacacgacgccggcccgtgggcctcggcccgtagggtaccgaaggtaccttaccgtcctactactaccacttacgngacggcggcgtcggacgaaggccgactactagcnnn

SEQ ID NO: 184629 - DNA, 632 bp, Homo sapiens
  misc_feature: GYAE6OF02GOOB0.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtggggggaggcctcgtccagccgtggggggtccctggagactctcctgtgtagcctctgtaacttcccctttacggcttattggatgagctgggtccgccgaggcctccgaggggaaggggctgggaggtggggtggaccaacagtaaagcaaagagtaggaaagtaaggaaggagtagtggtaggactcgtagtaggaacgggtcccgtttacacctatcctaccgaagacgaaccgaacgaccaaacgaaccgtcccgtagccatcctagactaaatcgaaacagtactggaacgacggacccggaggaccaacggtcttaagtttactacgtgcgacgaaggacggaagggcgttaggggtccggtttacgacgtacggtcggggcccgaacggggtaccctcgggtccctacccgg

SEQ ID NO: 184630 - DNA, 552 bp, Homo sapiens
  misc_feature: GYAE6OF02IJEBL.37.57.F02.1.454.CMB.1.raw
  modified_base (446)..(446): a, c, t, g, unknown or other
  misc_feature (446)..(446): n is a, c, g, or t
  modified_base (532)..(532): a, c, t, g, unknown or other
  misc_feature (532)..(532): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctggggggtccctgagactctcctgtgtagcctctgaacttcccctttacggcttattggatgagctgggtccgccaggctccgaggggaaggggctggaggtgggtggaccaacgataaaagcaaagagtaggaagtaaagaaaggagtatggtaggactcgtagtaggaagggtcccgtttacaccatcctcagagacaacgcaaagacctcgncatctgacaaatgaaacagtctagagacgccgaaggacacggcttaatttatactgacgcgagagaagcgtggcgtttgactacgngggaccagggaccctggtcc

SEQ ID NO: 184631 - DNA, 630 bp, Homo sapiens
  misc_feature: GYAE6OF02ISO4E.37.57.F02.1.454.CMB.1.raw
  modified_base (386)..(386): a, c, t, g, unknown or other
  misc_feature (386)..(386): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcgtggtttctgtgctatttggaggtgtcagtgtgaggtgcaattggtggagtcgtgggggaggcctcgtccagccgtggggggtccctggagactctcctgtgtagcctctgaacttcccctttacggctttattggatgagcgtgggtcccgccgaggcctccgaggggaaggggctgggagtgggtcggaccaaacataaagcaaagagtaggaaagtaagaaggtagtatgnggtactcgtggtaggaagggtccgtttacaccattctaccgagaacgaaccaacggaccaaagtaacctccgtgactacgtcctgaacaaagttgaaactgtcaggagacggcccggaaggaccacggtctttaattttacaccgtggaccgcgtaaggaggtaacggtcgttgggggtaccgtttacgaacgttccgggtacggggacccgtaaggggaacccccttgggtacccctacccgg

SEQ ID NO: 184632 - DNA, 799 bp, Homo sapiens
  misc_feature: GYAE6OF02H1M9O.37.57.F02.1.454.CMB.1.raw
tcagtagtgtagatcacgaccggtgctcgatttagctcgatatagttgggtttgggggtcgtcgagagaggagcttagccctggactccaaggccttccacttggtgatcagcactgagcacagaggactcaccatggaattggggctgagcgtgggttttcctggttgcttatttggaaggtgtccgagtgtgaggtgctaattggtggagtccgtgggggagtcctcgtccaggccgtgggggggtccctaggacgaccgttcctccgtggtcgttagcccgttctacggaacttttcccccgttaaggccttttaagtcggaacttgacgcgtcgggggttcccaccgacggtcctaccgaaggggggtaacggcgttcgggaggtcggggtcggaaccaacgtaagtaaaacggctaaaggacttggggaaaataaagggaacggtagtaactgggtacgggaactcgttgggtaacgaaacggggtcccgttttacaaccgtacttccgtaccgagtaacggaaaccgaaccgaccgtaaacggtaccgtacccggacgtagtaactccggtacgtaacgtaaaactcggaaactacggtaacctagggtaacggacggtacccgaaacgggtaaccgaccgggtaactttaacggttttaaatccgttacggacggtaccggtaagggaataacggggtaaccggttaggggttccccggttaaggtaaccgtaccgggttacgggggtacccgaaaaccggggtcccgtttaccggggacctaacccccggg

SEQ ID NO: 184633 - DNA, 518 bp, Homo sapiens
  misc_feature: GYAE6OF02GHXU6.37.57.F02.1.454.CMB.1.raw
  modified_base (490)..(490): a, c, t, g, unknown or other
  misc_feature (490)..(490): n is a, c, g, or t
  modified_base (508)..(518): a, c, t, g, unknown or other
  misc_feature (508)..(518): n is a, c, g, or t
tcagtagtgtagatcacgaccggtgctcgatttagctcgatatagttgggtttggggggtccctgagactctcctgtgtagcctctgaattcccctttacggcttattggatgagctgggtccgccaggctccagggaaggggctggagtgggtggccaacataaaagcaagatggaagtaagaaggagtatgtggactctgtgaagggccgtttcaccatctccagagacaacgccaagaactccgtgcatctgcaaatgaacagtctgagagccgaggacacggctatttattactgcgcgagagaaggactgggcggtttcgactagtggggccagggaaccctggtcaccgtctcctcacgcctccaccaagggccccatccggtctcccctggccgccctgcctcagcgcacctccgagagcacacgccggcccgtgggctcgcctggtcaacggactacttccactctacactacgtgagcggntcggcgacggcgcatagnnnnnnnnnnn

SEQ ID NO: 184634 - DNA, 570 bp, Homo sapiens
  misc_feature: GYAE6OF02IXLI1.37.57.F02.1.454.CMB.1.raw
  modified_base (567)..(569): a, c, t, g, unknown or other
  misc_feature (567)..(569): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaagggctggagtgggtggccaacataaagcaagatggaagtaagaaggagtatgtggactctggtgaagggcctttcaccatctccagagacaacgccaagaactccgtgcatctgacaaatgaacagtctgagagccgaggacacggctatttatactgcgcgagagaaggactgggcgtttcgactacgtcggggccgagggaaccctgggtccaccggtctcctctacgcctccgaccaagggcccaagtccggtccttcccccgtggccgcccctcgctccgacggcgccaccgtccgacgacgcacgacgccggcccgtggctcgccgtggaccaacggtactaccttcaacgtcactacacgttcggacggcgggccgcggcgtaaggcgactagtacggacnnnc

SEQ ID NO: 184635 - DNA, 626 bp, Homo sapiens
  misc_feature: GYAE6OF02IZMXD.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaggtgtccagtgtcaggtgcacctggtggagtcgtgggggaggcgtggtccagcctggggacggtccctgagactctcctgtatacgcctcgtggattccaccttcagcaactagtggcatgcacgtcggggtcccgccgaggcctccgaggcgaaggggctgggaggtgggtgcgtagttatagtcagatgagtggaagttgttagaggtagtagtcgcgtagacgtacggtaggaacgggtccgtagttccaaccgtacttccgtaccgaaggaacgaacctaacgttaacccgaaacgaaccaacgtaaccttactaacttctacgaactaaacgtacgaacctacgaccgttaagacgtaacgtggaacggaaccgacggtcgtagttacgtaacttaccgtacgttacggtacggtaaccggtaaaccgggtagggggttaacgg

SEQ ID NO: 184636 - DNA, 574 bp, Homo sapiens
  misc_feature: GYAE6OF02IWJ7I.37.57.F02.1.454.CMB.1.raw
  modified_base (423)..(423): a, c, t, g, unknown or other
  misc_feature (423)..(423): n is a, c, g, or t
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
  modified_base (463)..(463): a, c, t, g, unknown or other
  misc_feature (463)..(463): n is a, c, g, or t
  modified_base (482)..(482): a, c, t, g, unknown or other
  misc_feature (482)..(482): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaggtgtccagtgtgaggtgcaattggtggagtcgtgggggaggcctcgtccagccgtggggggtccctggagactctcctgtgtagcctctgaacttcccctttaggcttattggatgagctgggtccgcaggctccgaggggaggggctgggagtggggtggaccaacgataaagcaagataggaaagtaagaaggagtagtggtggactcgtgtggaagggtccgtttcaccgatctaccaganacaacgcaagacctcgngcatcngacaaatgaactgtacngagcgaccgagacgacgtnttattagtactgcgacggagacggaagggcgttgggggtaccgtttcgacgttacggtcggggacccaaggggtaccctgggtacctaccgg

SEQ ID NO: 184637 - DNA, 608 bp, Homo sapiens
  misc_feature: GYAE6OF02GLQDM.37.57.F02.1.454.CMB.1.raw
  modified_base (604)..(605): a, c, t, g, unknown or other
  misc_feature (604)..(605): n is a, c, g, or t
  modified_base (607)..(608): a, c, t, g, unknown or other
  misc_feature (607)..(608): n is a, c, g, or t
tcagtagtgtagatcacgaccggtgctcgatttagctcgatatagttgggtctggggggaggcctcgtccagcctgggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggtccgtttcaccatctccagagacaacgccaagaactccgtgcatctagaaaatgaacagtctgagagccgaggacacggctatttatactggcgcggagaggaaggctggggcggtttcgactacgtggggcccaagggaaccctggtccaccgtctcctcacgccctccaaccgaacgggcccagtcccggtcccttcccccgtcggccgcccgtcgcctccgaggacgccacccgtccgagcgccacgacggcccggcccgtgggcctcggtcccgtggtaccgaacgggtaccttaccttcccaacttcctaaccgacttaccgtcggacgggccgggacgtcgggaccgaacgggccgacgagtacgcnngnn

SEQ ID NO: 184638 - DNA, 614 bp, Homo sapiens
  misc_feature: GYAE6OF02IGBRO.37.57.F02.1.454.CMB.1.raw
  modified_base (493)..(493): a, c, t, g, unknown or other
  misc_feature (493)..(493): n is a, c, g, or t
  modified_base (540)..(540): a, c, t, g, unknown or other
  misc_feature (540)..(540): n is a, c, g, or t
  modified_base (551)..(551): a, c, t, g, unknown or other
  misc_feature (551)..(551): n is a, c, g, or t
  modified_base (586)..(586): a, c, t, g, unknown or other
  misc_feature (586)..(586): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcttgggttttccttgttgcttattttggaaggtgtccagtgtgaggtgcaattggtggagtcgtgggggagcctcgtccagccgtgggggtccctgacgactctcctgtgtagcctctgtaactttccccctttacggctttaagttggatggagcgttgggtcccgccgaggccttaccggaagggggaaggggcgtgggaggtggggtcggacccaaacgaagtaaaagaccgaaagtaagtagggaaagtaaggaaaggaagtagtggtggaacttcgtgtagaacgggtccgtttcacctactcctccgaagacgaccaaccgccaaagtacctccgngccattccagacaaatcgaactagtcagagacgccgagaccacggtnttaattatcgngcgagagagaacggtgtggtcgtttacgagtcggngggacccgacgggtacctgggtccaccg

SEQ ID NO: 184639 - DNA, 636 bp, Homo sapiens
  misc_feature: GYAE6OF02JXM61.37.57.F02.1.454.CMB.1.raw
  modified_base (206)..(206): a, c, t, g, unknown or other
  misc_feature (206)..(206): n is a, c, g, or t
  modified_base (310)..(310): a, c, t, g, unknown or other
  misc_feature (310)..(310): n is a, c, g, or t
  modified_base (481)..(481): a, c, t, g, unknown or other
  misc_feature (481)..(481): n is a, c, g, or t
  modified_base (558)..(558): a, c, t, g, unknown or other
  misc_feature (558)..(558): n is a, c, g, or t
tcagtagtgtagatcacgaccggtgctcgatttagctcgatatagttgggtttgggggtcgtcagagaggagccttagccctggactccaaggcctttccacttggtgatcagcactgagcacagaggactcaccatggaattggggctgagctgggttttcctgttgcttattttggaaggtgtccagtgtgaggtgcaattggnggagtcgtgggggagcctcgtccagccgtggggggtccctgagctctcctgtgtagcctctgacttccccgttacgcttacttggattggagtcgtgggtcccnccgacggcctccgagggaacggggcgtgggaggtcggggtcggaccgaacgaagtaaagcgaagagtaggaagtaaagaacggagtacgtggtacggactcgtcgtaggaacggggtccgtttacaccgtctaccgtaccgtagacgaaccgaacggcaaacgactaccgngacatcgtagacaagtacgaactagtcgtagaggacgaccggaagaccgacggtacttatttacgtaagtcgaccgngtaacgaggtaacgggtacgtcgggtcggtttacgacgtacggtcgggaccgtacgggaacccgtggtacccgtaccg

SEQ ID NO: 184640 - DNA, 594 bp, Homo sapiens
  misc_feature: GYAE6OF02G5WUA.37.57.F02.1.454.CMB.1.raw
  modified_base (455)..(455): a, c, t, g, unknown or other
  misc_feature (455)..(455): n is a, c, g, or t
  modified_base (471)..(471): a, c, t, g, unknown or other
  misc_feature (471)..(471): n is a, c, g, or t
  modified_base (475)..(475): a, c, t, g, unknown or other
  misc_feature (475)..(475): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagccgtggggggtccctgagactctcctgtgtagcctctgacttcccctttacggcttattggatgagctcgggtccgccaggctccgagggaaggggctgggaggtgggtggccaacaataaagcaagatggaaagtaaggaagggagtagtggtggactcgtgtagaaggggtccgtttcaccgattctccgagacgacaaaccgcaaagacctccgtgccatcngacaaatgaacagtcngagngccggagaccacggtcttatttactcgtgccgtagaggaaggtaacgggcgttgggggtcgtttccggaacgttaccggtcgggggacccctaacggggacccttgggacctaccccgg

SEQ ID NO: 184641 - DNA, 739 bp, Homo sapiens
  misc_feature: GYAE6OF02J0B1T.37.57.F02.1.454.CMB.1.raw
  modified_base (310)..(310): a, c, t, g, unknown or other
  misc_feature (310)..(310): n is a, c, g, or t
  modified_base (325)..(325): a, c, t, g, unknown or other
  misc_feature (325)..(325): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgcggggccgattcaccatctccagagacaacgaccaaaactcactgtatctgcaaatggacgcctgagatccgaggacacggctgtntattatgtgcgaganatttagactacgaaagtttcgagttgactggtatgactgtcttaatgtagtaccgtggggacctaaaggggaccctagttcggtccgtaacccggtctttccgtttaccgtaacgccccttaccctaacccggaaaaccgggtccccgaaaccggttcccgggttacccctttaccccccggttccggtaccccctacccccgtttaccccttacccgaaacgggtaaccggtaccctaaccccggtacggttccggggggaccaaccgtaaccgggccccggggtcccgtcggggccttaccgggtcccgtttacgggtaacccgtaaccgggttacgttaaaccccgtttccgtaacccgtttaccttaaccgtaacccgttaacggtccgggtaccggtccggggtaccgg

SEQ ID NO: 184642 - DNA, 553 bp, Homo sapiens
  misc_feature: GYAE6OF02II1Q3.37.57.F02.1.454.CMB.1.raw
  modified_base (304)..(304): a, c, t, g, unknown or other
  misc_feature (304)..(304): n is a, c, g, or t
  modified_base (369)..(369): a, c, t, g, unknown or other
  misc_feature (369)..(369): n is a, c, g, or t
  modified_base (422)..(422): a, c, t, g, unknown or other
  misc_feature (422)..(422): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccnccagtctccagggaggggctggagtgggtgccaacatacgagggaggtggtggtacgaaaaactntgtggactctgtgcggggccattcaccatctcagacgacaacgccaaaaaccnctactatactcgacaacaggacggaccgtcgagatccgtacggacgacgcgtgtagttgttattgtgngngagtagttaagtactactaaagtttaacgtagtacgtacgtacggtaggtatgtagttacg

SEQ ID NO: 184643 - DNA, 725 bp, Homo sapiens
  misc_feature: GYAE6OF02JW2FZ.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggagtgtccagtgtgaggtgcaattggtggagtcgtgggggaggcctcgtccagccgtggggggtccctgagactctcctgtgtagcctctgtaacttcccctttacggcttattggatggagcgtgggtcccgccgaggcctccgaggggaacggggctgggaggtggggtcggaccaacaagtaaagcaagagtaggaaagtaaggaaggagtagtggtaggactcgtaggtaggaacggggtccgtttacgacctattccgtacgaagaacggtaaccaaaccggaccaaacggtaaaccttcccggtgacctacgtccgtaggacctaaagtacggaaactaggttcctaggaacggaacgaccccgggaagggacccgaacgggttactttaacttttaacgtaaccgttcgggacccgttacggaaggaacgggtaaacgggtacggttacggggtaccgggtttaacgaaacccggttacggggttcccgggggacccggtaaaccggggtaccccgtttcggggtaccccggttaaccccgg

SEQ ID NO: 184644 - DNA, 574 bp, Homo sapiens
  misc_feature: GYAE6OF02G91R9.37.57.F02.1.454.CMB.1.raw
  modified_base (447)..(447): a, c, t, g, unknown or other
  misc_feature (447)..(447): n is a, c, g, or t
  modified_base (463)..(463): a, c, t, g, unknown or other
  misc_feature (463)..(463): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtggggggtccctgagactctcctgtgtagcctctgaactttccccttacggcttattggatgagcgtgggtccgccgaggctccgagggaggggctgggaggtgggtgccaacataaagcaagataggaaagtaagaaggagtatgtggactctgtggaacggtccgtttacaccgtatcctaccagacgaacaacgacccaaagaacctcgancatctgacaatgaacngtcagagagaccgaggaccacggtctatttattactgcgacggaaggaggtaaggacgtacggggtcgtttacgacgtaccggtggggacccacggggtaccctggtaccc

SEQ ID NO: 184645 - DNA, 592 bp, Homo sapiens
  misc_feature: GYAE6OF02GMYYZ.37.57.F02.1.454.CMB.1.raw
  modified_base (348)..(348): a, c, t, g, unknown or other
  misc_feature (348)..(348): n is a, c, g, or t
  modified_base (385)..(385): a, c, t, g, unknown or other
  misc_feature (385)..(385): n is a, c, g, or t
  modified_base (437)..(437): a, c, t, g, unknown or other
  misc_feature (437)..(437): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtggggggtccctgagactctcctgtgtagcctctgaactttcccctttacggcttattggatgagcgtgggtccgccgaggcctccgagggaaggggctgggagtggtgccaanataaagcaagatggaagtaagaaggatatgtggactntgtgaagggtccttacaccatctccagacgacaacgaccaaagaacctccgngcatctgacaaatagaacacgtcagagacgaccggagaccgtacggtcttaatttattacgtgccgagaggacggaacggtacgttcggggacggttttacgaccgttacggtcgggggacccgaacggggtaaccccgtggtacccgtacccgg

SEQ ID NO: 184646 - DNA, 709 bp, Homo sapiens
  misc_feature: GYAE6OF02HMPQR.37.57.F02.1.454.CMB.1.raw
  modified_base (207)..(207): a, c, t, g, unknown or other
  misc_feature (207)..(207): n is a, c, g, or t
  modified_base (337)..(337): a, c, t, g, unknown or other
  misc_feature (337)..(337): n is a, c, g, or t
  modified_base (381)..(381): a, c, t, g, unknown or other
  misc_feature (381)..(381): n is a, c, g, or t
  modified_base (452)..(452): a, c, t, g, unknown or other
  misc_feature (452)..(452): n is a, c, g, or t
  modified_base (561)..(561): a, c, t, g, unknown or other
  misc_feature (561)..(561): n is a, c, g, or t
tcagtagtgtagatcacgaccggtgctcgatttagctcgatatagttgggtttgaggtctcagagaggagcctagccctggactccaaggcctttccacttggtgatcagcactgagcacagacgactcaacatggaattgggctgagcgtgggtttctgttgctatttggaagtgtccagtgtgagcgcaagttggtggacggtgngggggacgcctggtccaggccgtggggggtcccaaggacgaccgtcttcctggtctaaggcccttgacgttaaacgttcccctttaacgggtcctttaagttgggtaacttgaggtacggtcggggtccnccggaacggtcctcccgaaggggaggggactgggaaggtggggngaccgaaatataaaaacggcaaggaactagggaaataaaacgaaggggataccgtgtagggaacccttcgngttaccggaaggggtttacccgttcgtaacccaatttcccattaaacgggaacacggttaaaccaaccaaagggttaaacccttcgggactagaccttaatccggaaanaaactaagaactaagcgtagacgaggaccgagttaaccgacgactaatttaacactggactacggaagaacaaacggggacgttaggacccgggtttagaaccggttacggccggggaaacctaaccgggtacccggtcgggtaaccg

SEQ ID NO: 184647 - DNA, 645 bp, Homo sapiens
  misc_feature: GYAE6OF02H6MC7.37.57.F02.1.454.CMB.1.raw
  modified_base (501)..(501): a, c, t, g, unknown or other
  misc_feature (501)..(501): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgcttattttggaaggtgtccagtgtgaggtgcaatttggtggagtcgtgggggaggcctcgtccagcccgtggggggtccctgagacctctcctgtgtagcctctgaacttccccctttacggcttattggatgagcgtgggtccgccaggctccgaggggaaggggctgggagtgggtcggaccaacaataaagcaaggataggaaagtaaggaaggagtagtgtaggactcgtgtagaaggggtccgtttccacctactcctccgaagaacgaaccgaaccgacccaaacggtaacctccgtagctaactctacgacaaaacgttgaaaccngtcctggaagacggcccgaaggaccgaccggtacttaatttacttaactgcgtacggagaacggaagggtacgttcggggtccggttttacgacgttacggtcggggacccgtacggggtaaccccgttcggtaccgtacccgg

SEQ ID NO: 184648 - DNA, 671 bp, Homo sapiens
  misc_feature: GYAE6OF02FYMI8.37.57.F02.1.454.CMB.1.raw
  modified_base (554)..(554): a, c, t, g, unknown or other
  misc_feature (554)..(554): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtgggggtccctgagactctcctgtgtagcctctgtaactttccccgtttacggcttattggatgagcgtgggtcccgccagggcctccgaggggacggggctgggaggtgggtggaccaaacaagtaaagcaaagataggaaagtaaagaaggagtagtggtggacttcgtgtaggaacggggtcccgtttacaccctagtcctccgaaggaacgaacaaaccgaccaaagaacctcccgtgacatcctagactaaatgaaacagtctaggaaggacgacccggaaggacctacgggtactttaaattttacgttaacgngaccggaggaacggaaggaaacggggtaccgttcgggggttacccggttttacggaaccgttacgggtccgggggacccgtaacgggggtacccccgtttgggacccctaccccggg

SEQ ID NO: 184649 - DNA, 611 bp, Homo sapiens
  misc_feature: GYAE6OF02FRX5Z.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccaggccgtggggggtccctgagactctcctgtgtagcctctgaactttccccttacggcttattggatgagctgggtccgccagggctccgaggggaaggggctgggaggtgggtggccaacaataaagcaagatggaagtaaggaaggagtatgtggactcgtgtaggaacgggtccgttacacctatcctaccagacgacaacgaccgaaagaccgtccgtgacactcgtagactaaatcggaaactagtcgtaggaagacggaccggagaaccgacggtactttaatttattacgtgccgaggagaggaacggtacggtggggtccggtttacgaacgttacggcggggacccgtaacggggacccttcggcctacccgg

SEQ ID NO: 184650 - DNA, 744 bp, Homo sapiens
  misc_feature: GYAE6OF02JGSMF.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgcttattttggaaggtgtccagtgtgaggtgcaattggtggagtcgtgggggagcctcgtccagccgtgggggtccctggagactctccgtgtgtagtccctctgtaactttcccccgtttacggtctttagttgggtatgagtcgtgggtcccgccgacggcctaccggaggggaacggggtctaggggtacggtggggtcggacccaaacgaagtaaaacgacaaaggagtagggaaagtaaaggaagggaagtagtggtaggaccgttagtaggtaggaaacggggtccgttttacaccctaagttcctaccgaagtaacgaaccgaaaccgacctaaagaaaccttccggtacgactacgttcgtacggaacctaaaatcggaaaacctcggttactaggaacggaacggtccccggaagggtaacccgtaccgggtactttaaaggttttaacttaaccgggtcgtaccgggtacgaaggtaacgggaacggggttaacgtcgggggttaccgtttacgaccggttacgggtccgggggaacccgtaacggggtaccccgttgggtaaccccg

SEQ ID NO: 184651 - DNA, 723 bp, Homo sapiens
  misc_feature: GYAE6OF02G38XE.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggagcctcgtccagccgtggggggtccctgagactctcctgtgtagcctctgtaacttcccctttaggcttattggatgagctgggtccgccaggctccgagggagggctggagtgggtggccaacataaagcaaagagtaggaaagtaagaaggagtagtggtaggactcgtgtaggaagggtcccgtttacacctatcctaccgaaggtaacgaacccaaaccggacccgtaaaaggaaacccttcccggtagaccgtaacttcgtacggtaaccaaaagttacggaaaacctacggttaccgtaggaacggaaccggtacccgggtaacggggaaccgtaaccggggtaccttttaaagttttaaccgtttaccgtcgggtaccggaccggtaacgggaacggtaaacggggtaccggttacgggggttaccgggttttacccgaaccgtttaccggggtaccggggggtacccaaccgggggtaacccccgttcgggtaaccccg

SEQ ID NO: 184652 - DNA, 712 bp, Homo sapiens
  misc_feature: GYAE6OF02HBESD.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcttgggttttccttgttgctattttggaggtgtccagtgtgaggtgcaagttggtggagtcgtgggggagcctcgtccagccgtgggggtccctgacgactctcctgtgtagcctctgaactttccccttacggtcttattggatgagtcgtcgggtccgcaggctccggaggggagggcgtgggaggtgggtcgaccgaaacaagtaaacgcgaagagtaggaaagtaaggaaggagtagtggtagacgtcgtggtaggtaacgggtccgtttacacctacgtcccgtacgaaggaacgaaacccgtaaacgaacccgaaacgtaaaccgtcccggtagacctactccgttagaacctaaagtacgaaacctagtcgtaggaacggtacggacccggaaggaccgtaaccgttatttaacttttagttaaccgtggtacccggtaggtaaggaacgggaaacgggtacggttacgggggtacccgttttaccggaacggtttaccggggtacggggtaaccccgtaaccggggtaaccccgttcgggtaccccgtacccg

SEQ ID NO: 184653 - DNA, 611 bp, Homo sapiens
  misc_feature: GYAE6OF02I74F4.37.57.F02.1.454.CMB.1.raw
  modified_base (249)..(249): a, c, t, g, unknown or other
  misc_feature (249)..(249): n is a, c, g, or t
  modified_base (597)..(597): a, c, t, g, unknown or other
  misc_feature (597)..(597): n is a, c, g, or t
  modified_base (603)..(603): a, c, t, g, unknown or other
  misc_feature (603)..(603): n is a, c, g, or t
  modified_base (606)..(606): a, c, t, g, unknown or other
  misc_feature (606)..(606): n is a, c, g, or t
  modified_base (608)..(608): a, c, t, g, unknown or other
  misc_feature (608)..(608): n is a, c, g, or t
  modified_base (610)..(611): a, c, t, g, unknown or other
  misc_feature (610)..(611): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaaggggctgggagtgggtggccaaacataaagcgagatggaagcgagaaatactatgtggacctctgtgaggggccattcaccatctccanagaccaaccgccaaagaaatccaatctttttagcaaaatcgaacacggtcttgaagtagtcggaaggtacgacggccatgtattactgtacgagagacagacgttgggccagggaccctggtccaccgtcgtcctcagccctaccgacccaaggggccccagttcccggtcttcccccgtacggtcccacccgtccctaccctaacgacgccacccgtcgtcgggggccacgacgaccgggccctcggggctccggaccgtcggtacaacggtcctaccttcctatcctacctactactcggacgcggggtaccgtacggccgaaggaccgtccgaagtacgtcgaancgtacncgncngnn

SEQ ID NO: 184654 - DNA, 540 bp, Homo sapiens
  misc_feature: GYAE6OF02FHK02.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaacttttggtagctattggatggactgggtccgccagtctccaggggaaggggctgggagtggggtggccaacatacgaggggaggtggtggtaacgaaaaactgtagtggactctgtggcggggccgattcaccatctcagagacaacgaccaaaactcactgtatctgacaaatcggacggcctagagagtccgaggacgacggctgtgtattattgtgctagagtatttagacttaacgtaagtttcgagttgacgtggtatgtag

SEQ ID NO: 184655 - DNA, 647 bp, Homo sapiens
  misc_feature: GYAE6OF02JJ3L2.37.57.F02.1.454.CMB.1.raw
  modified_base (272)..(272): a, c, t, g, unknown or other
  misc_feature (272)..(272): n is a, c, g, or t
tcagtagtgtagatcacgaccggtgctcgatttagctcgatatagttgggtttgggggttcgttcgagagaggagccttagccctggactccaacggcctttccacttggtgatcagcactgagcacagaggactcaccatggaattggggctgagctggtttccttgttgcttattttggaggtgtccagtgtgaggtgcaattggtggagtcgtgggggaggcctcggtccaggccgttgggggggtccctggagactcgtccgtgtgcngcctcgtggttcattctttagcaactcgccatgagcgtgggtccgccaggcctccggaggggaacgggcctgggaggtcgggctcgaggtattcgtgggtatgggtaacttacccggctaagttactaacggcaaacgccttcccggtacgggacccgggtaccggtttcccgaccggttcctacccgaggacgaaccctaattacccgaaagtaaacgtaccggtacttactacgttcggaaaactgaacctaggtcccagacggacgtccggaagaccgtaccggcccttgtaacgttcgtcgtcgaccgagtacgattcgacgacgggtagtaactacggacgttacgacgtacggccttagtcgtaaccgg

SEQ ID NO: 184656 - DNA, 800 bp, Homo sapiens
  misc_feature: GYAE6OF02GBHHT.37.57.F02.1.454.CMB.1.raw
tcagtagtgtagatcacgaccggtgctcgatttagctcgatatagttgggtttgggggttcgtcagagaggagccttagccctggactccaaggccttccacttggtgatcagcactgagcacagaggactcaccatggaattgggctgagctgggtttccttgttgtctatttggaagtgtccagtgtgaggtgcaattggtggagtctgggggagcgtcgtccagccgtggggggtcctgagactctccgtgtgtacgccttctgtaacttccctttacggtcttagttggatgagtcgtgggtcccgcgacggctccggagggacgggctgggagtgggtcggaccaacaacgtaaagacgaagaagtaggaagtaaaggaaggataagtggtaggactcgtgtaggtaacgggtccgtttacaccgtagttcctacccgtaaggaactaaccgaacccggtaacccaaaacggtaaccgtaccggttaacgaccgtacgtaccgtacggaacctaaaagttacgtaaaaccgtacgtttaccgaacgggtacgaacgggtacccggaacgggaaccgtaaccgggacttttaaacggttttactttaaaccggtcggacccggtacggtaaacgggtaaagggtaacccggggaaaaccgggttccggggggttaaacccggggttttttacgggaaaaccccgtttcccggggggttaaccgggggtaaacccccgggttaaacgggggtaacccccccggggtttacccggtacccccgggtttaacccccggg

SEQ ID NO: 184657 - DNA, 1109 bp, Homo sapiens
  misc_feature: GYAE6OF02JZJNG.37.57.F02.1.454.CMB.1.raw
  modified_base (870)..(870): a, c, t, g, unknown or other
  misc_feature (870)..(870): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggtttcctgttgctatttggaaggtgtccagtgtgaggtgcaattggtggagtctgggggaggcctcgtccagccgtgggggtccctgagactcgtctgtgtagcctcgtgtaattccccgtttacggctttagttggactggagtccgtgggtcccgtccgaacggccgttacccggaagggggtaaacggggccgttgggggaacgggttcgggggttacgggaccccgtaaaacggtaaacgtttaaaaacgggaccgaaaacggggtaacgttaaacgggggtaaaacgggtttaaaaacggggaaaaacgggggtaaagggtttaaccggtttaaggggtttaacgggggtaaaacccgtttcccgggttttaagggggttaaaccggggttaaaaaccgggggggtttaccccccggtttttttaaccggaaaccccccgtttaaacggttttaccccggtaaccccggttaaaggggtaaaacccggaaaccccgttaaaaacccggggtaacccccaaaaaagggggtaaaaccccccttttccccggggttaagggaacccttaaacgtttacccgtttaacggggaaacccgttaaaaaactttaccggggtaaaaaccaacgggtttttaccccggtaaagggttaaacgggaacgggttaaaccccccgggtaaagggggtaaccccgttaaaccccggggttnttttttaaaaacggttttttaaacccgtttaacccggttacggggaaccccgggtttaccgggaaaagggtttaaaccggggaaaacccggggtttcccgtttaaacggggggggttccccgggttttttaaaccccggaacggttttaacccgggggtacccgggggggtaacccccgtaaaaccggggggtttaaacccccccggtttcgggttaccccccggtttaaccccccggg

SEQ ID NO: 184658 - DNA, 570 bp, Homo sapiens
  misc_feature: GYAE6OF02GEIS1.37.57.F02.1.454.CMB.1.raw
  modified_base (358)..(358): a, c, t, g, unknown or other
  misc_feature (358)..(358): n is a, c, g, or t
  modified_base (445)..(445): a, c, t, g, unknown or other
  misc_feature (445)..(445): n is a, c, g, or t
  modified_base (453)..(453): a, c, t, g, unknown or other
  misc_feature (453)..(453): n is a, c, g, or t
  modified_base (470)..(470): a, c, t, g, unknown or other
  misc_feature (470)..(470): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagcctggggggtccctgagactctcctgtgtagcctctgaactttccccctttacggcttattggatgagtctgggtccgccaggctccgaggggaaggggctggagtgggtggccaacataaagcaagntaggaagtaagaaagggagtatgtaggactcgtggtgaacgggtccgtttacaccatcctccagacacaacgccaaagaacctccgngactatcngacaaatcgaacagtcngagacgccgacggacgacgtcttaatttagtactagcgcggaagaggaaggcgtgggtccggttagacgtacggtcggggccacggggaccctggtaccc

SEQ ID NO: 184659 - DNA, 542 bp, Homo sapiens
  misc_feature: GYAE6OF02GUP7T.37.57.F02.1.454.CMB.1.raw
  modified_base (402)..(402): a, c, t, g, unknown or other
  misc_feature (402)..(402): n is a, c, g, or t
  modified_base (442)..(442): a, c, t, g, unknown or other
  misc_feature (442)..(442): n is a, c, g, or t
  modified_base (501)..(501): a, c, t, g, unknown or other
  misc_feature (501)..(501): n is a, c, g, or t
  modified_base (525)..(525): a, c, t, g, unknown or other
  misc_feature (525)..(525): n is a, c, g, or t
  modified_base (529)..(529): a, c, t, g, unknown or other
  misc_feature (529)..(529): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (540)..(542): a, c, t, g, unknown or other
  misc_feature (540)..(542): n is a, c, g, or t
tcagtagtgtagatcacgaccggtgctcgatttagctcgatatagttggggtttggggggtccctgagactctcctgtgtagcctctgaattcccctttacggcttattggatgagctgggtccgccaggctccagggaaggggctggagtgggtggccaacataaaagcaagatggaagtaagaaggagtatgtggactctgtgaagggccgtttcaccatctccagagacaacgccaaagaactccgtgcatctgacaaaatgaacagtctgagagccgaggacacggctatttattactgcgcgagagaaggacgtgggcggtttcgactacgtggggccagggaaccctggtcaccgtctcctcagcctccaccgaagggcccatcggtcttcccccnggccgccctgctccgaggacgccacctccgagacgcaacnggccggccctgggctcgccgtgtacaggtacctactccatctacactactgacggcggntcggacgaggtcgacctagtacgntagnagcanancgannn

SEQ ID NO: 184660 - DNA, 663 bp, Homo sapiens
  misc_feature: GYAE6OF02HENJZ.37.57.F02.1.454.CMB.1.raw
  modified_base (656)..(656): a, c, t, g, unknown or other
  misc_feature (656)..(656): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaaggggctggagtgggtggcccaaacataaagcaagatggaagtaagaaggagtatgtggactctgtaggaagggcctttcacatctccagagacaacgccaagaacctccgtgctatctagacaaatgaacagtctagagacgacgagacacggtacttatttatactgcacgagagaaggcgtgggtcgtttacgactacggtcgggaccgaacgggacctggtacctaccgtctaccgtcacgtccctaccgaacgacggccctagtcccgtccctccccgtcgccgccctcgccgtccgaacgacgacccacccgtaccgaagacgaccgaccgacggcccggtacccgtcggccgtaccggtacccgtacgggtaccgaacggttacccttaacctacccgtaacgtacctaacccgtacgttaaccgtacgggtaacggtaccgggtaccggtaccgggaaccgaacgggtacccgtacgtaacggtaacgngtacgca

SEQ ID NO: 184661 - DNA, 673 bp, Homo sapiens
  misc_feature: GYAE6OF02JCU1X.37.57.F02.1.454.CMB.1.raw
  modified_base (264)..(264): a, c, t, g, unknown or other
  misc_feature (264)..(264): n is a, c, g, or t
  modified_base (344)..(344): a, c, t, g, unknown or other
  misc_feature (344)..(344): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattgggctgagctgggtttccttgttgcttatttggaaggtgtccagtgtgaggtgcaattggtggagtcgtgggggagcctcgtccagccgtggggggtccctggagactctcctgtgtagcctntgtaacttccccgtttacggcttattggatgagctggtccgcgagctccgagggacgggctgggagtggggtcggccaanagtaaagcaagagtaggaagtaaaggaaggtagtagtggtaggtaactcgtaggttaggaacgggttcccgttttacgacctagtccttaaccgaggtaacgaaccgaaccggaccaaacggtaacctccggtagactagtcctagactaaacgtgaactagtcgtaggaagtcggaccgaaggacgtaccgggtattaacgtttaacgttacctgggaccgtacggtacgggaaaggtaaccggtaggtacggggtttaccggtttaccggtaaccgttaacgggtccgggggacctaaccgggggtacccgttcgggttaaccccgg

SEQ ID NO: 184662 - DNA, 854 bp, Homo sapiens
  misc_feature: GYAE6OF02JZJW3.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggtttccttgttgctattttggaaggtgtccagtgtgaggtgcaattggtggagtcgtgggggagccgtcgtccaggccgtggggggtccctggacgtactctccgtggtgtacggcccttcgtagtaaactttcccccgtttacggtctttagttggtatgtacggtcgttggggttcccgcccgtaaggggcccttaccccggaaggggggtaaacgggggtccgttagggggtaacgggttcggggggttacgggaccccgaaaaccggtaagttaaaaacgggccgtaaaaagggtaacgttaaggggtaaaaggttaaaacggggaaaggggtaagtttaaggttacgggtacgggtaacttcggttagggttagggtaaaccggggttcccgttttaacgacccgtaacttccgtaacccgaaagggtaacgaaacccgtaacccgggaacctaaaacggaaaccgtttcccggagaccctaagttacgtacgaaccgtaaaacgtacgaaacctaaggttccgtaaggaacgggtaacgacccgggtaacggaaccgtaaaccgttcttaaacgttttaaactacggtcgaccgggtacggtaaggtaaggaaaccggtggttacgggggttaccgtttacggtaaccgtcgggaccggggtacccaacgggggtaaccccttgggtaaccccg

SEQ ID NO: 184663 - DNA, 719 bp, Homo sapiens
  misc_feature: GYAE6OF02IXLPR.37.57.F02.1.454.CMB.1.raw
  modified_base (504)..(504): a, c, t, g, unknown or other
  misc_feature (504)..(504): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattgggctgagcttgggttttccttgttgctattttggaaggtgtccagtgtgaggtgcaattggtggagtcgtgggggaggcctcgtccagccgtgggggtccctggagactctcctgtgtagcctcgtgtaacttcccctttacggctttagttggatggagtcgtgggtcccgccgaggcctccgaggggaagggctgggagtgggtcggaccaaacgaagtaaaggcgaaagagtaggaaagtaaggaaaggtagtatggtaggactcgtaggtaggaaacggggtcccgtttacgaacctacgttccgtacccgaaaggaacgaaaccaaccgggacccaaaagggaaccttccgggtanaccgtaactttcgacggtaacctaaagtccggaaactacgtacgtaaggaacgacggtacccggaaggacctaccgggtattaattttaacgtaccgtgacccggacggtaagacggtaaacgggtacgtcgggggttaccggtttaaccgacggtttaccgggtcggggaaccccgtaacggggtaaccccgtttgggaaccccgttaccccgg

SEQ ID NO: 184664 - DNA, 589 bp, Homo sapiens
  misc_feature: GYAE6OF02FL3L6.37.57.F02.1.454.CMB.1.raw
  modified_base (579)..(579): a, c, t, g, unknown or other
  misc_feature (579)..(579): n is a, c, g, or t
  modified_base (581)..(582): a, c, t, g, unknown or other
  misc_feature (581)..(582): n is a, c, g, or t
  modified_base (586)..(586): a, c, t, g, unknown or other
  misc_feature (586)..(586): n is a, c, g, or t
tcagtagtgtagatcacgaccggtgctcgatttagctcgatatagttgggtttggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagactccgtgcatctgcaaatgaacagtctgagagccgaggacacggctatttattactgcgcgagagaaggactgggcggtttcgacgtacgtggggccagggaaccctggtcaccgtctcctcacgcctcaccaagggcccatccggtcttccccgtggccgccctgctccaggacgtccaccgtccgagacgccaacacggccggccccgtggggcctcggcccgtgggtacaaacggtacctaccgttccaatccgtaaccaaccttaccgttggaacggccggggtcgttacggggaccctaagggcccgacgtaacgtacggtcgaatcgagacgnannacanagc

SEQ ID NO: 184665 - DNA, 700 bp, Homo sapiens
  misc_feature: GYAE6OF02JO9L8.37.57.F02.1.454.CMB.1.raw
  modified_base (495)..(495): a, c, t, g, unknown or other
  misc_feature (495)..(495): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggtttccttgttgcttattttggaaggtgtccagtgtgaggtgcaattgggtggagtcgtgggggaggccgtcgtccagccgtggggggtccctgagactctcctgtgtacgcctctgtaacttccccttaaggcttagttggatgacgtcgtcggggtccgaccagggcctcggaaggggtacgggctggaggtgggtacggaccaagactaaagcaaaggagtaggaaagtaaggaagggtaagtagtacggtggaacttgtaggtagaacgggtccgtttacgactacgtcttaccgaaaggtaccaacgaaaccgccgtaaaacggtacctaccggngaccaattcgtacgaaccaaatacgggaaaacctgtacgagaacgtcgacccggaggaaccacgggttacttaacgtttacttacggtacgaccggacgaaggtaaccggaacgggttacggtacggggttacccggttacgtaacggtacgggtaaccggggccggttaaaccggggtacccgttacgggtaccctaaacccgg

SEQ ID NO: 184666 - DNA, 604 bp, Homo sapiens
  misc_feature: GYAE6OF02J1GN4.37.57.F02.1.454.CMB.1.raw
  modified_base (310)..(310): a, c, t, g, unknown or other
  misc_feature (310)..(310): n is a, c, g, or t
  modified_base (410)..(410): a, c, t, g, unknown or other
  misc_feature (410)..(410): n is a, c, g, or t
  modified_base (418)..(418): a, c, t, g, unknown or other
  misc_feature (418)..(418): n is a, c, g, or t
  modified_base (433)..(433): a, c, t, g, unknown or other
  misc_feature (433)..(433): n is a, c, g, or t
  modified_base (441)..(441): a, c, t, g, unknown or other
  misc_feature (441)..(441): n is a, c, g, or t
  modified_base (463)..(463): a, c, t, g, unknown or other
  misc_feature (463)..(463): n is a, c, g, or t
tcagtagtgtagatcacgaccggtgctcgatttagctcgatatagttgggtttgaggtctcagagaggagccttagcccctggactccaaggcctttccacttggtgatcagcactgagcacagaggactcaccatggaattgggctgagctgggtttccttgtgctatttggaaggtgtccagtgtgaggtgcattggtggagtcgtgggggaggcctcgtccaggccgtgggggtccctgagactctccgtgtgtacgcctctgtaacttcccctttacggtcttagttggatgagcgtcggtccgcnggctccgagggaagggctggaggtggtcggccaatagtaaagacaagagtaggaagtaaggaaggagtagtgtggactgtggaggacgggtccttcaccntctccganacgaccaacgcaaanaccgtcgnacagtcctgaacaatcgaaacngttcagacgacgaccgaaggacgtaccggtacttagtttaacgtacctaggccgtaggtacgtaagggaacggtccggtacggggttaccgtttcggaacgttacgggcgggtaccggaaccgggtaccgtcggtaacccg

SEQ ID NO: 184667 - DNA, 911 bp, Homo sapiens
  misc_feature: GYAE6OF02H142D.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacaggaggactcaccagtaggaagttggggctggagcgtttggggtttttccttggttgtctttagttttgggaaggttgtcctaggttggtggagggtgacgtaagtttgggtggaggtcggtggggggacggtcccttcgtaccacggtcccgggttcgggggggtccctggacgtacctcctccgtgtgtacgcccttctaggtaacctttcccccgtttacggtctttagtggtatggacgtcgtggggtcccgacgacggtcctaccggaaggggggaacggggcgtaggggtagggttcgggggtcggaaccccgaaaacgaaagtaaaaggaccgaaaaggaaggtaaggggtaaaaggtaaagggaaagggtaagttaagtgggtacggtacttcgtgggtacgggtaacggggttcccgtttacgaaccctaacgttccctaccggaaggtaacggaaacccgaacccgggtaacccaaaacggtaacccgttcccggacgaaccttacgttccgtacgaaactaaaagtacggtaaactacggttaccgtagggaaccggtaacggacccgggtaaaggaacccggtaccggttaactttttaaacgttttaaacgtaccggtacgggacccggtaacggaaaggggtaacgggtaaacgggttaccgggttcgggggggtttaacccggttttaaccggaacccgggttaccgggggttaccggggggaccccgaaacccgggggtttaaccccgttccggggtacccgttaacccccgg

SEQ ID NO: 184668 - DNA, 760 bp, Homo sapiens
  misc_feature: GYAE6OF02G9ZK4.37.57.F02.1.454.CMB.1.raw
  modified_base (375)..(375): a, c, t, g, unknown or other
  misc_feature (375)..(375): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatgaattggggctgagcttgggttttcctgttgtcttatttggaaggtgtccagtgtgaggtgcaagttggtggagtcgtgggggaggcctcggtccaggccgtgggggggtcccttggacgtactcctccgtggtacgtacgtccctcgtagtaactttcccccgtttacggtctttacgttggagttcgtagtcgtcggggtacccgccgacggtcctacccggaagggggaacggggtntcggggtaggtcggggtacggacccgtaaacaagttaaacggacgaaaggtaacggtagggtaaaaggttaaagggaaaagggtgttaaacggtcggtagggtaacccttggttagggtaggggtaaacggggtcccgtttaccaaccgttacgtccttacccgaaaggaccgaaaccgtaaaccgacccggtaaagtaaacccgttcccggaagccctaattccggtaacgacgtaaaaagtccgaaatacggtcctaggaccgacgccggtaagaccgtagtacttatttactagtcgacggacgaaggaacgggaacgtccgggtagggtcccgtttaggacctacgggccgggtaccggaacggtaccccgtgttaccccg

SEQ ID NO: 184669 - DNA, 733 bp, Homo sapiens
  misc_feature: GYAE6OF02F8BU2.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtggggggtccctgagactctcctggtgtacgcctctgaacttccccttacggcttattggatgagcgtgggtccgccaggcctccgaggggaaggggctggggaggtggggtcggacccaaacgagtacggcggaggcggaacgggaagtggaaggaagtaaattagtggtaggtactcgtggtacggaacggggtccgtattaccgacctattcccgtaccgaagtacgaaaccctaaaccgtacccgaaaaggtaaccctcgaaggttacgtaacttaccgttaaacaacctaagtaccgtaaaacctaaaccggtttaggaaacggttacgggaaaccggtacgtaccgggttactttaacgttttaaaggttaaccgtaagggttaaacggaaacgggtccctaaacggttaggtacgggtaacggtttccggacgggggtacccggaacggggtaccctaccgggtaccctaccccggttcctaccccgtaccg

SEQ ID NO: 184670 - DNA, 676 bp, Homo sapiens
  misc_feature: GYAE6OF02HVPRN.37.57.F02.1.454.CMB.1.raw
  modified_base (670)..(670): a, c, t, g, unknown or other
  misc_feature (670)..(670): n is a, c, g, or t
  modified_base (672)..(672): a, c, t, g, unknown or other
  misc_feature (672)..(672): n is a, c, g, or t
tcagtagtgtagatcacgaccggtgctcgatttagctcgatatagttgggtctgggggaggcctcgtccagcctgggggggtccccgagactctcctgtgtagcctctgaattcccctttacggcttattggatgagctgggtcgccaggctccagggaaggggctggagtgggtggccaacataaagcaagatggaagtaagaaggagtatgtggactctgtgaagggccgtttcaccatctccagagacaacgccaagaactccgtgcatctgacaaatgaacagtctgagagccgaggacacggcttatttattactgcgcgagagaaggctggggcgtttcgactagtcggggaccacgggaaccctggtacaccgtctccctcacgtccctaccgacccgaacgggcccccaagttcccggttaccctttcccccgtcggcccgccccgttcggcccttccggaacgggtacgaccctaccccgtaccggacggaacgacccaacgaccggcccgggaccccgttcggggcctcggtcccgtaggggtacccaaggggtaacccttacctttcccgaaacttcccgttaacctacgttaccgtacggacgggtcccgggtaccgtacggggaacccacggggtccgactaacggttaggactacngntacg

SEQ ID NO: 184671 - DNA, 892 bp, Homo sapiens
  misc_feature: GYAE6OF02GIDLR.37.57.F02.1.454.CMB.1.raw
  modified_base (396)..(396): a, c, t, g, unknown or other
  misc_feature (396)..(396): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggacctcaccagtggaagttggggctgagtcgtttcgggttttccttggttgtctttagtttttagggaaggttcgtacctaggttggtggagggttcgactaagtttggggtggtacggttccgggtaggggggacgtcccgtccgtccgacggtcccgggttacggggggtcccctaggacgtaccttccgtccgttggttcgtacgtcccttcgtacgtaacctttccccgtttacggtcttttagtggtatgagtcggtcgggtcccnccgacggtcctaccggaagggggacgggtcgtaggggtagggttggggtaccggacccaaagtaaacgttaaaacggaccgaaaggtaaggtaagggtaaaaggtaaaggaaaggggtaagttaggtacgggtacggtaccgttaggttacgggtaacggggaaaccggggtttccccttttaccaaacccgttacttacccggtaacgaaacggtaacgaaaacccgaacccggaaacccgtaaaaccgtaacccggttccccggtaggacccttaacgttcccgtaaggtaaacccttaaaaggtaccgtaaaccgttacggtttccgaaggggaacgtacccgggtaccggaacggtaaccgtacgggttactttaagtttaactacggtacggcggtaacggaaggtaacggtaacggtcgggttacggggttaccgtttcggaacgttcgggaccggggtacccgtaaccggggtaccctcggggtacccc

SEQ ID NO: 184672 - DNA, 561 bp, Homo sapiens
  misc_feature: GYAE6OF02G6M5P.37.57.F02.1.454.CMB.1.raw
  modified_base (551)..(554): a, c, t, g, unknown or other
  misc_feature (551)..(554): n is a, c, g, or t
  modified_base (556)..(561): a, c, t, g, unknown or other
  misc_feature (556)..(561): n is a, c, g, or t
tcagtagtgtagatcacgaccggtgctcgatttagctcgatatagttgggtctgggggaggcctcgtccagcctggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgacaaatgaacagtctgagagccgaggacacggctatttattactgcgcgagagaaggactgggcgtttcgactacgtggggccagggaaccctggtccaccgtctcctcagccctccaccgaacgggcccagtccggtccttcccccgtggccgtccctcgccctccgacggacgaccacccgtccgagacgacaccgacgccggcccgtgggcctcgtccgtggtacgaacggacgtggacggcgggcgtcgggacgaagggccgacgacgtgcnnnncnnnnnn

SEQ ID NO: 184673 - DNA, 582 bp, Homo sapiens
  misc_feature: GYAE6OF02G0D38.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcgtggtttccttgttgctatttggaaggtgtccagtgtgaggtgcaattggtggagtcgtgggggaggcctcgtccagccgtggggggtccctgagactctcctgtgtagcctctgaacttcccctttacggcttattggatgagcgtgggtccgccaggcctccgaggggaaggggctgggaggtgggtcggaccaacgagtaaagcaagagtaggaaagtaaggaaggagtagtgtaggactcgtggtaggaacggggtccgtttacaccatcctacagacgacaacgccaaagacctccgtgccatcgcgacaaagtcgaaacagcctgaagacggtacgagaccgtacggtcttaatacttactgtagtaggaacggtcctcgtacgtacccttagacgcaggcgtcgtcggtccttggtacttcgg

SEQ ID NO: 184674 - DNA, 780 bp, Homo sapiens
  misc_feature: GYAE6OF02H0RXB.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaattgggctgagctggtttctgtgctatttggaaggtgtcagtgtgagtgcaattgggtggaggtcgtgggggacggcctcgtccgaggccgtggggggtccctggacgtacctctcctgttgtacgcctctgaactttccccgttaggtcttatggatggagtcgtcgggtccgccgaggcctaccgaagggggaacgggcgttggaggttcggggtgacccgtaaagaagtaaaggcgaaagtagtaggaaagtaagaaggaggtatggtggactcgtggtaggtaacgggtccgtttacaacccgtattccgtacccgaaggaaccgtaacgaaacccgaccgtaaaaagtaaaccccgttcccgggtaggtaacctacgtttacccgtaacggtaactaaaaacgttacgaaaccgtaaccgggttcgttaaagggaaacggccgggaaacccgggtaagggaaccctaacggggtaacttttaacgttttaaacttaaccgggtgggacccggtacgggtaaggaaaacggggtacgggtacccgggtttcgggggtacccgggttttaaccgaacgggtttaccgggacccggggggtaacccttaaccggggggtaccccttcgggtaacccccgg

SEQ ID NO: 184675 - DNA, 560 bp, Homo sapiens
  misc_feature: GYAE6OF02FZ1WH.37.57.F02.1.454.CMB.1.raw
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
  modified_base (473)..(473): a, c, t, g, unknown or other
  misc_feature (473)..(473): n is a, c, g, or t
  modified_base (483)..(483): a, c, t, g, unknown or other
  misc_feature (483)..(483): n is a, c, g, or t
  modified_base (524)..(524): a, c, t, g, unknown or other
  misc_feature (524)..(524): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcacccatggaattggggctgagctgggtttttccttgttgctattttggaaggtgtccagtgtgaggtgcaattggtggagtcgtgggggaggcctcgtccagccgtggggggtccctgagactctcctgtgtagcctctgaacttcccctttacggcttattggatgagctgggtccgccaggctccgagggaagggctgggagtgggtggccaacaataaagcaaagatggaagtaagaaggagtatgtgactctggtgaagggtccgttcacatctcagagacaacgccaagactccgngcatcngacaaatgaactagtctagagagccgagacacggnttattattcngcgcgagaggaaggacgtggggtcggtttacgacgttacgngggggacccacggggtaacccctggtacctacccgg

SEQ ID NO: 184676 - DNA, 852 bp, Homo sapiens
  misc_feature: GYAE6OF02GZG5M.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaagttggggctgagcttgggtttttccttgttgcttattttggaaggtgtccagtgtgaggtgcaattggtggagtcgtgggggagcctcgtccagccggtgggggtccctgacgtacctctccgtgtgtacgcctctagtacctttccccgtttacggtctttagttggattggagtcgttcgggtcccgccgaggtccgtaccggaagggggaacggggtcgtagggagggttggggtcggacccgaaacgaaagtaaacggacgaaagtagtaaggggtaaaagtaaagggaaaggtaagttaagtaggttacggacttcgttagggtaaggtaaacggggttcccgtttacaacccgtattccgtaccgaaggaacggaaaccaaccggacctaaaacggtaacctccggtagacctagttccgtacgaaccaaagttacgaacgtaacggtcgtaacggacggtaaccgggacccggtaaagggaacccgtaaccgggttactttttaaacgttttaaaccgtttaacgggcggtaacccgggacggtaaacgggtaacggggtaaaccggggtaccgggttttaccggggggttcccggtttttaacccggtaaccggggttttacccgggggtaccggggggtaaccccggtaaacccggggggtttaaccccccggtttacggggttacccccgttaacccccggg

SEQ ID NO: 184677 - DNA, 722 bp, Homo sapiens
  misc_feature: GYAE6OF02HLEKU.37.57.F02.1.454.CMB.1.raw
  modified_base (373)..(373): a, c, t, g, unknown or other
  misc_feature (373)..(373): n is a, c, g, or t
  modified_base (390)..(390): a, c, t, g, unknown or other
  misc_feature (390)..(390): n is a, c, g, or t
tcagtagtgtagatcacgaccggtgctcgatttagctcgatatagttgggtttgggggtcgtcgagagaggagccttagccctggactccaaggcctttccacttggtgatcagcactgagcacagaggactcaccatggaattggggctgagctgggtttcctgttgctattttggaaggtgtccagtgtgaggtgcaagttggtggagtcgtggggagccgtgtccagccgtgggggtaccctggacgctcgtccgtagtggtacgccttgtacgtactttacccccgtttaggcctttattcggatcggagcgtgggtacccgcacggctccgagggaggctggagtgggtgccaagataaagcaagtanaggaaagtaaggaaagngtaactggtggaaactcgtgaggtaaaggggtccgtttacacgtacgtctacgaagtacgaaaccgtacgacccaaagtaaacctccgggtagcctaagtccgttaggaaccaaaattcgggtaaacacgtttacggagaacgggaccgcccgggaagaacccggaacgttcgttaaacttacttttaaacgcggaacccgtgggtaaaaggtcggaaaaacgggttcgttacgggggggttaccgtttaacccggaaccggtttacggggtaaccggggaccccgggtaacggggttaaaccccccgtggggttaccctaacccccggggg

SEQ ID NO: 184678 - DNA, 813 bp, Homo sapiens
  misc_feature: GYAE6OF02IEWOV.37.57.F02.1.454.CMB.1.raw
tcagtagtgtagatcacgaccggtgctcgatttagctcgatatagttgggtttggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcacatctccagagacaattccaagaacacactgtctctgactaaatcgaacagcctagagacgtcgaggacaccggtccttaagtattacgtgtagtaggaacggtcctacgtacggtaccccttagtacgccgaggtccggtcgttcggtaccgttggttaaccttttcgggaccgtacggtccgggtaccgaaccggggtaaaccccgttggtacccgtacccgttcctacccgtccgaacgtcccctacccgtaacccggaaccgggcccctaacggttcccggttacccctttccccccggtcgggtacccccgtccccgttacggtaccccgtaccggaaccgggtaccgtaccccgtaaccgttacccgggaacggaccgttacccgaaccggtaccgggcccgggttccccgggtcgggtccgttcccgggaccccggtttcggggtaaacccgtaaacccgggtcccgttttaacccgttacccgaacctttaccctaaccggtaccctttaccgggtcggtaaccgggtcccggggtacggttacccgggacggttaacgggcccggtacgttacggtacgtagcctagg

SEQ ID NO: 184679 - DNA, 722 bp, Homo sapiens
  misc_feature: GYAE6OF02JS1UP.37.57.F02.1.454.CMB.1.raw
  modified_base (125)..(125): a, c, t, g, unknown or other
  misc_feature (125)..(125): n is a, c, g, or t
  modified_base (162)..(162): a, c, t, g, unknown or other
  misc_feature (162)..(162): n is a, c, g, or t
  modified_base (271)..(271): a, c, t, g, unknown or other
  misc_feature (271)..(271): n is a, c, g, or t
  modified_base (292)..(292): a, c, t, g, unknown or other
  misc_feature (292)..(292): n is a, c, g, or t
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
  modified_base (687)..(687): a, c, t, g, unknown or other
  misc_feature (687)..(687): n is a, c, g, or t
  modified_base (720)..(720): a, c, t, g, unknown or other
  misc_feature (720)..(720): n is a, c, g, or t
tcagtagtgtagatcacgaccggtgctcgatttagctcgatatagttgggtttgggggtcccgtgagactctcctgtgtagcctctgaacttcccctttacggcttattggatgagctgggtccnccaggctcgaagggaagggctggagtgggtggccaanataaagcaagatagggaagtaaagaaggagtagtggtacggacttcgtggtgaaaggggtccctttcaaccctatctaccagagacaacggaccaaaggtacctccgtnctatcctagcaaaatgaaacngtctggaagagccgaggtacacggtctatttatacngacgngaacgaggaaggtcgaggtccggtttacgaccttaggtcgggaccgaacgggtacccgtaggtccaccggttcaccgtacgacccgtcccttacgacccgaacgggcccctaacggtccggttacccttcccccggtacgcccgtaacccgtcgaccgttcccgacggaccgtaccgacccgtccggacgacgtaccacgaccggaccggcccgtaccgggccgtaccggcccgttaccggtaccgtaacggtaccttacccgttaccgtacctaccgttacccgacgttaccgtcggtaaccggtccgggtaccgtacggggaccgtaccgggacggaccgtaacggttacgnggacctacgtactcgacgcgactacgtaccgtncg

SEQ ID NO: 184680 - DNA, 729 bp, Homo sapiens
  misc_feature: GYAE6OF02GV7WC.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattgggctgagctgggttttccttgttgctattttggaaggtgtccagtgtgaggtgcaagttggtggagtcgtgggggagcctcgtccagccgtgggggtccctggacgactctcctgtgtacgcctctgaactttcccctttaggcttattggatgagcgtgggtccgccgaggctccgagggagggctgggagtgggtcggaccaacgataaagcaagagtggaaagtaagaaggatagtggtaggactgtaggtacggaacgggtcccgtttacgacctaagttccgtaccgaaggtaacgaaaccgtaaccgacccgtaaaagtaaacccgttcccggtagaccacgttccgtacggaactaaaagttcggaaacgtacggttagaggtaaacggaccgggtacccgaagggtaaccgtaaccgggttactttaaagtttttaccgttaacgtcgggtaccgtacgggaaggaacgggtaaccgggtacggttacgggggttacccggttttacggaacccgtttaccgggtccgggggacccgttaacccgggggaccccgtttacgggaccccttaaccccgg

SEQ ID NO: 184681 - DNA, 542 bp, Homo sapiens
  misc_feature: GYAE6OF02F8KXQ.37.57.F02.1.454.CMB.1.raw
  modified_base (305)..(305): a, c, t, g, unknown or other
  misc_feature (305)..(305): n is a, c, g, or t
  modified_base (338)..(338): a, c, t, g, unknown or other
  misc_feature (338)..(338): n is a, c, g, or t
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctgggggggtccctgagactctcctgtgtagcctctgaattcccctttacggcttattggatgagctgggtccncaggctcagggagggctggagtgggtggccaanataaagcaagatggaagtaagaaggagtatggtaggactcgtgtgaagggtcccgtttcaccatctccagacgacaacgccaaagaactccgtgcatctgacaaatgaacagtctagagagccgagacacggcttattatacngngcgagaggaaggacgtgggtcgtttcgacgtacgtggggccagggaccctggcctaccg

SEQ ID NO: 184682 - DNA, 656 bp, Homo sapiens
  misc_feature: GYAE6OF02IG3HS.37.57.F02.1.454.CMB.1.raw
  modified_base (461)..(461): a, c, t, g, unknown or other
  misc_feature (461)..(461): n is a, c, g, or t
  modified_base (512)..(512): a, c, t, g, unknown or other
  misc_feature (512)..(512): n is a, c, g, or t
  modified_base (518)..(518): a, c, t, g, unknown or other
  misc_feature (518)..(518): n is a, c, g, or t
  modified_base (565)..(565): a, c, t, g, unknown or other
  misc_feature (565)..(565): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcttgggttttccttgttgcttagttttggaaggtgtccagtgtgaggtgctaatttggtggagtcggtgggggaggccgtcgtccgaggccggttcggggggtccctggacgacgtcttccgtgtgtacgcctctagtaacctttccccgtttacggtctttagttggattgacggtcgtcgggtcccgcgaggccgtccggaggggaacggggctgggaggtgggtcgaccaagaataaagcaaagagtaaggaaagtaaggaaggaggtagtggtaggactcgtgtaaggacggttccgttcaacgtntcacgagacgaaccaacgacgaaataaccgtccgtgcatctacgactaaancgaaangtacagaacgacggaccgaggactacggtacttaagtttacgtacgngtaccgaggagaagggaaggtcggtgggttaccggtttagaccggttacggacggggccggaaaccgggtacccgtcggtcccgtacccgg

SEQ ID NO: 184683 - DNA, 1058 bp, Homo sapiens
  misc_feature: GYAE6OF02H0RN5.37.57.F02.1.454.CMB.1.raw
  modified_base (910)..(910): a, c, t, g, unknown or other
  misc_feature (910)..(910): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattgggctgagtcgttgggtttttccttgttgtcttagttttggaaggttgtccagtgtgaggtgcaagttggtggagtcggtgggggacggtccgtcggtccgacggtcccgggttcgggggggttcccctaggacggtaccgttccgttccgttggttcgttacgtcccgttcgttacggttaaacccttttcccccggttttaacggtacctttttaaggtttacgggaacgtttcgggaacggttcccgggtttaccgggggttccccgacccggtaaccgggtccccgttaccgggaacgggggggtaaacgggggtccgttagggggtacgggttcgggggttaccgggaaccccgtaaaacgtaaaacggttaaaaacggaccgtaaaagggtaaggttaagggggtaaaaaaggttaaacgggaaaaaggggttaaggttaaggtttaggggtaacgggttaacctttacgggtttagggtaaacgggttaacccgggggttccccggttttaaccggacccgtttacgttacccgtaaccgaaagggtaaacccggaaaacccgtaaaaccccggaacccgtaaaaaccggttacccgttcccggggtaagaccgttaacgttaccggtaacgaaaacttaaaaacggtccggtaaaacgttcggttaccggaaagggaacggtaaacccgggacccgggtaaaggtaaaccccggtaaaccgggttttaactttttaaacgtttaaacggtttaaacccgnggggaacccggtaacgggtaaaggtaaacggggtaccgggttaaccggttgggggtttaaccccggttaacggtaccggtttaaccggggacccgggggtaacccgaaaacccgggggtttaccctccggggttaccctaaccccggg

SEQ ID NO: 184684 - DNA, 739 bp, Homo sapiens
  misc_feature: GYAE6OF02IAT1Q.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaagttggggctgagctgggttttccttgttgctattttggaaggtgtccagtgtgaggtgcaattggtggagtcgtgggggagcctcgtccagccgtgggggtccctgagactctcctgtgtacgcctctgtaactttccccgttacggtctttagttggatggagcgttcgggtccgccgacgggccttcccggaagggggaacggggcgtaggaggtgggtcggaccaaacaagtaaagcaaagagtaggaaagtaaaggaaggtaaggtagtggtaggtactacgtggtagaacggggttccctttaccgaaccgtacttccgtaccgaaagggaacgaaccgaaacccgaccgaaacgtaaacctcccggtagaccgtattaccgttagaactaaagtacgtaaacctacgttagaggaacggaaccggaccgggaacggaaccgtacgggttacttttaaggttttactaaccgtcggacgtacggtaaggaacgggaacgggtaaccggtcggggttcccggttttacggaaccgtttacggggtacggggacccggtaaccggggtaaccccggttcggtaccccgttaccccg

SEQ ID NO: 184685 - DNA, 594 bp, Homo sapiens
  misc_feature: GYAE6OF02HLF2H.37.57.F02.1.454.CMB.1.raw
tcagtagtgtagatcacgaccggtgctcgatttagctcgatatagttgggtctgggggaggcctcgtccagcctgggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgcaagaactcattgatctgacaaatgaacagactgagagccgaggacacggctgtagtattactgtgacgagagaggaggcgtaattagtagtaaaagtggctgggtaccttacgtacttactactactacagtcggacgtcgtaggggacaaagggaccgacggtcaccgtctcctcacgcctaccaccgaacggcccagtccgtccttccccgtcgcctaccctcctaccgaacgacgaccaccgtcgtacggggaccacgacgcccggcccgtcgggtctcggccgtcggtaccgaaggtacctacgttcctactacctactactacgtagacggg

SEQ ID NO: 184686 - DNA, 649 bp, Homo sapiens
  misc_feature: GYAE6OF02JE3YA.37.57.F02.1.454.CMB.1.raw
  modified_base (577)..(577): a, c, t, g, unknown or other
  misc_feature (577)..(577): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtggggggtccctgagactctcctgtgtagcctctgtaacttcccctttaggcttattggatgagcgtgggtccgccgaggtcctccgaggggaaggggctgggagtggggtcggaccgaacaagtaaacgacgaagtagtagggaaacgtaaaggaagggaagtagtaggtggactcgtagtggaaagggtccgtttacgacctagtcctccgaagacgaacaaccgtaccaagtaacctccgtagcatcctagacaaatgaacagtcctaggagcggtacccgaaggaccgacggttaccttaatttacttaacgtcgacgacgtaacggaggtaaaccggngtacggggttccgtttacgaacgttaccggtcggggtaccggaaccgggtacccgttacggccgtaccccgg

SEQ ID NO: 184687 - DNA, 609 bp, Homo sapiens
  misc_feature: GYAE6OF02HYU7S.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggagtgtcagtgtgaggtgcaattggtggagtcgtggggggaggcctcgtccagccgtgggggggtccctggagactctcctgtgtagcctctgaactttcccctttacggctttattggatgagcgtgggtcccgccaggctccggaggggaaggggctgggaggtgggtggccaacgataaagcaagataggaaagtaaggaaggagtatggtggactcgtggtagagggtccgtttcgacctatcctacagagacaacgaccaagaacctcgtagcatcagacaaatgaacaggtctaggacgaggccgaaggacgacggtactttaagtttactacgtggacgcgaaggaggaagggtcgtaggggtccgtttacgaccgttacggtcgggggacccgaacgggggtaacccttcgggtacctaccccgg

SEQ ID NO: 184688 - DNA, 576 bp, Homo sapiens
  misc_feature: GYAE6OF02JECGK.37.57.F02.1.454.CMB.1.raw
  modified_base (246)..(246): a, c, t, g, unknown or other
  misc_feature (246)..(246): n is a, c, g, or t
  modified_base (268)..(268): a, c, t, g, unknown or other
  misc_feature (268)..(268): n is a, c, g, or t
  modified_base (360)..(360): a, c, t, g, unknown or other
  misc_feature (360)..(360): n is a, c, g, or t
  modified_base (417)..(417): a, c, t, g, unknown or other
  misc_feature (417)..(417): n is a, c, g, or t
  modified_base (436)..(436): a, c, t, g, unknown or other
  misc_feature (436)..(436): n is a, c, g, or t
  modified_base (460)..(460): a, c, t, g, unknown or other
  misc_feature (460)..(460): n is a, c, g, or t
  modified_base (510)..(510): a, c, t, g, unknown or other
  misc_feature (510)..(510): n is a, c, g, or t
  modified_base (528)..(528): a, c, t, g, unknown or other
  misc_feature (528)..(528): n is a, c, g, or t
  modified_base (549)..(549): a, c, t, g, unknown or other
  misc_feature (549)..(549): n is a, c, g, or t
  modified_base (572)..(572): a, c, t, g, unknown or other
  misc_feature (572)..(572): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcgtggtttcctgtgctatttagaaggtgcagtgtgaggtgcagcgtgggtaggagtcgtagggggagcctggtacaagccgtgggggactcccgngacgactctcctgtgcagcctnggattccacttgagtagctatacgctaatcggaacgttcgggcccacgaggtcctaccggaagggggaagggcttgggaggtcggggtctanagtcctaagttaggtacgtaggtagtactacagtaataaccgtacgctagactacgngtcgagggtcccatcacancttttttttttttttttttacganacgacaacgcaaagtaacctcaacgttgactcacgactaaagacgaaacncgtcgagacgagaccganacgtacgctggtattactagngagacgacgtaccacctcgactnaacg

SEQ ID NO: 184689 - DNA, 233 bp, Homo sapiens
  misc_feature: GYAE6OF02GG99V.37.57.F02.1.454.CMB.1.raw
  modified_base (215)..(215): a, c, t, g, unknown or other
  misc_feature (215)..(215): n is a, c, g, or t
  modified_base (221)..(233): a, c, t, g, unknown or other
  misc_feature (221)..(233): n is a, c, g, or t
tcagtagtgtagatcacgaccggtgctcgatttagctcgatatagttgggtctgggctgagctgggctaagctggacctggctgggcctccaccaagggcccatcggtcttccccctggcgccctgctccaggagcacctccgagagcacagcggccctgggctgcctggtcaaggactacttccatctacactatgagcgggctggcaagggcncatagnnnnnnnnnnnnn

SEQ ID NO: 184690 - DNA, 784 bp, Homo sapiens
  misc_feature: GYAE6OF02JU7KO.37.57.F02.1.454.CMB.1.raw
  modified_base (277)..(277): a, c, t, g, unknown or other
  misc_feature (277)..(277): n is a, c, g, or t
  modified_base (497)..(497): a, c, t, g, unknown or other
  misc_feature (497)..(497): n is a, c, g, or t
  modified_base (593)..(593): a, c, t, g, unknown or other
  misc_feature (593)..(593): n is a, c, g, or t
  modified_base (764)..(764): a, c, t, g, unknown or other
  misc_feature (764)..(764): n is a, c, g, or t
tcagtagtgtagatcacgaccggtgctcgatttagctcgatatagttgggtttgggggttcgtcagagaggagccgttagccctggactccaaggcctttccacttggtgatcagcactgagcacagaggactcaccatggaattggggctgagctgggttttccttgttgtctattttagaaggtgtcctagtgtgacgtgacaacgtggtaggaggtcgtgggggagcgttggtccgagccggttgggggtaccctggacgactcctccgtggtnacgacgtcctcgttggtattaccgttaacgtttgggtactacgttatttagggtacgtagggtaacgttcggggttacccgccgtagtccgttaccgaaggggacgggggtacgtagggtagggtgggggttacggaccaaaccggtagttaaccgggaaggggttaggggtacggttacgggtaaacggtaaaaacgtgttgggtaggtaaccgttagngggtaaggggtcccggggaccggtcgttaccgaccgtacgtacgtaccgacgggaacgaacccgtaacgaaacccgttaaaaccacaacccggttntacgtaccgtacgtaacgttaaggaaccggtcgggtaccaggggttaaagaccggtaaccggaacggtacccgggtaaacggtccggttagtttacgttaagttacgtttcgggagtacgtaggtacgtaaagtttcaacgttaacctaacggtttacggtgtaacgggtntaggttatacgtattaccgg

SEQ ID NO: 184691 - DNA, 904 bp, Homo sapiens
  misc_feature: GYAE6OF02I0M4H.37.57.F02.1.454.CMB.1.raw
tcagtagtgtagatcacgaccggtgctcgatttagctcgatatagttgggtttgaggtctcagagaggagccttagccctggactccaaggccctttccacttggtgatcagcactgagcacagaggactcaccatggaattggggctgagcgttgggttttccttgttgctattttggaaggtgtccagtgtggaggtgctaagttgggtgggagtcggttgggggggacggtcccgttccggttcccgaggtcccggttcggggggggtcccccttaggacgtaccttcttcccgtggttcgtacgcccttcgtacgtaactttccccccgtttacggtccttttagttaggacttggaacgtcgttacgggtcccaccgaggtccgtacggaaaggggggaagggggccgtggggaacgggttgggggtaccggtaccaaaacgaagtaaaagcaaaagtagtaggaaaggttaaagaacgggattagtggtacggacttacgtaggtacggtaaacggggtcccgttttaccaaccgtaactttccgtaccgaaaggaacgaaaccgtaaacccggacctaaaacgggaacccttccggtaccgaaccgtaacttacgtaacgtaaccgtaaaagttacggtaaacccgtaaggttacccgtaaggtaaccgggaaccggtaccggggaaaccgggtaaccgtacccggtttaaactttaacgttttttaacgtaaccgtcgggttaccggaacggtaacggaacgggttaaaccggggtaccggggttaacgggggtttcccgggttttaaacccgggtaaccgttttacccggggtacggggggttaaccccccgggaaacggggttaaaccccccggttcgggtttaaaccccccgg

SEQ ID NO: 184692 - DNA, 592 bp, Homo sapiens
  misc_feature: GYAE6OF02G1N4H.37.57.F02.1.454.CMB.1.raw
  modified_base (417)..(417): a, c, t, g, unknown or other
  misc_feature (417)..(417): n is a, c, g, or t
  modified_base (581)..(581): a, c, t, g, unknown or other
  misc_feature (581)..(581): n is a, c, g, or t
  modified_base (584)..(585): a, c, t, g, unknown or other
  misc_feature (584)..(585): n is a, c, g, or t
  modified_base (587)..(587): a, c, t, g, unknown or other
  misc_feature (587)..(587): n is a, c, g, or t
  modified_base (590)..(592): a, c, t, g, unknown or other
  misc_feature (590)..(592): n is a, c, g, or t
tcagtagtgtagatcacgaccggtgctcgatttagctcgatatagttgggtttggggggtccctgagactctcctgtgtagcctctgaattcccctttacggcttattggatgagctgggtccgccaggctccaggggaagggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtcggggaccacggaaccctggtccaccgtctcctcacgccctaccaccgaacgggcccagtccggtccctttcccccnggcccacccctcctacccgaagacgccaccgtcggtcggggaccacgacggccggcccgtgggcctcggcccgtagggtaccaaacgggtaccttaccgtttccaacttccgtaaccgtacctacgtggacggcgggactcgggacaacgggccgacgagtagnctnntnacnnn

SEQ ID NO: 184693 - DNA, 987 bp, Homo sapiens
  misc_feature: GYAE6OF02I97YH.37.57.F02.1.454.CMB.1.raw
  modified_base (180)..(180): a, c, t, g, unknown or other
  misc_feature (180)..(180): n is a, c, g, or t
  modified_base (210)..(210): a, c, t, g, unknown or other
  misc_feature (210)..(210): n is a, c, g, or t
tcagtagtgtagatcacgaccggtgctcgatttagctcgatatagttgggtttgggggtctcagagaggagccttagccctggactccaaggcctttccacttggtgatcagcactgagcacagacggactcaccatggaattggggctgagctggtttccttgtgctattttggaggtntccagtgtgaggtgcaattggtggagtcgngggggagcctcggtccagccgtggggggtccctgagactctccgtgtgtagcctactgtacttcccctttacggcctttacttggattcggacgtcgttggggttcccgacccgtagggtccttacccgaggggggtaaacgggggtccgtttacggggaacggttcgggggtacgggtacccgaaaaccgtaaggttaaaaacggccgtaaaaccggaagttaacggggtaaaaggttaaaacgggaaaggggtaaacggttaacgttagggtaacggtaaacccgttccggtaggttacggggtaaaccggggttcccggtttttacccgaaccgtaaccgtttacccgttaacccgtaacgggtaaccggtaaaccccgaaacccggccccggtaaaaaacgtaaccccgttcccgggtaacgtacccggttaaacttcccggtaacggtaaaccttaaaaggttaacccgggaaaacctttaggggttaccccttaaggggggaaaccctacggggttaaaccccgggagggttaaaaccccggtacccgggttaacgttttaacgttttaaaccgttttaacccgggcgggtaccggttacccggggaaacggtaacggggtaaaccggggttacccgggttttaacggggggtaccgggtttttttaaccccggaacggttttaaccgggggtttacccgggggaaacccccgggtttacccgggggttaaaacccccgggtttcgggttacccgttaaacccccccgggg

SEQ ID NO: 184694 - DNA, 725 bp, Homo sapiens
  misc_feature: GYAE6OF02HT24O.37.57.F02.1.454.CMB.1.raw
  modified_base (216)..(216): a, c, t, g, unknown or other
  misc_feature (216)..(216): n is a, c, g, or t
  modified_base (279)..(279): a, c, t, g, unknown or other
  misc_feature (279)..(279): n is a, c, g, or t
  modified_base (691)..(691): a, c, t, g, unknown or other
  misc_feature (691)..(691): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaagttgggctgagtcttgggttttccttgttgcttattttggaagtgtccagtgtgaggtgcaagttggtggagtcgngggggacgtcctcgtccgacgccggttcgggggtcctggacgtcctctaccgtgtgtagcctntgtaacttccccgtttacggctttacgtggtaactgaggtcgtcggtcccgaccgaggtcctaccggaggggaggggcctgggtaggtggggtgaccaaaagtaagtaaagacgtaaggaagtagggaaacgtaaagaaggtagtagtcggtaggtactgtaggtacggtaaacggggttccgtttacgaacctacgttccgtaccgaagacgtaaaccgtaaaccgaccggtaaaacgtaaccgttcccggagtccaagttacgtaacgaaactaacgtacgaaacgtacggtacacggtaaaggacccgaacggaacgaaccgtacggttactttaagtttaacgttacgtcggacgaggtacggaaaggtaacggtaaggtcggggttacgtttacggacgttacgggngggaaccgtaccgggtaccgtagtcccgtaaccg

SEQ ID NO: 184695 - DNA, 818 bp, Homo sapiens
  misc_feature: GYAE6OF02H8IKD.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcttgggttttccttgttgcttatttttggaaggtgtccagtgtgaggtgcaagttggtggagtcgtgggggaggcctcgtccagccgtggggggtccctgagactctccgtgtgtacgccttctacgtaactttccccgtttacggtctttagttggagttgagtcgttcggggtcccgacgtacggacctaccggaagggggtaacggggcgttagggtaacgggttcggggtcggaaccaaaacgaaagtaaaacgacgaaaggagtagggaaaagtaaaggaaggtaagtagtggtacggtactcgtaggtacggtaacggggttccctttacaacctacgttcctaccgaaggtaaccgaaaccgaaaccggaaccctaaaacggtaacctacccggtacgactaacgtccgtaacgaactaaaagtacgaaactaggtaccgtaggaacggaaccggccggaaacgggaaccgtaaccgggttaacttttaaagttttaacgttaaccggtacggtaccggaaccggaaaggtaaacgggaacgggttaaccgggtttaggggggtacccggtttttaaccggaaaccggtttcccgggtaccggggggtaaccccggtaaacccgggggtaaccccgtttccgggtacccgtaacccccgg

SEQ ID NO: 184696 - DNA, 737 bp, Homo sapiens
  misc_feature: GYAE6OF02IUPIZ.37.57.F02.1.454.CMB.1.raw
  modified_base (485)..(485): a, c, t, g, unknown or other
  misc_feature (485)..(485): n is a, c, g, or t
tcagtagtgtagatcacgaccggtgctcgatttagctcgatatagttgggtctgggggaggcctcgtccagcctgggggggtccctgagactctcctgtgtagcctctgaattcccctttacggcttattggatgagctgggtccgccaggctccgagggaaggggctggagtggggtggcagttatatcagatgatggaagtgttgagagtatgcagactccgtaggaacgggctattacacactctccagagacacttacaagaacacactactatctgaacaatagaacagaccgtagaagaacgtggaacggacgacggcgtagttagtactacgagttacgtacgaccggtaaaccggttagggggttaggaacgtagtcggacgtaacggtcggtagggtaagggtggttagtttacgggttttgtaagttttacgggtcggggtaacgtaaacgggtagtaacggtcggtttaacccncggttcctacgttacgaccgtacccgttaccaaccggggtacgtccccgtaaggttccccgttcccgtcccccgttaggaccccctacccgtcgtaaccgaacggtccctacccgtaccggtttcgggaccgggacaccggtccggtacccggccgtgggtacctaccggtccggttacggaacccgtaaaccggttacccttaccgtccgtaacctttcccgtaacgtacccgttaggaacccgggtcggg

SEQ ID NO: 184697 - DNA, 633 bp, Homo sapiens
  misc_feature: GYAE6OF02IES2I.37.57.F02.1.454.CMB.1.raw
  modified_base (324)..(324): a, c, t, g, unknown or other
  misc_feature (324)..(324): n is a, c, g, or t
  modified_base (333)..(333): a, c, t, g, unknown or other
  misc_feature (333)..(333): n is a, c, g, or t
  modified_base (409)..(409): a, c, t, g, unknown or other
  misc_feature (409)..(409): n is a, c, g, or t
  modified_base (442)..(442): a, c, t, g, unknown or other
  misc_feature (442)..(442): n is a, c, g, or t
  modified_base (601)..(601): a, c, t, g, unknown or other
  misc_feature (601)..(601): n is a, c, g, or t
tcagtagtgtagatcacgaccggtgctcgatttagctcgatatagttgggtttggggtctcagagaggagccttagccctggactccaaggcctttaccacgttggtgatcagcactgagcacagagactcaccatggaatgggctgagctggtttcctgtgctatttggagtgtcagtgtgagtgcaagttggtggagtcggtgggggacgccgttcgtccgaggcccgtgggggtaccctggacgactcgtaccgtgtcgtaacgcctcgtagtaacctttccccgtttaaggctttagttggaatgagtcgtcgggtaccnccgaggccnccggaagggaggctggacggttgggacggacccaaagtagaaacgcgaaagtacgtaggaaagtaaggagaacgtntacggtgaacttgagtacgaaggtcgttcacgntacgcagacgacaacgcgttaaaagctttccgggataccagttcgacgaacaacgtacgaaacgttagccgtaggaacggaccgaccgttaacggaaacttccggtattatttaacctagcgtcgacgtaagacggaaggtacctgggggtacttaacncgttaagcggccgttaacgaccgtgaccctcg

SEQ ID NO: 184698 - DNA, 758 bp, Homo sapiens
  misc_feature: GYAE6OF02HOF3K.37.57.F02.1.454.CMB.1.raw
  modified_base (328)..(328): a, c, t, g, unknown or other
  misc_feature (328)..(328): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcttgggttttccttgttgcttagttttggaaggtgtccagtgtgaggtgcaagttggtggagtcgtgggggagtcctcgtccagccggtggggggtccctgacgactctcctgtgtacgcctctagtaacctttccccgtttacggtctttagttggagtgacgtcgtcgggtcccnccgacggcctacggaagggggaagggtcgtagggtagggtcggggtacggacccaaacgaaagtaaacgacgaaaggacgtagggaaagtaaaggaaggtaagtagtggtaggtactgtggtacggtaacgggtcccgtttcaacctacgttccaacgaacggacgaaaccgaaacgaacccgaaaacgaaccgttccggtagaacctacgttaccgtacgtaaacaaacgttacgaaacgtcggttaccggaaggaacgggtaacgacccgggaacgtaaccgtaacccggttatttaaagtttttaaccgagtaccggacggaacgggtaaggaagggtaacgggtcggttacgggggttaaccttaccggaacggtacggggtaccgggaacccgtaaccggggttaccctcggacccgttaaccgg

SEQ ID NO: 184699 - DNA, 725 bp, Homo sapiens
  misc_feature: GYAE6OF02GHZBC.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatgaattggggctgagctgggtttccttgttgcttattttggaggtgtccagtgtgaggtgcaattggtggagtcgtgggggaggcctcggtccacgccgtggggggtcccctggacgtactccgtccgtcgtggtacgcccgttcgtagaaccttttcccccgtttacggtacctttagtttcggattggacgtcgtcggggttcccgccgaggcctccgagggggaacgggtctagggtagtggggtcgaccgaaactaagtaagcgtaaagcgttaggaaagtaaacggaaggtagtagtcgtaggtacgttacgtggtaggtaaccggggtccgtttacgacctagttccaccgtaagtacggaacctaaccgtaccgaaagtaacccgttcggtagacctagtccgttaacacctaaaagtcgaaacgtacgttacgacggtaaggacggaccggaggaaccgaccgttagttactttagttccgaaggcgacgtaagacgggtaaacggtacggtcggggtcccgtttaagaccggttacccggtggggtaacccacggggtacccctgggtaccctaaccccgg

SEQ ID NO: 184700 - DNA, 690 bp, Homo sapiens
  misc_feature: GYAE6OF02FWEX3.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaggtgtccagtgtgaggtgcaattggtggagtcgtgggggaggcctcgtccagccgtggggggtcccctggagactctcctgtgtagcctctgaacttcccctttacggcttattggatgagtctcgggtccgccgagggcctccgagggggaagggctgggaggtgggtcggccaacaagtaaagcaaagagtggaagtaagaaggagtatggtagactcgtgtggaagggtccgtttcaccatcctccgaaggacaaccaaaccggccgaaaagtaacccgtccgtagacctaacttcctaacggactaaaagttcggaaaacctgggtcctaggagtaaccgggaccggaagggaaccgtaccgggtaacttttaagtttttaaccttacgtaggacccgcgggaaaggacggggtaaaacggtccggttggggggtacccggttttacgaaccggtttacggtcggggggaccccaaacgggggtaccccctttcgggaccctaccccg

SEQ ID NO: 184701 - DNA, 545 bp, Homo sapiens
  misc_feature: GYAE6OF02GF4PA.37.57.F02.1.454.CMB.1.raw
  modified_base (305)..(305): a, c, t, g, unknown or other
  misc_feature (305)..(305): n is a, c, g, or t
  modified_base (332)..(332): a, c, t, g, unknown or other
  misc_feature (332)..(332): n is a, c, g, or t
  modified_base (380)..(380): a, c, t, g, unknown or other
  misc_feature (380)..(380): n is a, c, g, or t
  modified_base (394)..(394): a, c, t, g, unknown or other
  misc_feature (394)..(394): n is a, c, g, or t
  modified_base (447)..(447): a, c, t, g, unknown or other
  misc_feature (447)..(447): n is a, c, g, or t
  modified_base (468)..(468): a, c, t, g, unknown or other
  misc_feature (468)..(468): n is a, c, g, or t
  modified_base (477)..(477): a, c, t, g, unknown or other
  misc_feature (477)..(477): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaagtgtccagtgtgaggtgcaattggtggagtctgggggaggcctcgtccagccgtggggggtccctgagactctcctgtgtagcctctgaacttcccctttacggcttattggatgagctgggtccncaggctcgagggagggctggagtgggngccaacataaagcaagataggaagtaagaaggagtatgtggactctgngaagggtccctttnacccatcctcgagtagacaacgccaagtactccgtgcatctagacaatgaacngtcagagagcgagacacggtntatttatcncgcgcgagacgaagacgtcgggtcggtttacgacgtacggcgggtaccgacgggacctggtctacccg

SEQ ID NO: 184702 - DNA, 736 bp, Homo sapiens
  misc_feature: GYAE6OF02GUA14.37.57.F02.1.454.CMB.1.raw
  modified_base (497)..(497): a, c, t, g, unknown or other
  misc_feature (497)..(497): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcttgggttttccttgttgctattttggaaggtgtccagtgtgaggtgcaattggtggagtcgtgggggaggcctcgtccagccgtgggggtccctgagactctcctgtgtacgcctctgtaacctttccccgtttacggctttattggatgagcgtcgggtcccgccgaggcctccggaagggggaacggggccgtggggaggttggggtacggaccaaacgaagtaaaagcgaaagagtaggaaagtaaggaaggtagtagtggtaggactgtggtaggaacgggtccgtttacacctactcctaccgaagaacgaaccaacgacccgaaaagaccgttccgganaccacttcgtacgaactaaagtacgaaacgtacgtactagggaacgacggacccgggaaggaacccgtacgggttactttaaacgttttacgtaaccgtagggacccggtacggaaggtaacgggaaacgggtaccgggttacgggggttacccggtttttaaccggaaccgtttacggggtccggggaaccccgttaacgggggtaacccccgtttcgggtaaccccgtaacccccgg

SEQ ID NO: 184703 - DNA, 797 bp, Homo sapiens
  misc_feature: GYAE6OF02I6D2I.37.57.F02.1.454.CMB.1.raw
  modified_base (777)..(777): a, c, t, g, unknown or other
  misc_feature (777)..(777): n is a, c, g, or t
  modified_base (782)..(782): a, c, t, g, unknown or other
  misc_feature (782)..(782): n is a, c, g, or t
  modified_base (785)..(785): a, c, t, g, unknown or other
  misc_feature (785)..(785): n is a, c, g, or t
  modified_base (791)..(791): a, c, t, g, unknown or other
  misc_feature (791)..(791): n is a, c, g, or t
  modified_base (796)..(796): a, c, t, g, unknown or other
  misc_feature (796)..(796): n is a, c, g, or t
tcagtagtgtagatcacgaccggtgctcgatttagctcgatatagttgggtttggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtggaagggtccgtttcaccatctccagagacaacgccaagaaccttccgtgctatctagaccaaagtgaacagttctggaacgacggcccggtaaggaccgacgggtctttaagttttaacttacgtcggaccgtaggaaggaaggaagggtaaccgttcgggggtccggtttttaccggactaccgggtacgggggacccgaacggggtaaaccccttgggtacccctaccggttcctccctcgacgtcccctaccgaaccgaaacggggcccctaaggttcccggttaccccgttccccccgtcggtccccgtccccgttcggtaccccgttacggaaccgggtaccgtcccgtaacccccgtacccgggaacggaccgacccgaaccgtaaccgggccccgggtaccccggtcggggtacccttccgggtaccccggttagggtacccgaaacgggttacccttacccgtttacccggtaacttaccccggttaacctaaccgttacgttaccggggaacggcccgggttacgtaccgggtacaccggggtacgaaccgtaacgttaaggccnggacncgnctcgcncgcgnc

SEQ ID NO: 184704 - DNA, 839 bp, Homo sapiens
  misc_feature: GYAE6OF02GAEJS.37.57.F02.1.454.CMB.1.raw
tcagtagtgtagatcacgaccggtgctcgatttagctcgatatagttgggtttgaggtctcagagaggagccttagccctggactccaaggtccctttccacttggtgatcagcactgagcacaggaggactccaccatggtaagttggggctgagtcgtttggggtttttccctttggtttgtctttagttttgggaaggttcgtcccgtaggttggttaggtagggttgtacctaagtttggggtacgggtaggttccgggtagggggggacggtcccgttccggtcccgacggtcccgggttcgggggggtccccttggaacgtaccttccgttccgttggttacggtacgcccttcgtacgttaaccttttccccccggtttaacggtccttttagttcgggtatggtacggtcggttcgggtcccgacccgtaggtcctaccggaagggggtacggggtccgtgggtagggttcggggacggaacccaaagtaacgtaaacgaccgtaaaggacggtaaggaaaggtaaaggaaggtagtagtggtaggtactcgtaggtacggaacgggttccgttaccacctacgtcctaaccgagaacgaaccgaaccgaccgaaacgtacccgtccgtgacctacttccgtagaactaaggtactaaacggacgtttccgaggaacgtacgggacccggaaggaccgtaccgggttactttaagtttaacgtaccggtgacggtacggaacggaagggtaacgggtaccgggttgggttaccggttaccgtacggttaccgggtcgggtaccgaacccgggttacccgtgggtacccccg

SEQ ID NO: 184705 - DNA, 606 bp, Homo sapiens
  misc_feature: GYAE6OF02G2Z9G.37.57.F02.1.454.CMB.1.raw
  modified_base (180)..(180): a, c, t, g, unknown or other
  misc_feature (180)..(180): n is a, c, g, or t
  modified_base (289)..(289): a, c, t, g, unknown or other
  misc_feature (289)..(289): n is a, c, g, or t
  modified_base (400)..(400): a, c, t, g, unknown or other
  misc_feature (400)..(400): n is a, c, g, or t
  modified_base (402)..(402): a, c, t, g, unknown or other
  misc_feature (402)..(402): n is a, c, g, or t
  modified_base (442)..(442): a, c, t, g, unknown or other
  misc_feature (442)..(442): n is a, c, g, or t
  modified_base (541)..(541): a, c, t, g, unknown or other
  misc_feature (541)..(541): n is a, c, g, or t
  modified_base (596)..(596): a, c, t, g, unknown or other
  misc_feature (596)..(596): n is a, c, g, or t
  modified_base (602)..(602): a, c, t, g, unknown or other
  misc_feature (602)..(602): n is a, c, g, or t
tcagtagtgtagatcacgaccggtgctcgatttagctcgatatagttgggtctgggggaggcctcgtccagcctggggggtccctgagactctcctgtgtagcctctgaacttcccctttacggcttattggatgagctgggtccgccaggctccgagggagggctggagtggtgccaanataagcaagatggaataagaaggagtatgtggactctgtgaagggtcctttcacctatcctccaagagaacctaacgccaagaacctccgtgcatctgacaaatgaacntctgagacgccgaggacacggtcttaagttttactacgtgcgacgagagaaggcgtggtcggtttacacgtcggtcggggaccgtaacggacccgtggtccaccgtcctcncncgccctacgacgaccggtccagttccggtcccttccccgngtcccgtcctcgtcctcgacggcgacctccgtacgagacgccacgcgggtcccgccggtcggcgttcgccgtggaccgtaacggtaccttaccgtaccnccgttaactacctaccgttacgacggcgggccggtcgtggacgaggacctagtanggtacngcta

SEQ ID NO: 184706 - DNA, 522 bp, Homo sapiens
  misc_feature: GYAE6OF02FHRGA.37.57.F02.1.454.CMB.1.raw
  modified_base (436)..(436): a, c, t, g, unknown or other
  misc_feature (436)..(436): n is a, c, g, or t
  modified_base (495)..(495): a, c, t, g, unknown or other
  misc_feature (495)..(495): n is a, c, g, or t
  modified_base (518)..(518): a, c, t, g, unknown or other
  misc_feature (518)..(518): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggtttttccttgttgctatttttggaaggtgtccagtgtgaggtgcaattggtggagtctgggggaggcctcgtccagcctggggggtccctgagactctcctgtgtagcctctgaattcccctttacggcttattggatgagctgggtccgccaggctccagggaagggctggagtgggtggccaacgataaagcaagagtggaagtaagaaggagtatgtggactctgtgaagggccgtttcaccatctccagagacaacgccaagacctccgtgcatcngacaaatgaacagtctagagacgccgaggacacggcttatttatacgtgcgcgagagancagacggtatagagcagcagctntacg

SEQ ID NO: 184707 - DNA, 588 bp, Homo sapiens
  misc_feature: GYAE6OF02IEI0M.37.57.F02.1.454.CMB.1.raw
  modified_base (185)..(185): a, c, t, g, unknown or other
  misc_feature (185)..(185): n is a, c, g, or t
  modified_base (435)..(435): a, c, t, g, unknown or other
  misc_feature (435)..(435): n is a, c, g, or t
  modified_base (464)..(464): a, c, t, g, unknown or other
  misc_feature (464)..(464): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (579)..(580): a, c, t, g, unknown or other
  misc_feature (579)..(580): n is a, c, g, or t
  modified_base (582)..(588): a, c, t, g, unknown or other
  misc_feature (582)..(588): n is a, c, g, or t
tcagtagtgtagatcacgaccggtgctcgatttagctcgatatagttgggtttggggggtccctgagactctcctgtgtagcctctgaattcccctttacggcttattggatgagctgggtccgccaggctccagggaagggctggagtgggtgccaacataaagcaagatggaagtaagaaggngtatgtggactctgtgaagggtccgtttcaaccatctccagagacaacgccaagaacctccgtgcatctgcaaatgaacagtctgagacgccgaggaccacggtacttatttacttacgtgcgacggaagaaggaacggtacgtggggtaccggtttcgaactacggtcggggaccgacggggtaccctggtccaccgtcctcctcacgcctaccaccgacggccctacgtccgttccctccctggcccncctcgcctcgacggacgctactcgagacncacgacggccggtcccgtgggccgtgccgtggtacgaacgacttaccgtcctactcctactaccgtacgtcggtacggcggtcgtacggacgtacgggccgagtacgacgnancnncnnnnnnn

SEQ ID NO: 184708 - DNA, 854 bp, Homo sapiens
  misc_feature: GYAE6OF02I6SUV.37.57.F02.1.454.CMB.1.raw
  modified_base (206)..(206): a, c, t, g, unknown or other
  misc_feature (206)..(206): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (320)..(320): a, c, t, g, unknown or other
  misc_feature (320)..(320): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaagttggggctgagtctggggttttccttgttgcttattttggaggtgtcagtgtgaggtgcattggnggagttcgtgggggacggtcctcgtccagccggtcggggggtccctggacgtactctcgtgtgtacncctntnacctttccctacggtcttagtgatcgagcgttcgggtcccnccgtaggccgtaccgaaggggtacgggcgtgggaggtgggtacgaccaaacgaataaaacgcgaaagtacgtagggtaaacgtaaacggaaggtagttaacgtggtacgggacttacgggtagggttaacgggtaaccggggttacccttttacccgaaacgtaccttacccggtaaccctaaaggaaaccggtaaaccccgtaaaccgacccccggtaaaaaaccggttaaccgttaccccggtaaacggtacccttacgtaacccgtttaagggaaaacccttaaaacgttaacggtaaaaccgttacggtaaccgttacggaaaccgggtaaaccggacccgggaaagggtacccgtaacgggtttactttaaacgttttaaccggttacgacgggtcgtaagacgggtaaacgggtaccgggtaagggtttcccggggttaacgggttacccggttaaggttaaccccgggtcggggggttaaccccgaacgggttaaaccccgggttcgggtacccccgtttaacccgg

SEQ ID NO: 184709 - DNA, 758 bp, Homo sapiens
  misc_feature: GYAE6OF02HNTHH.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggagcctcgtccagccgtggggggtccctgagactctcctgtgtagcctctgtaactttcccctttacggctttagttggatgagtccgtggggtcccgccgacggccttacccggaagggggaacgggggccgttggggagggttcgggggtcgggaccccaaacgaaagttaaaacggacgaaagtagtagggaaagtaaacggaaagggagttaagttggtaggtacgtcgttggtacggaacggggttcccgttttacgacccgtattccctacccgaaggaaccgaaccgaaaccgacccaaaagtaacccgttcccgagaccgtaacgttcctagaactaaagttacgaaaccgtacgtacgtagacggtacggaccggaagggaacccgtacggtattttaacgtttacgtttaccgcggaccgacggaaggtaacggtaagggtacgggttcggggtttaccgggtttaaccgaccgggttaccgggtaccggggggtacccgtaaccgggggttaccccgtgggttaacccccg

SEQ ID NO: 184710 - DNA, 714 bp, Homo sapiens
  misc_feature: GYAE6OF02IBFDX.37.57.F02.1.454.CMB.1.raw
  modified_base (359)..(359): a, c, t, g, unknown or other
  misc_feature (359)..(359): n is a, c, g, or t
  modified_base (370)..(370): a, c, t, g, unknown or other
  misc_feature (370)..(370): n is a, c, g, or t
  modified_base (412)..(412): a, c, t, g, unknown or other
  misc_feature (412)..(412): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaagtgtccagtgtggaggtgcaatttggtggagtcgtgggggaggtcttggtccagccgtggggggtccctgagactctctgtgcaggcctcgtggtatttcaacgtttggtagtcttattggatgggacgtgggtcccgcctagtccgtcgaggggagggcgtggaggtgggtcgacaacngtacgaggggnggtaggtagggtaaacgaaaaacgtgtagtaggactgttggnggccggggtccgaactttccaaccgtatccgtaccaaggaacgaaccaaaccgaaaccctaaaaactccgtaaccgttagtaactccgttaacgaacgtaaaggtcgggaaccggtcgtccggaacgtacggtacccgggtaaggacccggtaacgggtccttagggttacgtttaatttaacggtttggtaccggtacggtaaggttaacggttaagttttaaccggtaaaccgtttaaaccgttaaacggttttacggtacggttacggtaacgtttacgggtaagttaggtacttacgg

SEQ ID NO: 184711 - DNA, 896 bp, Homo sapiens
  misc_feature: GYAE6OF02HIQ4W.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcttgggttttccttgttgcttattttggaaggtgtccagtgtgaggtgcaattggtggagtcgtgggggagcctcgtccagccgtgggggtccctgacgactctcctgtgtacgcctcgtgtaacctttccccgtttacggtcttagttggatggacgtcgtcggggtcccgccgacggccgtaccggaaggggtaacgggcgtagggacgggttggggtacggaaccgaaacgtaaagtaaaacggacgtaaaggtaagtaggggaaaaggttaaagggaaagggtaagttaagtacgggttaggtacgtttacggttagggtaaggggtaaaccggggttcccgttttaccgaaccccgttacgttacccgtaaccggtaaacggaacggtaaaccccgtaaacccgaacccggtaaaacggttaaacccgttccgggtaccgaccttaaccgtacggttacgaaaccgtaaacgtacgaaaccgttcgttaccggtaaggacggtaaccgggacccggtaacgggaacccgtacggttaacctttttaacgttttaaaccgtttacggaccgtacccgggtacggtaaagggaacgggttaaaaccggggttccgggtttacggggggtttaccccgggttttaaccggtaaccggggttttacccggggtaccggggggtaaacccccggaacccgggggtttaacccccgttcgggggttaacccccccttaaccccggg

SEQ ID NO: 184712 - DNA, 642 bp, Homo sapiens
  misc_feature: GYAE6OF02HNF5D.37.57.F02.1.454.CMB.1.raw
  modified_base (355)..(355): a, c, t, g, unknown or other
  misc_feature (355)..(355): n is a, c, g, or t
  modified_base (448)..(448): a, c, t, g, unknown or other
  misc_feature (448)..(448): n is a, c, g, or t
  modified_base (466)..(466): a, c, t, g, unknown or other
  misc_feature (466)..(466): n is a, c, g, or t
  modified_base (513)..(513): a, c, t, g, unknown or other
  misc_feature (513)..(513): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgcttattttggaaggtgtccagtgtgaggtgcaattggtggagtcgtgggggagcctcgtccagccgtggggggtccctgaggactctcctgtgtagcctctgaactttcccctttacggctttattggatgagcgtcgggtccgccaggcctccggagggggaggggcgtggaggtgggtgccaaanataaacgcaagagtaggaaagtaagaaggagtagtgtaggtactcgtgtagacgggtcctttcactctcacagagacaacgccaagacctcgnctatctgacaaatcgaangtctgaagacgtaccggagacgtacggtacttaagttttactaccgnggtccgacggggtaaggtaacgggaacgggtaccgggttgggggttacccgggttttaccgaacggttaccggggtacgggggacccggaaccgggggttaccccgtaccgggtacccttaaccccggg

SEQ ID NO: 184713 - DNA, 732 bp, Homo sapiens
  misc_feature: GYAE6OF02FYZOU.37.57.F02.1.454.CMB.1.raw
  modified_base (371)..(371): a, c, t, g, unknown or other
  misc_feature (371)..(371): n is a, c, g, or t
  modified_base (517)..(517): a, c, t, g, unknown or other
  misc_feature (517)..(517): n is a, c, g, or t
  modified_base (552)..(552): a, c, t, g, unknown or other
  misc_feature (552)..(552): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaagttggggctgagcttgggttttccttgttgcttattttggaaggtgtccagtgtgaggtgctaattggtggagtcgtgggggagcctcgtccagccgtgggggtccctgagactctcctgtgtacgcctctgtaactttccccgtttacggtctttagttggatggagtcgtgggtcccaccgaggcctaccggaagggggaacggggctgggaggttgggtcgaccaaanaagtaaagcgaaagagtaggaaagtaaaggaaggtagtagtggtaggtactcggtggacgggtaacggggttccctttaccaaccgtacttccgtaccgaaaggtaccaaacccgtaccgaaccgtaaacgtaacccgttccgganacctacttctacggaataagtacgaaactgtacgnggaaagccggtacccggaaagacccgttaccgtattttaaactttacgttaacgcgacggtagaaacgggtaagtaaccgggggttctccgggggggtttaaccgttttaccaccgggttacgggtcccggggggaaaccgttacccggggtaacccggtttcggaaaccccttccccgg

SEQ ID NO: 184714 - DNA, 547 bp, Homo sapiens
  misc_feature: GYAE6OF02HUJW9.37.57.F02.1.454.CMB.1.raw
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (533)..(533): a, c, t, g, unknown or other
  misc_feature (533)..(533): n is a, c, g, or t
  modified_base (538)..(539): a, c, t, g, unknown or other
  misc_feature (538)..(539): n is a, c, g, or t
  modified_base (544)..(547): a, c, t, g, unknown or other
  misc_feature (544)..(547): n is a, c, g, or t
tcagtagtgtagatcacgaccggtgctcgatttagctcgatatagttgggtttgggggggtccctgagactctcctgtgtagcctctgaattcccctttacggcttattggatgagctgggtccgccaggctccagggaaggggctggagtgggtggccaacataaaagcaagatggaagtaagaaggagtatgtggactctgtgaagggccgtttcaccatctccagagacaacgccaaagaactccgtgcatctgacaaatgaacagtctgagagccgaggacacggctatttattactgcgcgagaagaaggactggggcggttttcgactacgtggggccaagggaaccctggtcaccgtcncctcngcctcaccaacggcccatcggtcttccccgtgccgccctgcctccgaggcgaccacccgtccgagacgcacagccggcctgggcctgcctaggtcaaaggctacttccattcgacactacgtgacggcggctggcctaagggcgacgaagtacggactgcancgtannacgtnnnn

SEQ ID NO: 184715 - DNA, 722 bp, Homo sapiens
  misc_feature: GYAE6OF02HXNDW.37.57.F02.1.454.CMB.1.raw
  modified_base (242)..(242): a, c, t, g, unknown or other
  misc_feature (242)..(242): n is a, c, g, or t
  modified_base (287)..(287): a, c, t, g, unknown or other
  misc_feature (287)..(287): n is a, c, g, or t
tcagtagtgtagatcacgaccggtgctcgatttagctcgatatagttgggtttggggacccaaaaaccacacccctccttgggagaatcccctagatcacagctcctcaccatggactggacctggagcatcctttttcctggtggcagcagcaacaggtgcccactctcaggttcagctggtgcagtctggagctgaggtgaagaagcctggggcctcagtgaaggtctctgcaaggcttntggttataccttttagcaattagtggtatcaacgtgggtgcgacnggccctggacaaggccatgagtggagtgggatggatcagcgacttacaaataataaacacacactatgacacgaagtaagttccgaagggcaaggacgttccaacccctaggaaccctacgaaacgtaacgtaacctacgttacccgaaacggtacgaacccaaccgtaaaccgtaccccgttaaaccgtaacggttaaccgggacggtaccgtaacgggggtaacggggaacgtaccccgtagggaacgggttacttacccggttaggggaaacccgtaacgtacccggggttcccggttttaggtttttaaccggtgggttacggaccgggtaaggtaacggttaaaccgtaagggttaaatttacggttttaagttaaacggtttacgggtaaccgtttaccgggtacgggggtaccccggtaaaccggggg

SEQ ID NO: 184716 - DNA, 630 bp, Homo sapiens
  misc_feature: GYAE6OF02GEIYC.37.57.F02.1.454.CMB.1.raw
tcagtagtgtagatcacgaccggtgctcgatttagctcgatatagttgggtttgggggggtccctgagactctcctgtgtagcctctgaattcccctttacggcttattggatgagctgggtccgccaggctccagggaaggggctggagtgggtgccaacataaagcaagatggaagtaagaaggagtatgtggactctgtgaagggtccgtttcaccatctccagagacaacgcccagaactcattgtattctgcaaaatgaacagactgagagccgaggacacggctgtgtattactgtgcgagagaggaggcgattagtgtaaaatggctgggccttctactaactactactacatggacgtcgtgggacaaagggaccacggtacaccgtcctcctacacgccctacccacccgaacgggcccctacgtacccggttccttcccccctcgggcctaccccctcctacccaagacgcctaacccgtcggtccgggggcaaccgacggtccggcccgttagggccgttccgtaccgtcggtacgaacggtaccttaccgttccacgttctaaccgtaactacctcggacggtccgggtacgtcgggacctaacgggccgacgtaacg

SEQ ID NO: 184717 - DNA, 714 bp, Homo sapiens
  misc_feature: GYAE6OF02ILLSU.37.57.F02.1.454.CMB.1.raw
  modified_base (318)..(318): a, c, t, g, unknown or other
  misc_feature (318)..(318): n is a, c, g, or t
  modified_base (531)..(531): a, c, t, g, unknown or other
  misc_feature (531)..(531): n is a, c, g, or t
tcagtagtgtagatcacgaccggtgctcgatttagctcgatatagttgggtttgagtctcagagaggagccttagccctggactccaaggcctttccacttggtgatcagcactgagcacagaggactcaccatggaattggggctgagctggttttcctgtgctattttggaaggtgtccagtgtgaggtgcaagttggtggagtcgtgggggagcctcgtccaggccgtcgggggtcctgacgtactcgtctgtgtacgccttcgtagtaactttcccccgtttaggtccttagttggatggagtcgtcgggtccnccgaggccgtcggagggagggctagggaggtgggtgaccaataagtaaacgcaaagagtaggaagtaaaggaaggtagtagtggtagacgttgtagtagggtaacgggtcccgttacgaacctagttccgaccgaagtagaaccgaaaccgacaaaacgtacgtcccgagtacctaacgtcgttacgaacgttaaagtacgaaccgtaaggtntaacgggaacgaaccggtaccgaaacgggtaccctaacggtaaccgtttattttaaaccgtacgtaccggcgtaacggtaggtaaacgggtaaccggacgggtttccggggtaaccgttttaaccggacgttaaccggggtaccggggtacccgaaaaccgggttccccggtagggtaccccg

SEQ ID NO: 184718 - DNA, 739 bp, Homo sapiens
  misc_feature: GYAE6OF02HGFSC.37.57.F02.1.454.CMB.1.raw
  modified_base (268)..(268): a, c, t, g, unknown or other
  misc_feature (268)..(268): n is a, c, g, or t
  modified_base (729)..(729): a, c, t, g, unknown or other
  misc_feature (729)..(729): n is a, c, g, or t
  modified_base (735)..(735): a, c, t, g, unknown or other
  misc_feature (735)..(735): n is a, c, g, or t
  modified_base (737)..(737): a, c, t, g, unknown or other
  misc_feature (737)..(737): n is a, c, g, or t
tcagtagtgtagatcacgaccggtgctcgatttagctcgatatagttgggtttggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtggaagggccgtttcaccatctccagagacaacgcaagaactccgtgcatctgacaaatgaacagtntgagagccgagacacggctagtttatactgcgcgagagaacggctagggcggttcgacgtacgtggggcccaacggggtaacctggtacgtaccgttctccgtcgagccctacctaccgaaacgggccctaacgttccgggttacccttccccccgtagggcccgtccccgttcggaccttacccgaacgggtacgtacccgtaaaccccgttcccggaaacggtaacggacccaacggaaccggtaccccggggtaccccgtgggggtaacccttccgggtaccccgttacgggtaacccgaaacgggttaacccgttaaccgtttaacccgtaacgttaccttaaacccgtaaccgtttaaccgtttacgggtacggggaaacccggggttccggtaacggtaccggaacggggttaccgaccggtaacggtaaaccgggtcgtaagcctagaggacgnagtcgngncg

SEQ ID NO: 184719 - DNA, 644 bp, Homo sapiens
  misc_feature: GYAE6OF02JT9P8.37.57.F02.1.454.CMB.1.raw
  modified_base (146)..(146): a, c, t, g, unknown or other
  misc_feature (146)..(146): n is a, c, g, or t
  modified_base (181)..(181): a, c, t, g, unknown or other
  misc_feature (181)..(181): n is a, c, g, or t
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
  modified_base (327)..(327): a, c, t, g, unknown or other
  misc_feature (327)..(327): n is a, c, g, or t
  modified_base (338)..(338): a, c, t, g, unknown or other
  misc_feature (338)..(338): n is a, c, g, or t
  modified_base (636)..(636): a, c, t, g, unknown or other
  misc_feature (636)..(636): n is a, c, g, or t
  modified_base (639)..(639): a, c, t, g, unknown or other
  misc_feature (639)..(639): n is a, c, g, or t
tcagtagtgtagatcacgaccggtgctcgatttagctcgatatagttgggtctgggggaggcctcgtccagcctggggggtccctgagactctcctgtgtagcctctgaacttcccctttacggcttattggatgagctgggtccnccaggctccgagggagggctggagtgggtgccaanataaagcaagataggaaagtaaggaaggagtagtgtggactctggtaggaacgggtccgtttcaccatcctaccgagacgacaacgccaagacctccgtncatctagacaaagtcgaacngtctaggagacgacgaggacacggtnttatttatacngcgacgagagaggcgtgggtcgttacacgtcggcgggaccacgggtacctggtacctccgtcctccacgacgtcccacccgacgacggccctacgtccggtcccttccccgacggtcccgcccgtcgccgtacgacggacgccctaccgtacggacgaccgaccgacgaccggcccggtccggtggtccgtacggtccgtacggtaccgaaccgggtaccttacgtaccgtacttaccgtacctacgttcggtacggacggtccggtacgcgaccgacggtcctaacgtacgtagacncgngtacg

SEQ ID NO: 184720 - DNA, 747 bp, Homo sapiens
  misc_feature: GYAE6OF02HYOAT.37.57.F02.1.454.CMB.1.raw
  modified_base (288)..(288): a, c, t, g, unknown or other
  misc_feature (288)..(288): n is a, c, g, or t
tcagtagtgtagatcacgaccggtgctcgatttagctcgatatagttgggtttgaggtctcagagaggagccttagccctggactccaaggccctttccacttggtgatcagcactgagcacagaggactcacagtggaattgggggctgagtcttgggtttttccttgttgcttatttttggaaggtgtccagttgtgtaggtgctaagtttgggtggtaggtcggtggggggacggtcctcgtccaggccgtcggggggtccctggacgtacctcctctgtgtacncctctagttactttccccgttacggtctttagttcggattcgacggtcgttcggggtcccacgtaggtccgtaccgggaggggtacggggcgtggagggttcgggtacgaccaaactaagtaaacgacgaaagaggtaagggtaaagtaaaggaaggagttagtggttacgacttgtaggtacgggtaaacgggttccctttactaacccgtatacccgtacgtaacggaacctaaacccgaaccgaaaccgtaaacggtaaaccctttcccggaagtactacttacggtacgaaactaaaggtacaacgtctagtacggacgaccggaccggaaggaccgtaacgttcgtttaatacgtttagaccgtcggaagtaggaaggtaaccggttggtaccgggtacgtttacggtacgtacgggggtccgaaccgggttaccggcccggtagtaaccccgg

SEQ ID NO: 184721 - DNA, 579 bp, Homo sapiens
  misc_feature: GYAE6OF02HCJMB.37.57.F02.1.454.CMB.1.raw
  modified_base (575)..(575): a, c, t, g, unknown or other
  misc_feature (575)..(575): n is a, c, g, or t
  modified_base (577)..(578): a, c, t, g, unknown or other
  misc_feature (577)..(578): n is a, c, g, or t
tcagtagtgtagatcacgaccggtgctcgatttagctcgatatagttgggtctgggggaggcctcgtccagcctgggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggctatttatactgcgcgagagaaggctgggcggtttcgacgtacgtggggccaagggaaccctgggtccaccgtctcctcacgccctaccaccgaacggcccagttccggtcctccccgtggccgcccctgccctccgaggacgccacctccggagacgcacgacgccggcccgtgggcctcggccctgggtaccgaacggtaccttaccgtccaatcctaacacctacgtgacggtcggcgtcggaccgtaaggccgacgaagtacgncnnc

SEQ ID NO: 184722 - DNA, 820 bp, Homo sapiens
  misc_feature: GYAE6OF02II53S.37.57.F02.1.454.CMB.1.raw
  modified_base (218)..(218): a, c, t, g, unknown or other
  misc_feature (218)..(218): n is a, c, g, or t
  modified_base (267)..(267): a, c, t, g, unknown or other
  misc_feature (267)..(267): n is a, c, g, or t
  modified_base (286)..(286): a, c, t, g, unknown or other
  misc_feature (286)..(286): n is a, c, g, or t
  modified_base (814)..(814): a, c, t, g, unknown or other
  misc_feature (814)..(814): n is a, c, g, or t
tcagtagtgtagatcacgaccggtgctcgatttagctcgatatagttgggtctggggaggcctcgtccagcctggggggtccctgagactctcctgtgtagcctctgaacttccccttttacggcttattggatgagctgggtccgcaggctccgagggaaggggctggagtgggtgccaacataaagcaagatggaagtaagaagagtatgtgactntgtgaaggtccgttcaccatctccaagagacaacgccaagaactccgtnactatctgacaaatgaacngtctagagacgccgaagaccgacggtactttagtttacttacgtcggcgacgacggaaggaaacgggtaccgtggggttaccggttttacgaccttaacggtcgggggacccgaaacgggggaccctttacgggtacccctaccgtttccgtccctaccgtacccggtacccctacccgaaacccgggaacgggttccctacggtaaccgtttcccggtttacccccgtttccccccggttcgggacccccgtccccgtttccggacccttacccgggaacgggtaccgtacccctacccggtaacccgggtaaagacccggtacccgaaccggaccggggcccggtccccgggttacgggggtccccttccgggtacccgggttacgggttaaccgtaaccggggttaaccctttacccgttaaccccgtattaccccggttaaccctactttaccggtccgggaacgggttcccggggtaaccggtcgggaacccgggtaaccgggacgtacccggtaataccggngacgcg

SEQ ID NO: 184723 - DNA, 672 bp, Homo sapiens
  misc_feature: GYAE6OF02GF9GB.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccagtggaagttggggctgagcttgggttttccttgttgcttattttggaaggtgtccagtgtgaggtgcaattggtggagtcgtgggggaggcctcgtcagccgtcgggggtccctggagacctctcctgtgtacgcctctagtaacctttccccgttacggtcctttaattggatggagtcgtcgggtcccgaccgtaggtcctaccggaaggggtaggggtccgtgggtagggtcgggtacgaccaaacgaagtaaaacggactaaagagtaggaaagtaaaggaaggtagtagtggtacggactggtagtaggacgggtaccctttaccgaacctagtcctaacgagaacgaaccaaccgaccaaagaccctcgtgactatacagaactaatacgaactagtcgtaggaagtacgaccgaaggtaccgacggttaattaacgtttaactacgtcgacgaaggtagaacggtagggtaccgtggggttaaccgtcgtaccggtcggtaccgggaacgtaccggtacgtcccgtacccg

SEQ ID NO: 184724 - DNA, 716 bp, Homo sapiens
  misc_feature: GYAE6OF02JY0DZ.37.57.F02.1.454.CMB.1.raw
  modified_base (624)..(624): a, c, t, g, unknown or other
  misc_feature (624)..(624): n is a, c, g, or t
  modified_base (660)..(660): a, c, t, g, unknown or other
  misc_feature (660)..(660): n is a, c, g, or t
tcagtagtgtagatcacgaccggtgctcgatttagctcgatatagttgggtttggggtctcagagaggagccttagccctggactccaaggcctttccacttggtgatcagcactgagcacagaggactcaccatggaattgggctgagcgttgggttttcctgttgctagttttggaaggtgtccagtgtgaggtgcaattggtggagtcgtgggggacgcctcgtccagccgtgggggtccctgacgactcgtcctgtgtagcctctgaacttcccgttaggctttagtggactgagtcgtcgggtacccgtccgaacggcgtacccgagggggtaacgggccggttagggaacggttcgggggttacggaccccgtaaacgtaaagttaaaacggaccgtaaaaggtacgttaacggggaaaggttaaaacgggaaaggggtaagttaaggtacggtaggggaactttcgtagggtacggtaacgggggtacccgtttacgaccttaagtccgtaacccgaggaacgtaaacgaaaccccgtcgaaaacggtaccgtccggtagtactaacgtcgacgtactaaagtacgtaaacgtcgtgtacgaggcacccggagaccnggtaccttagttacgcgtgccgagagacgtaacggngtcgggttccgacgttacgtacggcgggaccaaccgggtactgggaccctacccgg

SEQ ID NO: 184725 - DNA, 606 bp, Homo sapiens
  misc_feature: GYAE6OF02FZHYE.37.57.F02.1.454.CMB.1.raw
  modified_base (131)..(131): a, c, t, g, unknown or other
  misc_feature (131)..(131): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactnaccatggaattggggctgagctggttttccttgttgctattttggaggtgtccagtgtgaggtgcaattgggtggagtcgtgggggagcctcgtccagccgtgggggtccctgagactctccgtgtgtacgcctctagaactttcccctttacggcttagttggattgacgtctcgggtccgccgaggctccgaggggaggggtcgtgggaggtggggtcggcctaacaagtaaacgcgaaagataggaaagtaagaaggagtatggtaggactgtaggtaggaaggggtcctttaccaccgattccgtccaaggacgaaacgaacgcccgaaagtaacctcgtagctatcagacaaatgtaaacagtcgtaggacgacgcggaacgacgactcgttaattactagtcgacgagaagagtaacggcggttggtcgttacgagttcggcgggaccgacggtaccgtcgtctacccg

SEQ ID NO: 184726 - DNA, 692 bp, Homo sapiens
  misc_feature: GYAE6OF02JEWBD.37.57.F02.1.454.CMB.1.raw
  modified_base (374)..(374): a, c, t, g, unknown or other
  misc_feature (374)..(374): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccagtggaagttgggctgagcgttggttttccttgttgtcttagttttaggaggtgtcagtgtggaggtgacgtaagttggtggtagttcggtgggggacgtccgtcgtccgaggccggttcgggggtccctggacgtacctccgtccgtggtgtacgtccttcgtgtaaccgtttcccgtttacggtctttagttgatgagtcgtggtcccgccgaggccgacggaggggacggcgtgggnggtgggtacgaccaaagagtaaacgacgaaagtagtaaggaaagtaaaggaggtaataggttaggtagtacgttcgtggtaacggtaaccggttctaccgtacgtacgttaccgacgaaggtaccgaaccctaacaccggtaaacgccgtaccgatacgtactcgttacgaaacctaaagacgtaaccgtgtacgtgaaccggacgccggtaagcccgtaacgttaacttaagtttaacgtccgtagcccgtagagtaagggaacggtcgtgggttaccttcgaacgtggacccggcaacggttccctgggatccccg

SEQ ID NO: 184727 - DNA, 749 bp, Homo sapiens
  misc_feature: GYAE6OF02HSR28.37.57.F02.1.454.CMB.1.raw
  modified_base (198)..(198): a, c, t, g, unknown or other
  misc_feature (198)..(198): n is a, c, g, or t
  modified_base (558)..(558): a, c, t, g, unknown or other
  misc_feature (558)..(558): n is a, c, g, or t
tcagtagtgtagatcacgaccggtgctcgatttagctcgatataggttggggtttgggggtctcagagaggagccttagccctggactccaaggcctttcacttggtgatcagcactgagcacagaggactcaccatggaattggggctgagcttgggttttccttgttgctattttggaagtgtcagtgtgaggtgnaagttggtggagtcgtgggggagcctcgtcacgtccgtgggggtccctagacgactcgtccgtggtcgtacgcctacgtgtaactttccccgtttacgctttaagttgagtgacgcgtcgggtcccgaccacggtctaccggagggggacgggtcgtgggtaggtcgggtacgggacctaaacgaagttaaacgctaaaggagttaggggaaaacggtaaaggaacggtaacggttagtacgggtacgggtactttacgtcgggttaaggtaacggggtccgtttaccgaccgtaacgttctaccgaagtaaccggaaccgtaaaccggaccaaacgtaacgttacccgtggaacccgtnttaccggagtaacctaaaaggttaccgaaacgtacgtcgtaaagtaacggaccggtaccggaacggtaccgacggtaactttacgtttaactaccgtcgggacgaggaacgagggtaaccgtaacggtcgggttaaccggttcgaccggtacggtccgggaaccggtacggaaccgttcggtaactcccgg

SEQ ID NO: 184728 - DNA, 764 bp, Homo sapiens
  misc_feature: GYAE6OF02I3QUN.37.57.F02.1.454.CMB.1.raw
  modified_base (147)..(147): a, c, t, g, unknown or other
  misc_feature (147)..(147): n is a, c, g, or t
  modified_base (234)..(234): a, c, t, g, unknown or other
  misc_feature (234)..(234): n is a, c, g, or t
  modified_base (340)..(340): a, c, t, g, unknown or other
  misc_feature (340)..(340): n is a, c, g, or t
tcagtagtgtagatcacgaccggtgctcgatttagctcgatatagttgggtctgggggaggcctcgtccagcctggggggtccctgagactctcctgtgtagcctctgaacttcccctttacggcttattggatgagcgtgggtccnccgaggctccgaggggaagggctgggtagtgggtggaccaactataaagcaagagtaggaaagtaaggaaggagtatggtaggactntggtacggaacgggtccttacaccattccacgagacaaccacgaccaagtacctccgtagcagtcagacaaatcgaacagtctagagacggacgtagacgacggtntatttacgtactcggacgtaggaaggaaggaacgtcggtgggtaccggtttacgaaccggtacggtacggggaccgtaaccggggtaaccttgggaaccctaccgggttcctaccggtaccgtacccggtacctaaccccggaacgtaaccccgggggtaccctttaagggtccccgtttaccccgttaccccggttccggaccccgttccccgtacgtacccgtaaccggacgtaccggtacccgtacccgtaccgtacggaccgtaccgaccggtaccgaccggcccggtcggtaccgtcgtaccggtacgtaccgtaacggtaccgttaaccgtcctaacgttccgtaactacgttacggccggtaacggtcggtaccgtacggtacggaacggttccgaacggtcgtaacggctagatcg

SEQ ID NO: 184729 - DNA, 612 bp, Homo sapiens
  misc_feature: GYAE6OF02G9YNO.37.57.F02.1.454.CMB.1.raw
  modified_base (271)..(271): a, c, t, g, unknown or other
  misc_feature (271)..(271): n is a, c, g, or t
  modified_base (314)..(314): a, c, t, g, unknown or other
  misc_feature (314)..(314): n is a, c, g, or t
  modified_base (354)..(354): a, c, t, g, unknown or other
  misc_feature (354)..(354): n is a, c, g, or t
  modified_base (452)..(452): a, c, t, g, unknown or other
  misc_feature (452)..(452): n is a, c, g, or t
  modified_base (465)..(465): a, c, t, g, unknown or other
  misc_feature (465)..(465): n is a, c, g, or t
  modified_base (469)..(469): a, c, t, g, unknown or other
  misc_feature (469)..(469): n is a, c, g, or t
  modified_base (519)..(519): a, c, t, g, unknown or other
  misc_feature (519)..(519): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagcgttgggttttccttgttgcttattttggaaggtgtccagtgtgaggtgctaagttggtggagtcgtgggggagcctcgtccagccgtcgggggtccctgacgactctcctgtgtagcctntgaactttccccttacggctttattggatgagcgtgggtcccncgaggcctccgaggggaggggctggaggtgggtgaccaanataaagcgaagataggaaagtaagaaggagtagtgtggactgtggtaggaacgggtcctttacacctatccgacagagaacaacgccaaagacctcgngcatcagacaatnaacngtacaggagcgaccggagaccgtacggtacttatttaagttccgtgacgnggaaggaagggtaacggcggtccgggggttacgtttaccgggaccgttacgggaccgggtacccggaaccgggtacccgttcgggtaaccccg

SEQ ID NO: 184730 - DNA, 630 bp, Homo sapiens
  misc_feature: GYAE6OF02G1LLU.37.57.F02.1.454.CMB.1.raw
  modified_base (431)..(431): a, c, t, g, unknown or other
  misc_feature (431)..(431): n is a, c, g, or t
  modified_base (462)..(462): a, c, t, g, unknown or other
  misc_feature (462)..(462): n is a, c, g, or t
  modified_base (471)..(471): a, c, t, g, unknown or other
  misc_feature (471)..(471): n is a, c, g, or t
  modified_base (487)..(487): a, c, t, g, unknown or other
  misc_feature (487)..(487): n is a, c, g, or t
  modified_base (531)..(531): a, c, t, g, unknown or other
  misc_feature (531)..(531): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtcggggggtccctgagactctcctgtgtagcctctgacttcccctttacggctttattggatgagcgtgggtcccgccgaggcctaccgaggggaaggggcgtgggaggtggggtcggaccaacgagtaaaacgcaaagagtaggaaagtaaggaaggagtatggtgactcgtgtgaagggtccgtttcaccattccnccgagagaacaaccgccgaaagaacctccgngccattccngaacaaagtcgaaacngttcagagacgaccggagaccgacggtcttaatttacttaacgnggaccgtacggaaggtaacggaacggtcggtcggggttaccggtttacggaaccgtttacgggccgggggtaaccaccggggtacccctgggtaccccg

SEQ ID NO: 184731 - DNA, 680 bp, Homo sapiens
  misc_feature: GYAE6OF02HNM52.37.57.F02.1.454.CMB.1.raw
  modified_base (181)..(181): a, c, t, g, unknown or other
  misc_feature (181)..(181): n is a, c, g, or t
  modified_base (490)..(490): a, c, t, g, unknown or other
  misc_feature (490)..(490): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcgtggtttcgtgtaggctatttggaaggtntccagtgtgaggtgcaattgggtggagtcgtgggggaggcctcgtccagccgtgggggtccctgagacctctcctgtgtagcctctagaactttccccttaggtcttattggatgagtcgtcgggtccgacgaggtcctccgaagggggacggggtccgtgggaggttcggggcggtaccaaacaagtaaagcgaaaggagttaggaaaggttaaggaaggtagtagtaggtaggtacctgttagtacggtaacgggtccgtttacacctacgttccacgaggaacacgaacgacaaagaactccgganccgaatcctaagtacgaaattcgaaaacgtgttacgacgacggtacggaccggtaagaaccggtacgttactttaaagttcgttaaacgcggtaacgaccgtaaggtaacgggaaaccgtggtacggggtacgtttaccgacgtacggttacggggaccctaacccgggacctttaggaccttaccccgg

SEQ ID NO: 184732 - DNA, 630 bp, Homo sapiens
  misc_feature: GYAE6OF02FTFOF.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtggggggtccctgagactctcctgtgtagcctctcgaacttcccctttaccggtcttagtttggtatgagtcgtcggggtcccgccgacgtcctccgaggggaaggggcgtgggaggtgggtcggccgaacatacgaggggaggtgggtaggtaacgaaaaactagtggtggactcgtgtcgggccggggccgtagttccacctactccgtcagacaccaaccgaaccaaaaacctcactagtactcagacaaacgtcggacgtccgtagacgacgtaccggaggaccgacggtcgttaggtgttaagttagtggtgacggtagtagtatttaaggtaacttaacggtaacgtttacgaggttacgtacgttggtagtaggtagtcgttattacgg

SEQ ID NO: 184733 - DNA, 861 bp, Homo sapiens
  misc_feature: GYAE6OF02IVVA6.37.57.F02.1.454.CMB.1.raw
tcagtagtgtagatcacgaccggtgctcgatttagctcgatatagttgggtttgaggtctcagagaggagccttagccctggacctccaaggcctttccacttggtgatcagcactgagcacagagactcacatggaattgggctgagcgttgggtttttccttgttgtcttagttttggaaggttgtccagtgtgaggtgctaagttggtggagtcgtgggggaggccgtcgtccgagtccggtgggggtccctgagacctctccgtgtgtacgcctcgtataacctttccccgtttacggtcttagttggatggagtcggtcgggtcccgaccgacggtcctaccgggaagggggtaacggggtcgtagggacgggttacggggtaccgaaccgtaaacgaaagttaaaacgagaaaacgggtaagtaagggtaaaaggtaaagggaaacgggttaagtacgttacgggttacggtaaccgtttggttacgggtacgggtaaacccggggttcccgttttaccgaacccgtacgtttacccccgtacgaaaagggaacccgtaaaccccgtaaacccggtaaccccgtaaaacgtaccccgttccggtagacccttaaggttaccgtaacgaaaccgttaaaacgtacggtaaaccctacggttaacggaacggaagggtacccggaaccgggtaaacgggtaccgttaaaccgggtttcttttaaagttttcccgtaacggtccggacggtaacggagggtaacgggtaaccgggttcggttagggggtttcccgttaggacccgggttacgggtaacccgggggcccggtaaaccgggttcccggtgttaaccccgg

SEQ ID NO: 184734 - DNA, 747 bp, Homo sapiens
  misc_feature: GYAE6OF02HHG05.37.57.F02.1.454.CMB.1.raw
  modified_base (431)..(431): a, c, t, g, unknown or other
  misc_feature (431)..(431): n is a, c, g, or t
  modified_base (629)..(629): a, c, t, g, unknown or other
  misc_feature (629)..(629): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaaccagtaggaagttgggctgagtcgttgggtttttccttgttgtctttagttttggaaggttgtcctagttggtaggaggtgactaagtttgggtgggacgtcggtgggggacgtccgttcgtccacggcccggttcggggggtccctggacgtaccttccgttccgtggttcgtacgtccttcgttcgttaacctttccccgtttacggtctttagtggatgacgtcggttcgggtcccgcgaggtccgacggaagggggacgggtcgtggggtaggttcggggtacgaaccgtaaanaagtaaacgacgaaggacgtaaggaaagtaaagggaaggtagtagtggtacgtactacggttaggtacgaacgggttccttaccactcgtccgtacgaaagtaccgaaacgtaccgaaccgaaataccgtccgagacctgtctaacgaactaaagcgaaacgtcgtacgtaggaacgcggaacgacgtaccgaggttnttaaacgttcgtagtcggcaggtaagaacgggtacggttccggttaggggtacctttacggaccgtttaaggggcccgggttaaccggaaccgggttcccgtacggtccccgttccgg

SEQ ID NO: 184735 - DNA, 789 bp, Homo sapiens
  misc_feature: GYAE6OF02JES7V.37.57.F02.1.454.CMB.1.raw
  modified_base (221)..(221): a, c, t, g, unknown or other
  misc_feature (221)..(221): n is a, c, g, or t
  modified_base (626)..(626): a, c, t, g, unknown or other
  misc_feature (626)..(626): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaagttgggctgagtcgttgggttttccttgttgcttagttttggagtgtaccagtgtgaggtgactagttggtggagttcggngggggacgccgtcgtaccgaggccggtcgggggtccctaggacgacgtccgttccgtggtgtacgtcctcgtacgtaacctttccccgtttacggtactttagttacggtatcggtacgtcggtcgggtacccgccgaggtcccgtacgggaacgggggacgggtccggtaggggtaggtcggggtacgtaacccgaaacgtaagtaaacgtacggaaaagaggtaaacggtaaaagtaagggtaaaggtacggttagtacgggtagttacgttacgggtaggtacgggtaaccgggttcccgtttaccgaccgtttaacctaccgtacgaacgtaacgaacccggtaaacgacccgtaaacgtacccgtacggttaccgactacgtagttacgaactaacgtanaaaccgtgtactagggagtaccgcggaacgtaaccgtagtactttactttacgtacgtcggacgtacgaagggtaccggtaacgggtcggtcgggttacccggttagtacccggtacgggtacgggacccggaacggggtaccccggttcgaccggttacccg

SEQ ID NO: 184736 - DNA, 589 bp, Homo sapiens
  misc_feature: GYAE6OF02FWT6U.37.57.F02.1.454.CMB.1.raw
  modified_base (315)..(315): a, c, t, g, unknown or other
  misc_feature (315)..(315): n is a, c, g, or t
  modified_base (413)..(413): a, c, t, g, unknown or other
  misc_feature (413)..(413): n is a, c, g, or t
  modified_base (577)..(577): a, c, t, g, unknown or other
  misc_feature (577)..(577): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (585)..(586): a, c, t, g, unknown or other
  misc_feature (585)..(586): n is a, c, g, or t
  modified_base (588)..(589): a, c, t, g, unknown or other
  misc_feature (588)..(589): n is a, c, g, or t
tcagtagtgtagatcacgaccggtgctcgatttagctcgatatagttgggtttggggggtccctgagactctcctgtgtagcctctgaattcccctttacggcttattggatgagctgggtccgccaggctccagggaaggggctggagtgggtggccaacataaagcaagatggaagtaagaaggatatgtggactctgtgaagggccgtttcaccatctccagagacaacgccaagaactccgtgcatctgacaaatgaacagtctgagacgccgaaggacacggacttatttatactgcgagaagagaaggngtgggtcgtttacgacgtacgtgggaccgaggaacccgtggtccaccgttctcctcacgccctccaaccgacggccctagtccggtcccttaccccgngcccgcctcgctcccaggacgccacctccgagacgacacgacgccgtcccgtcgggcgtcgtccgtacgtacgaacgtaccttaccttaccgtacttacctactacctacgtacggtaaggccggtacgtacggaccgacggaccgacgaacgtaggctacagngacnancnncnn

SEQ ID NO: 184737 - DNA, 695 bp, Homo sapiens
  misc_feature: GYAE6OF02IIRLC.37.57.F02.1.454.CMB.1.raw
  modified_base (196)..(196): a, c, t, g, unknown or other
  misc_feature (196)..(196): n is a, c, g, or t
  modified_base (685)..(686): a, c, t, g, unknown or other
  misc_feature (685)..(686): n is a, c, g, or t
  modified_base (689)..(695): a, c, t, g, unknown or other
  misc_feature (689)..(695): n is a, c, g, or t
tcagtagtgtagatcacgaccggtgctcgatttagctcgatatagttgggtttgggggtccctgagactctcctgtgtagcctctgaatttcccctttacggcttattggatgagctgggtccgccaggctccgagggaagggctggagtgggtggccaaacataaagcaagatgggaagtaagaaggagtatggnggactctgtggaacgggtccgtttcaccatctccgagacgaacaaccgaccaaagaacctccgtgcatctgacaaagtgaactgtctaggagagccgaaggacgacgtacttatttacttactgcgacgagaagaaggacgtgggtccggtttcgacgtacgtcgggccgaacggaccgtcggtaccaccgttcctcctccgacgccctacccgaaccgacgggcccctaacgtcccggttacccgtttcccccgtcggccccgtcccgtacgtcccgtaccgtacggacccggtacgtacccccgtccggagaccgaaccgaccggtacgggacccggtcccggtcggggtaccgtccggttcccgtacgggtaaccgtaaacgggtaacccttaccgttacccgttactttacccgtaacctaaccgttaccgtacgggacggtcccgggttcgcggtaccggacggacggtcgaacgttagcgagnngcnnnnnnn

SEQ ID NO: 184738 - DNA, 802 bp, Homo sapiens
  misc_feature: GYAE6OF02H2GI8.37.57.F02.1.454.CMB.1.raw
  modified_base (323)..(323): a, c, t, g, unknown or other
  misc_feature (323)..(323): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaagttgggctgagtcgttgggttttccttgtcgcttagtttttggaaggttcgtccagttgtggaggtgactaagttggtgtacggtcggttgggggacgtcctcgtccgacggtcccggtcgggggttccctaggacgtaccttcgtccgtgtgactccttctgtaaccttttcccgttacggtnttacgtgaactgtacgtcggtcggccgacgcgtacgtaccggaaggggacgggtcgtagggtcgggtcggggtcggtaaccaaaacgtacgttaaaacgacgaaaaggttacgtaacgggaaaaggtaaacgtaaagggttcgttaacggtaagggtcgttacgtcgtaggggtacggggttaccgggtttccctttaaccgaccgttacgttacccgtaacggacgttaaaccgggaaacccgaaacccgaaccgtaaaccgttaacccgccgttaaggtaccctagtactacgtaaccgtaaagcgtaaacgtcgttacgagtaacggacggccgaagtacgaccggttattaacgtttacgaccgttcgacggtaaggaacgtaacgggtaacggttccgggtaacggggttccgttaccggttacggtccggggtacccggtaacgggtacccggtacccggttgtaacccccgg

SEQ ID NO: 184739 - DNA, 973 bp, Homo sapiens
  misc_feature: GYAE6OF02IK9TW.37.57.F02.1.454.CMB.1.raw
tcagtagtgtagatcacgaccggtgctcgatttagctcgatatagttggggtttgggggtctcagagaggagccttagccctggactccaaggcctttccacttggtgatcagcactgagcacagaggactcaccatggaagttggggctgagcgttgggttttccttgttgcttattttggaaggtgtccagtgtgaggtgctaagttggtaggagttcggtaggggggacgtccgtcgtccgacggtccggtcgggggggtcccctggacgtacctcctccgtaggtgtacgcctctagtaactttccccgtttacggtctttacgttggactggagtcgtcggggtcccgaccgacgttcctaccgggaagggggtaacgggggtcgttaggggagggttcggggtacggaacccctaaaacgtaacgttaaaccggtaaggggggtaggggttacggggtacgggtaaaaaccggtaaaaaaacgtaaggtttagggtaacggttaaccgttcggtacgggttacgggggtccccggggggtaacccgttaagttttaccccgaaacccttaacggttttccccgtaacccgtaaacgggtaacccggaaaacccgtaaaaccccgggtaaaaaccccctaaaaaaaacccgttcccgttaaaacccgtttacggtttaaccgttacccgttaaaccgaaacgttaaaaacgggttacccggggaacccgggtaacccgtacgggtaaacgggaacccggtttacccgggaaaccgggtaaccgggtaacccggggttacgttacggtttaaccggtttaaagtttttaacggttagggtttaccggacgggtaaccggttaggtttaaaccgtttaaggtaaacccgttaaacgttaaacgggttttccggaaacggttacggtaaccggtttaggtaccgttaggtaacgttggttaattttaacgg

SEQ ID NO: 184740 - DNA, 701 bp, Homo sapiens
  misc_feature: GYAE6OF02GBTDZ.37.57.F02.1.454.CMB.1.raw
  modified_base (382)..(382): a, c, t, g, unknown or other
  misc_feature (382)..(382): n is a, c, g, or t
  modified_base (618)..(618): a, c, t, g, unknown or other
  misc_feature (618)..(618): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcttgggttttccttgttgcttattttggaaggtgtccagtgtgaggtgctaattggtggagtcgtgggggaggcctcgtccagccgtcggggggtccctgagtactctcctgtgtacgcctctgtaactttccccgtttacggctttagttggatgagtcgtcgggtcccgccgaggcgtccggaagggggaacggggcgtaggggtacggttggggtacggacccgaaanaagtaaagaccaaagagtagggaaagtaaggaaggtagtagtagtggactacgtaggtacggacgggttaccgttacaaccgtactacctaccgaaggacgaaacccgaaaccggacccgaaagtaacccgttccggtagaccctacgttacgtacgaactaaagttacgaaacgtgttacgtaggaacggtacggcccgggaaggaacccgtaccggtatttaagtttactacgngaccggagaagacggtaaggtcggttacgggtacgttacgacgttacggcgggacccgtacgggaccttcgggacctacccgg

SEQ ID NO: 184741 - DNA, 695 bp, Homo sapiens
  misc_feature: GYAE6OF02GJTEN.37.57.F02.1.454.CMB.1.raw
  modified_base (266)..(266): a, c, t, g, unknown or other
  misc_feature (266)..(266): n is a, c, g, or t
  modified_base (310)..(310): a, c, t, g, unknown or other
  misc_feature (310)..(310): n is a, c, g, or t
  modified_base (399)..(399): a, c, t, g, unknown or other
  misc_feature (399)..(399): n is a, c, g, or t
  modified_base (512)..(512): a, c, t, g, unknown or other
  misc_feature (512)..(512): n is a, c, g, or t
  modified_base (660)..(660): a, c, t, g, unknown or other
  misc_feature (660)..(660): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcctgggttttcctgttgctattttggaaggtgtccaggtgtgaggtgcaattggtggagtcgtgggggagcctggtccagccgtgggggtcctggagactctcctgtgtagcctntaggactttccccttaggcttattggactgaggtcctgggtccncgaggctccgagggagggtctgggacgtgggtcgaccaagtagtaaacgcaaacggagttggaaaacgttaaaggaagggtacgttagnggtacgggactaggtgtaacgggaacgggtcccgtttacgaaccctgtaccgttaccgaaagggtaccgaaacggaaaccaccggtaaagtaaccccggttccggtaagaacncgttaaccgttagaaccgttaaagccgtaaacgtgttcctagggaaccacggaccggtaagacgcgttaacttaattttacgcggtacgtaacggcggttaaggaaccgtcggttaaggccggggttactacgacgttgggacccggnggttaaccgggaccttaggggtacccctacccggg

SEQ ID NO: 184742 - DNA, 652 bp, Homo sapiens
  misc_feature: GYAE6OF02JKCAA.37.57.F02.1.454.CMB.1.raw
  modified_base (178)..(178): a, c, t, g, unknown or other
  misc_feature (178)..(178): n is a, c, g, or t
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
tcagtagtgtagatcacgaccggtgctcgatttagctcgatatagttgggtctgggggagcctcgtccagcctggggggtccctgagactctcctgtgtagcctctgaacttcccctttaggcttattggatgagctgggtccacaggctccgagggagggctggagtgggtgccaanataagcaagatggaagtaagaggagtatgtgactctggtagacggtccttacaccntcctacgaganaccgacgacctaagactccgagactatcgtagacaaagtcgaactagtctaggacgacggaccgtaggacctacgggtcttggtaagttatttcgtgtggacgataaggttatttaacgaacccgttagttaaaaggttccgtagactacgttaggtattgtagtagttaccttagtaacctacggttacccgggtaggggacccctaaaagggtccgtagttaccgggtaaccctcgttcgttcttacgccgtaccctacggaccacggccctagtcccttcctccccgtgcttcccagcctacggtacgccgaccgcccgtaagcgctaccacgtaccgggtccgccggtacgtcgcggtcgtaggtaaccacgtcctacttccacttacgtacctactcgacgg

SEQ ID NO: 184743 - DNA, 826 bp, Homo sapiens
  misc_feature: GYAE6OF02GJ8HY.37.57.F02.1.454.CMB.1.raw
  modified_base (682)..(682): a, c, t, g, unknown or other
  misc_feature (682)..(682): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctatttggaggtgtccagtgtgaggtgcaattggtggagtcgtgggggaggcctcgtccagccgtggggggtccctgacgactctcctgtgtacgcctctgaacttcccctttacggcttattggatgacgtcgtcggggtcccgaccgacggccgtccggaaggggagggggtccgtaggggtaaggttgggggtcggacccaaacgaaagttaaacggcgaaaggacgtaggggaaaggtaaaggaacgggtaagtagttgggtaggacgtcgtggtagggaaacggggttccccgtttacaacccgtacgttacccgtaccgaaaggtaaccgaaaccgtaaacccggacccgtaaaaacgggtaaccccttacccggggttagaaccccgtaagttacccggtacggtaacctaaaacgggttccgggaaactaacgggtttccggtaaggaacgggaaccgggaccgggaacgggaccgtaaccgggttacttttaaatttacgttacnccgggtaccggaggtaaggaacgggtaaacgggtaccgggttcgggggttaacccggttttaccggtaaccggtttacggggtaccgggggtaacccgaaacccggggggttaccccgtttcggggtaaccccgtttaccccgg

SEQ ID NO: 184744 - DNA, 857 bp, Homo sapiens
  misc_feature: GYAE6OF02IMJQL.37.57.F02.1.454.CMB.1.raw
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
  modified_base (323)..(323): a, c, t, g, unknown or other
  misc_feature (323)..(323): n is a, c, g, or t
  modified_base (737)..(737): a, c, t, g, unknown or other
  misc_feature (737)..(737): n is a, c, g, or t
tcagtagtgtagatcacgaccggtgctcgatttagctcgatatagttgggtttggaggtctcagagaggagccttagccctggactccaaggcctttccacttcggtgatcagcactgagcacagaggactcaccatggaattggggctgagtctggtttcctgtgctatttggagtgtccagtgtgaggtgcaattggtcggagtcgtggggacgctcgtccagccgtgggggtcctgagtctctctggtgtacnccgtntacggtactttccccgttacgggtctttacgttggaagttgaacgtcggtaccgggttaccncccgtaagggtccgttaccggaaggggggtaaaccggggtcttaggggtacggttcgggggtaccgacccgtaaaacggtaaacttaaaacgggccgtaaacgggtaacggttaaccggggtaaaggttaaaccggggaaaggtacgggttaatttcgggtaacggggtaaccttacgggtggttaacggaaaccggggttccctttaacgaccgttaacgtttctaacccgggtaaagacccgggtaaccgtaaaccgaacccggttaaaggtaaacccttcggtaaccggtaacctagttaccgtttaacggaaactaaacggttacgtaaacgtccggtttacgaggaaaccggccggtaaaccggtaacggtaacccgtaacggtgtttaaaccgtttacgtttaaccgngggtacccggttaaccaagggtaaccggggtaaaccgggttcggttaccgggggttacgttacccgggtaaccttaccgggggttggaccccgggtaacgggttacccgtcggggtaccc

SEQ ID NO: 184745 - DNA, 835 bp, Homo sapiens
  misc_feature: GYAE6OF02JNJ63.37.57.F02.1.454.CMB.1.raw
tcagtagtgtagatcacgaccggtgctcgatttagctcgatatagttggggtttgggggtctcagagaggagccttagcccgtggactccaaggcctttccacttggtgatcagcactgagcacagaggactcaccatggaatggggctgagctggtttccttgttgctatttgaggtgtcagtgtgaggtgcattggtggagtcgtgggggagccgtcgtccagccgtggggggtccctggagaccgtccgtcctggtgttacgccttcgtacggtaactttcccctttaacggtcctttaagttcgggacttggacgtcgtcgggttcccgacccgtaagggtcctcccgaaggggtaacggggcctgggacgtggggtcggaccgaactaagtaaacgccgaacgagtaggtaaacggtaaaggaagggtaggtaactcgggtaggtaacgtcgttaggtaggtaaacggggtcccgttttacgacccgtaagtccttaccgaacggtaacgaaccgtaacccggaccgtaaacggaaaccgttccgtaggtaaccgacgttacgtagtaccgtaaagttaagaaaccgtaacgttacggtcggaaacggtaccggaccgggaaacgggaaccggtaaccgggtaccttttaaacggttttaaaggtttaaccgtcgggttaacggaccggttaaccgggaagggtaaacggggttaccggtttaacggggggttccggtttaaccggttaaaccgggttaaccgggttacccgggggtacccgtaaaccgggggggtaaccccctttacggggttaccccggtaaccccgg

SEQ ID NO: 184746 - DNA, 640 bp, Homo sapiens
  misc_feature: GYAE6OF02I4KDI.37.57.F02.1.454.CMB.1.raw
  modified_base (269)..(269): a, c, t, g, unknown or other
  misc_feature (269)..(269): n is a, c, g, or t
  modified_base (348)..(348): a, c, t, g, unknown or other
  misc_feature (348)..(348): n is a, c, g, or t
  modified_base (464)..(464): a, c, t, g, unknown or other
  misc_feature (464)..(464): n is a, c, g, or t
  modified_base (468)..(468): a, c, t, g, unknown or other
  misc_feature (468)..(468): n is a, c, g, or t
tcagtagtgtagatcacgaccggtgctcgatttagctcgatatagttggggtttgggggtctcagagaggagccttagccctggactccaaggcctttccacttggtgatcagcactagagcacagaggactcaccatggaattggggctgagctgggttttccttgttgcttattttggaaggtgtccagtgtgagtgcaattggtggagtcgtggggggagcctggtccagccgtgggggtccctgagactctctgtgtagcctctnaactttccccttagcttagtgatgagtcgtgggtcccgcgagtcctaccgaggggagggctgggaggtgggtgaccaanataaagcgaaagataggaaagtaagaaggtagttagtggtacgactcgtagtggaacgggtcccgtttacaccgtatcctaccgaagacgaactaaccggacaaacggtacctcgngacngtactgaacaaagtcgaacgactacgtagaagacggaccgtaaggaaccgtaggtctttaacttttacaacgtcacgacgaaggaggtaaacgggtcggttggggttaccggttaccgtaacggttacggtcggggacccgaacggggtaacccccttgggtacccgtcccg

SEQ ID NO: 184747 - DNA, 719 bp, Homo sapiens
  misc_feature: GYAE6OF02GXXM5.37.57.F02.1.454.CMB.1.raw
tcagtagtgtagatcacgaccggtgctcgatttagctcgatatagttggggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagccgtgggggtccctgagactctcctgtgtagcctctgaacttccccgtttacggtcttattggatgagctgggtcccgccagggcctccgaggggaacggggcgtggagtggggtggaccgaacagtaaagcaaagtagtaggaaagtaaggaagggtagtagtggtaggactcgtaggtaggaagggtcccgtttacaccgtatcctccgaagacgaaccaaccgtacccgaaacgtaaacctcccggtagacccgtattccgtaagacctaaaagtcgaaaccgaggttaccgttaggaaggaaccggtacccggaagggaaccgtaccgggtactttaaacgttttacttaacggtgtacccggtacggaaggtaaggaaacggggtacgttacggggggtaccggttttaccgaaacgggttacccggttacggggggacccgtaacccggggggtaacccgttccgggtaccctaccccgggg

SEQ ID NO: 184748 - DNA, 850 bp, Homo sapiens
  misc_feature: GYAE6OF02IHF61.37.57.F02.1.454.CMB.1.raw
  modified_base (724)..(724): a, c, t, g, unknown or other
  misc_feature (724)..(724): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaagttggggctgagcgttgggttttccttgttgcttagttttggaaggtgtccaggtgtggaggtgctaagttgggtggaggtcggtgggggcggtcccgttcggtccgacggtccggttcgggggggtcccctaggacggtacttccgttccgtggttcgtacgtcccttcgtagtaaccgtttccccgtttacggtctttacgttggtagtggagtccggttccggggtcccgccgtacggtccgtaccgggaagggggaacggggtccgttgggtaagggtcgggggtacgggaaccaaaacggtaaaactaaaacggacgaaaaggtaagtaagggtaaaaggtaaaagggtaaagggtaaggttaaggtaggtaggtaaccttacggtaggtaacgggtaacgggttcccgtttaccggaacctacgttacccgtaccgaaaggttaaccgaaaccgtaacccgaacccgtaaaagtaccccggttaccggtcggtaacctaacgttcgtaaccgaaacgtaaagtcgaaaacgtcgtacgtagggaacgtaccggaacccggaaaggaccgtaaaccgttntttaaagtttaccgtacgtacgcgggaaaccgagggtaaacggaaggttcccggggttggtacccgggtttaaccgagtcccgggtaggggaacccggttaaccgggacccgttaccggtacccgg

SEQ ID NO: 184749 - DNA, 741 bp, Homo sapiens
  misc_feature: GYAE6OF02JOERI.37.57.F02.1.454.CMB.1.raw
tcagtagtgtagatcacgaccggtgctcgatttagctcgatatagttgggtttgggggtcgtcagagaggagccttagccctggactccaaggcctttccacttggtgatcagcactgagcacagaggactcaccatggaattggggctgaggcgtgggttttccttgttgctattttggtaaggtgtccagtgtgaggtgctaattggtgagtcgtggggagcctcgcacgccgtggggtccctggacgactctcctgtgtacgtcctactgtaacttccccttacggccgtttagttggactgagtcgtgggtccgaccgtaggcctcgacggggtaaggggctaggggacgtcggggtagacccgaaaacgtagtaaaacggtcgaaacggtaggtagggtaaacgtaaagggtaaaggtaagtgtaggtaggtaacgtcgtagtagggaaacggttcccggtttacaaccgacgtttccgaaccgtacgaaacggactaaacccgaccgtaaaacggtaaccgtccgacgtaccgtaacgttcgacggtaacaaagttacccgaagtacgtacgttaggaacacggtacccggaggaaaccgtaacggtacttttaacgttaacttacgtacgggccgtacggtaacgtaacgggtaagggtaaccgtgggggtacgttaaccgtacgtttaccgggacgggtacgaccgggtaaccggttcgacccggttacccgg

SEQ ID NO: 184750 - DNA, 931 bp, Homo sapiens
  misc_feature: GYAE6OF02F5CIB.37.57.F02.1.454.CMB.1.raw
  modified_base (267)..(267): a, c, t, g, unknown or other
  misc_feature (267)..(267): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaattgggctgagctgggttttccttgttgcttatttggaaggtgtccagtgtgaggtgcaattggtggagtcgtgggggagcctcgtccagccgtgggggtccctggagactctccgtgtcgtacgcctntcgtaactttccccgtttacggcctttagttcggtatgagcgttcgggtccgccgacggccgtccgaagggggaagggccgtagggaggtcggggtcggtacccgaaaccgaagtaaaaacgccgaaaggtaagtagggtaaagtaaaggaaaggtaagtaacgtggtacggtactcgtaggtaacggtaacggggttcccgttttaccgaaccgttacgttaccctaccgtaaaggacgtaaaccccgaaaccggtaccccgtaaaaaggtaacccgttaccccggtagtacccgtaaccgtttacccgtaacgggttaaaccctaaaaacggttcgtaaaaaccccgtaagggttttacccgttaaagggggaaacggtaaacccggggttaccccggggaaaacgggtacccgtaaaacccggggggtttaccttttaaaacggttttttaaaccggttttacccggtaacgggtccccgggtaacggggaaaaacggggttaaccgggtaaaaaccgggggttaacccgggtttaccgggggggtttaccccgggttttttaacccggaaacccgggtttaacccggggtttaacccgggggggaaccccctttaacccggggggggtaaccccccgtttcggggtttaaacccccccgg

SEQ ID NO: 184751 - DNA, 849 bp, Homo sapiens
  misc_feature: GYAE6OF02GA1Y2.37.57.F02.1.454.CMB.1.raw
  modified_base (673)..(673): a, c, t, g, unknown or other
  misc_feature (673)..(673): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggacctcaccagtggaagttggggctggagtcgttgggtttttccttggttgtcttagtttttagggaaggttcgtccgagttggtaggaggtgtactaagtttgggtggagttcggtggggggacggtccgtcggtaccacggtccgggttcggggggttccctaggacgtacttcctccgtgtagtcgcctcgtagtaacctttccccgtttacgtctttagtttggtatcggagtccggttacgggtcccgcccgtaagggtccctacccgggtagggggaacggggtcggttggggacgggttgggggtacggaccaaacgtaaagttaaaacgaccggaaaaggtaacgtaagggtaaacggtaaaaggaaagggtaagtaagttcgggtacggtacgtacgtggtacgggtaaccgggttcccgtttaccacccttatccgtaaccgaaggaccgaacgaacccgaccgtaaagtaacccgttccggtactacccgtaagttccgaacgtaaactaacgtaacgtaaccttagttacccggngaaggccgggtaaccgaaacgggtaaccgaccgggtttaacttttaagtttaacgttacgtcgggaaccggtcgtaaaggaacggtaacggggttacggtacggggttcccggtttaacgtaaccggtcgggttcggaaccccggtagggtaccccggtacggtacccgtaccccg

SEQ ID NO: 184752 - DNA, 685 bp, Homo sapiens
  misc_feature: GYAE6OF02FWVTB.37.57.F02.1.454.CMB.1.raw
  modified_base (269)..(269): a, c, t, g, unknown or other
  misc_feature (269)..(269): n is a, c, g, or t
  modified_base (306)..(306): a, c, t, g, unknown or other
  misc_feature (306)..(306): n is a, c, g, or t
tcagtagtgtagatcacgaccggtgctcgatttagctcgatatagttggggtttgggggtctcagagaggagccttagccctggactccaaggcctttccacttggtgatcagcactgagcacagaggactcaccatggaattggggctgagctgggttttcctgttgctattttggaaggtgtccagtgtgaggtgcaattggtggagtcgtgggggagcctcgtccagccgtggggggtccctgagactctcctgtgtacgcctctnaacttcccctttaggcttattggatgagctgggtccncgaggctccgagggagggctggacggtgggcgacaacaagtaagacaagacgtaggaaagtaaggaacggagttatggtaggacgtagtgggtagtaacggggtcctttacaccgtagtacctaccggaaagaccgtaaccgaaaaccgggtcccgtaaaaagtaacccgtcccggtaggaacctaacgttacctaaggaacctaaaagttccgaaacgtacgttccgaaggcggaaacggacccggtaagggacccaacgggttcctttaaaacgtttctttagacgaccggtaggaacgtaggaacggtacggttcgggtaccgtttacgaacgttcggcggggtaaacccgtcgggaacccttggaccgtacccgg

SEQ ID NO: 184753 - DNA, 836 bp, Homo sapiens
  misc_feature: GYAE6OF02GSHTQ.37.57.F02.1.454.CMB.1.raw
  modified_base (243)..(243): a, c, t, g, unknown or other
  misc_feature (243)..(243): n is a, c, g, or t
  modified_base (607)..(607): a, c, t, g, unknown or other
  misc_feature (607)..(607): n is a, c, g, or t
tcagtagtgtagatcacgaccggtgctcgatttagctcgatatagttgggtttggggtctcgagagaggagccttagccctggacctccaaggcctttccacttggtgatcagcactgagcacagaggactcaccatggaatgggctgagcttgggttttccttgttgtcttattttaggaagtgtccagtgtgaggtgcattggtggagtgtggggagcctcgtccagccgtcgggggtccngacgactcctcctgtcgtacgtcctcgtacgtaacctttccccgtttaacggctttagtggatacgagtaccggttccgggtcccgacccgaacggtcccgttaccggaacgggggtaacggggtcgtaggggtaacggttggggtacgggaaccgtaaaacgtaaacgtaaacggaccgtaaaggtaacgttaagggtaaaacgtaaaggtaaaggtagttaaggtcggttacgggtacttcggttaggtaacgggaaaccgggtttcccggtttaccaacccgtacgttaccgtaacccggaaaggtacccggaaacctaaccccgggaacccgtaaaaacggtaccccgttaccggggtanaacccttacgttcgttaaacggaaacctaaaacgtacgtaaaacgtcgtccttaagggacggtaaccggtaacccgggaagtaaccccggtaacgggtaaccttttaggtttaaaccttcgacgggactacgggtaacggtaagggaacgggttaccgggttacggggtaccgtttacgaaaccgttcgggacgggtaccgaacccggggttactcggtaacctccccg

SEQ ID NO: 184754 - DNA, 806 bp, Homo sapiens
  misc_feature: GYAE6OF02J3HS7.37.57.F02.1.454.CMB.1.raw
  modified_base (218)..(218): a, c, t, g, unknown or other
  misc_feature (218)..(218): n is a, c, g, or t
  modified_base (318)..(318): a, c, t, g, unknown or other
  misc_feature (318)..(318): n is a, c, g, or t
  modified_base (662)..(662): a, c, t, g, unknown or other
  misc_feature (662)..(662): n is a, c, g, or t
tcagtagtgtagatcacgaccggtgctcgatttagctcgatatagttgggtttgggggtctcagagaggagccttagccctggactccaaggcctttccacttggtgatcgagcactgagcacagaggacctcaccatggaattgggcctggagtcgtaggttttcctcgtagcttagttttggaagttgtaccagtgtcgtagtgcgtaacgttggnggtagtcggtggggacgcctacgtccaggtcccgttcgggggtcccaggtacgacttcgtccgtgtagtcgtcctcgtacgtaacctttcccgttacgtnttaagttcgagtggactccggtcggtccgccgacggctaccgggagggacggtgtgggtaggtcgggtacgaccctaagtaacgtaaggaccgaaggtacgttaaggaaacggtacggtaaggcgttagtacggtacggacttaggtacggtaggtaacccggtccgttacaacgtctacgacgtaagacctaacgaccgtaacgaagtaccgtacgtagacctacgtacggactaacgtaattacgacgtaacggtctaaccggaggtaacccgacgggaacgtacggttaacccgtttacgttttaaaaccgtttcggaaccgggtacgacccggggttaanaccggggggttaaaccggtacggttaaccccggggtggtttttaaacccccgggtaacggtaccggggttaacccggggttcccggggtaaaccccggtaaaccccggggttcccggttacccggttaaccccttcccccgggg

SEQ ID NO: 184755 - DNA, 773 bp, Homo sapiens
  misc_feature: GYAE6OF02HO1KG.37.57.F02.1.454.CMB.1.raw
  modified_base (279)..(279): a, c, t, g, unknown or other
  misc_feature (279)..(279): n is a, c, g, or t
  modified_base (757)..(757): a, c, t, g, unknown or other
  misc_feature (757)..(757): n is a, c, g, or t
  modified_base (766)..(766): a, c, t, g, unknown or other
  misc_feature (766)..(766): n is a, c, g, or t
  modified_base (768)..(768): a, c, t, g, unknown or other
  misc_feature (768)..(768): n is a, c, g, or t
  modified_base (771)..(772): a, c, t, g, unknown or other
  misc_feature (771)..(772): n is a, c, g, or t
tcagtagtgtagatcacgaccggtgctcgattttagctcgatatagtttgggtttgggggggtccctgagactctcctgtgtagcctctgaacttcccctttacggcttattggatgagctgggtccgccaggctccagggaaggggctggagtgggtggccaacataaagcaaagatggaagtaaggaaggagtatgtggacttctgtggaagggccgtttcaacctatcctccaagagacaacgaccaaagtaacctccgtgcagtctgactaaaangaacagttctgagacgaccggaggacacggactatttacttacgtgcgcggaagacggaaggacggtggggtacgggttttacgacgtaacggtcgggggtaccgaacggggaaccctggggtacctaacccggttcctacccgttacaccgtcccgtaccccaaccgaaccggggtacccctaacgttcccgggttaccctttccccccccgtagggtcccccggtcccccttccgggtccccgttacccgaacgggtaaccgacccgtaaccccggttacccggaacggaacgtcccaaaccgggtaccggacccgggaccccgtacggggttccgtaccggtacccgttagggtacccgaaacgggtacccgttaacccgttcccgttaacttacccgtaaccctaacgtaccgttacgggtaccgggtaccggaccgtacggaccgtaacgggcgtaacggtacgtacggctancacgtgcgncnctnnc

SEQ ID NO: 184756 - DNA, 777 bp, Homo sapiens
  misc_feature: GYAE6OF02FN1RN.37.57.F02.1.454.CMB.1.raw
  modified_base (250)..(250): a, c, t, g, unknown or other
  misc_feature (250)..(250): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattgggctgagcttgggtttttccttgttgcttattttggaaggtgtccagtgtgaggtgcaagttggtggagtcgtgggggagcctcgtccgagccggtcgggggtcccnggacgactcctccgtgtgtacgccttctagtaacctttccccgtttaggtctttagttggatgagtccgtacgggtccaccgaggcctccggaaggggaacggggtcgtgggaggttcggggacgaccgaaactaagtaaacgacgaaagagtaggaaaagtaagaaagggtagttaagtcggtacggtacgttcgtaggtaacgggtaacggggttcccgtttaaccaacccgtacttccgtaccgaaacggaaccggtaaaccaaaccggaccgtaaaaccggttaaccctccggtagtaccctaagttccgtaaggaaccttaaaaggaccgaaacgtacgtttaccgaagggaacgaaccggtaccggaaacggtaaccggtacgttaacctttttaagttttaaccgttaacgtcggaccggtacgaaggtaacggaaacgggttcggttaccgggggttacgtttaccgaacgttacgggtcgggacccgtaaccgggtaccggtcgtacccgttacccgg

SEQ ID NO: 184757 - DNA, 914 bp, Homo sapiens
  misc_feature: GYAE6OF02H9R3L.37.57.F02.1.454.CMB.1.raw
  modified_base (439)..(439): a, c, t, g, unknown or other
  misc_feature (439)..(439): n is a, c, g, or t
  modified_base (911)..(911): a, c, t, g, unknown or other
  misc_feature (911)..(911): n is a, c, g, or t
tcagtagtgtagatcacgaccggtgctcgatttagctcgatatagttgggtctggggaggcctcgtccagcctggggggtccctgagacctctcctgtgacacgtcctcgtagtaaccttttcccgttacgtactttaggttaggatggacgtcggttcgggtcccgaccgacggtccaccggaaggggggaacgggtcgtagggtacggggttggggaccggaaccctaaataaaagtaaaccggacgaaaggtaagtaagggtaaaaggtaaaggaaggttaagttaggttaggtacggtaccttacgttggttaaacgggtaaccggtttccgtttaacccaacctacttccctacggaaagtaacaaaccgaaccgaaccgaaacgtaccgtcgacactaactcgaacgaaactaagaaccgtaactacggttanacggaacgaccgggaaccgtaacggaaccggtaaccttacgttttaaactttacgtttacggacggtaccggaagggaaaggaaggtaaacgggtcgggttacgggtttacccgtacgtaacgtaggtccgggaaccgtaaccggtaccgttacgtaaccccgccgttttaccgcccgtacgtaccgtaaacccccgtcccggaaaaacccggtccgtaaccccgtttaacggtccccggtttacccccggtttccccgaccccggtacccccggtacccgttcgtacccggtaccgtaacggacccgtaaccgtacccgtacgacgacgaccgacgacccggccgtaccggtcgtccggtcctaccgggtacgtaacggttaaccgtaccttacgtaccgtactacctaccgtacgttacgtcggtaaccggccggtacgtacggaccgacggacgtaccgagttagacgntac

SEQ ID NO: 184758 - DNA, 688 bp, Homo sapiens
  misc_feature: GYAE6OF02F0G1K.37.57.F02.1.454.CMB.1.raw
  modified_base (475)..(475): a, c, t, g, unknown or other
  misc_feature (475)..(475): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaggtgtccagtgtgaggtgcaattggtggagtcgtgggggaggcctcgtccagccgtgggggtccctgagactctcctgtgtacgcctctgtaacttcccctttacggcttagttggatgagtcgtcgggtccgccgaggcctccgaggggaagggctgggaggtgggtcggaccaacataaagcaagagtggaaagtaaggaaggagtagtggtaggtactcgtaggtacggaacgggttcccgtttacacctatcctaccgaagacgaaccaaccgacctaaaggaccttcccggngaccatcgtagactaaatcgaaactgttaccgaggaacgacggtaccggaaaggtacacgggttactttaagttttaactacgtcggccggtacggtaaggaaacgggtaacgggtaccggtttcggggggttaccggttttaacccggaacggtttccggggaccgggggtaacccgaaccggggtaaccccgttgggtaccccgtacccgg

SEQ ID NO: 184759 - DNA, 576 bp, Homo sapiens
  misc_feature: GYAE6OF02G2W3Q.37.57.F02.1.454.CMB.1.raw
  modified_base (126)..(126): a, c, t, g, unknown or other
  misc_feature (126)..(126): n is a, c, g, or t
  modified_base (161)..(161): a, c, t, g, unknown or other
  misc_feature (161)..(161): n is a, c, g, or t
  modified_base (169)..(169): a, c, t, g, unknown or other
  misc_feature (169)..(169): n is a, c, g, or t
  modified_base (173)..(173): a, c, t, g, unknown or other
  misc_feature (173)..(173): n is a, c, g, or t
  modified_base (187)..(187): a, c, t, g, unknown or other
  misc_feature (187)..(187): n is a, c, g, or t
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (244)..(244): a, c, t, g, unknown or other
  misc_feature (244)..(244): n is a, c, g, or t
  modified_base (264)..(264): a, c, t, g, unknown or other
  misc_feature (264)..(264): n is a, c, g, or t
  modified_base (289)..(289): a, c, t, g, unknown or other
  misc_feature (289)..(289): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (443)..(443): a, c, t, g, unknown or other
  misc_feature (443)..(443): n is a, c, g, or t
  modified_base (446)..(446): a, c, t, g, unknown or other
  misc_feature (446)..(446): n is a, c, g, or t
  modified_base (562)..(562): a, c, t, g, unknown or other
  misc_feature (562)..(562): n is a, c, g, or t
  modified_base (569)..(569): a, c, t, g, unknown or other
  misc_feature (569)..(569): n is a, c, g, or t
  modified_base (573)..(575): a, c, t, g, unknown or other
  misc_feature (573)..(575): n is a, c, g, or t
tcagtagtgtagatcacgaccggtgctcgatttagctcgatatagttgggtttggggggtccctgagactctcctgtgtagcctctgaacttcccctttacggcttattggatgagcgtgggtccnccaggctccagggagggctggagtgggtgaccaanagtaaagnaagntggaataagaaggngtatgngactntgtggaggtccttcacatctcagagacacgaccaaagtacctccgncatctgacaaatcgtaaacngtctgagacgaccgaggactacgtnttatttatcctgccgagagagaaggcgtagggtcgttacgacgtacggcgggaccgaacgggtacccgtggtcctaccgtctccgtacaccgtccctacgaaccgacggtccctaggttcccgttcctcccgnggccnccgtcgcctcgacgcnccnctcgacgacacacgcggaccgccgtggtcctcgccgtacgacgtacgtcttacttccgatacccgtactcgtagacgccggcgcgacgggaccaggcgtacgagtacgacgctcgngtactcntagnnnc

SEQ ID NO: 184760 - DNA, 767 bp, Homo sapiens
  misc_feature: GYAE6OF02FTRN6.37.57.F02.1.454.CMB.1.raw
  modified_base (637)..(637): a, c, t, g, unknown or other
  misc_feature (637)..(637): n is a, c, g, or t
tcagtagtgtagatcacgaccggtgctcgatttagctcgatatagttggggtttgggggtctcagagaggagccttagccctggactccaaggcctttccacttggtgatcagcactgagcacagaggactcaccatggaattggggctgagctggtttccttgtgctattttggagtgtccagtgtgaggtgcaattggtggagtcgtgggggaggcctccgtccaggtcccgtgggggtccctgagactctcctgtgtacgtccttctagaacctttccccgtttacggtactttagttcggatggtacgcgttcgggtccgccgagggcctccggaggggacgggcgtggagggtgggtcgaccaacgtaagaacgacgaagagtaggaaaggtaagaaggtaagttagtggtacggtactcggtggtacgggtaacgggttcccgtttccgaaccgtacgtcccgtaacgaaggtacggaaaccaaccggacccgtaaaagtaaccccgttaccggtggaccctaacgttccgttaacaccggttaaaagtaccggaacgttacccgttaaggtcgggaaagtacccggtacgggaaccggtaccggtaacccggttttaaacgtttttaacncgttacggaccggtagaacggtacgggtaaacgggtcggttacggggttaacccggttttacggaaccgttcgggacccggggtacccgggaaccggttacccggttcggggtacccttaacccccgggg

SEQ ID NO: 184761 - DNA, 842 bp, Homo sapiens
  misc_feature: GYAE6OF02GJX4P.37.57.F02.1.454.CMB.1.raw
  modified_base (275)..(275): a, c, t, g, unknown or other
  misc_feature (275)..(275): n is a, c, g, or t
tcagtagtgtagatcacgaccggtgctcgatttagctcgatatagttgggtttgagggtctcagagagagccttagccctggactccaaggccttcacttggtgatcagcactgagcacagaggactcaccatggaattggggctggagcgttgggttttccttgttgcttagttttggaaggttgtccagtgtgaggtgcaagttggtggagtcgtgggggacgtcctcgtccagccgtgggggtccctgacgtctctccgtgtcgtagccttntacgtactttaccccgttaggtactttagttggactgagtccgtggtcccgacgtaggtccgtaccgaagggggtacgggtccgtagggtacggtcgggttcggaaccctaaacgagtaaaacggacctaaaggtacgtaagggaaacggttaaaggaacggtagttaggtagtacggtaacgttcgtacggtaacggtaaccggttcccgtttacgaaccgtacttcccgtaaacccgtaggaaccgtaaacccgaacccggaccggtaaaaacgttaccccgttccggttaacgaccgttaacgtttacccgtacgtaaaacgttaaaagttccggaaaaccggttcgttaacccgtaggtaaacggtaaccgggtaacccgggtaaccgggtaccgttaaaccggggtttccttttaaaagtttacccggtaacgttcgggaacccgttagggtaaacggtaaacggggaaaccgtttccggggtaacccgggtttaccggtttaacccgacggtttaacccgggcggggtaacccctaacggggtacccttcgggaacccccg

SEQ ID NO: 184762 - DNA, 782 bp, Homo sapiens
  misc_feature: GYAE6OF02INVMV.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaattggggctgagctgggttttccttgttgctattttggaaggtgtccagtgtgaggtgcaagttggtggagtcgtgggggaggcctcgtccaggccgtggggggtccctggacgactcctccgtgtgtacgcctctgtactttccccgtttacggtacttattggagtgagtccgttggggtcccgccgtaggccgtaccggagggggaacggggccttaggggagggtggggtcggacccgaaacgaagtaaaacgcgaaacgtaagttaggaaaggtaaaggaaagggtaagttagtaggtacgggtaacttcggtaggttacgggaaacgggttcccgtttaccacccgtacttaccgtaccgaaggaacgaaacctaccggaaccctaaaggacccgttaccgtagtaaccgtattaccgttgaaaccgtaaattacgaaaccgtagttacgtaggaacggtaccggaccggaacgggtaacctaaccgggttctttaaacgttttaacgttaacggttcgacccgggtaacggtagggaaacggtaacgggttaccggtacggggttaccgttttaccggaacggtttaccgggtccgggtaacccggaaccggggttaccccgttacggttaccccgg

SEQ ID NO: 184763 - DNA, 821 bp, Homo sapiens
  misc_feature: GYAE6OF02HVO5F.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaagttggggctgagcttgggttttcctttgttgtcttagttttggaaggttgtccagtgtggaggtgctaagtttgggtggagttcggtggggggacgggtccgttccgtccgacggtcccggttcggggggtccctggacgtaccttctccgtgtgtacgccttcgtagtaacctttccccgtttacggtctttagttcggtagtggacgtcgtcggggtcccgccgacggtccgtaccggtagggggacggggcggtggtagggtcgggaccgacaacgtaagaacgaacggaaggaggtaaaggaagggtaaaggaggtaagtagttaggtacggtacgtggttaggtacgggtaccggttcccgtaccgtacgttaccgtcccgtaagtaaaccggaaccgaaacgaacccgacgaaaaccgttcccgaccggtcgaactccggtacgtaaccgtaaactaagtcaaaccgttccgtagtaacggaccgtacggacgggtaaccggtaaccggttaccgtttaacttttaacgtttaaccgtaccggtacgggtaccgggaaccggaaggggtaaaccggtcgggtttaacccgggtggggttaccccggttaaccgtacgggtttaccgggggaccccgggttaaccggtaaccgggttccccgtacgttacccccggg

SEQ ID NO: 184764 - DNA, 736 bp, Homo sapiens
  misc_feature: GYAE6OF02HW82Q.37.57.F02.1.454.CMB.1.raw
  modified_base (227)..(227): a, c, t, g, unknown or other
  misc_feature (227)..(227): n is a, c, g, or t
  modified_base (321)..(321): a, c, t, g, unknown or other
  misc_feature (321)..(321): n is a, c, g, or t
  modified_base (339)..(339): a, c, t, g, unknown or other
  misc_feature (339)..(339): n is a, c, g, or t
  modified_base (732)..(732): a, c, t, g, unknown or other
  misc_feature (732)..(732): n is a, c, g, or t
tcagtagtgtagatcacgaccggtgctcgatttagctcgatatagttgggtctgggggaggcctcgtccagcctgggggggtccctgagactctcctgtgtagcctctgaacttcccctttacggcttattggatgagctgggtccgccaggctccgaggggaaggggctggaggtgggtggaccaacataaaagcaagatggaagtaagaaggagtatgtggactntggtaggaaggtccgttcactatctacagaagaacaacgacaagaactcgtagcatctgactaaatagaacagtctagagacgcggaagaaccncggtactaatttagtacnggtacgacgaagtaacggaaggtactggggtaccgttcgacgttacggtcggggaccgaacggggtaaccctaggtccgaccgttcctcctcgtacgcccctaccgaacgaacgggtcccctaacgggttccgtacccgttccccgtcggccccgtcccgtcgaccgtaccgacggtacgaccgtacccgtacgacggtaacgacgtaaccgaacggccggtacccggtccgggtccgtccgtccggttaccgggtaactaacccgggttaaccttaccgttaacccgtaacgttaacccttaccgtaccgttaaccgtaccgggtaacgggtaccggggcgttaccgggaacccgtaacgggtacccgtacggtaacgttacggacgtacgntacg

SEQ ID NO: 184765 - DNA, 748 bp, Homo sapiens
  misc_feature: GYAE6OF02F5SUB.37.57.F02.1.454.CMB.1.raw
  modified_base (196)..(196): a, c, t, g, unknown or other
  misc_feature (196)..(196): n is a, c, g, or t
  modified_base (513)..(513): a, c, t, g, unknown or other
  misc_feature (513)..(513): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcgttgggttttccttgttgcttattttggaaggtgtccagtgtgnggtgcaattggtggagtcgtgggggagccgtcgtccgagccgtgggggtccctgacgactctccgtgtgtacgcctctacgtaacctttcccgtttacggtctttagttggatggacgtcgtcgggtcccgccgaggccgtaccggaaggggacgggtcgtgggaggtgggtcgaccaaacaagtaaagcgaagtagtaggaaagtaagaaggtagtagtggtagtacttgtaggtaggtaacgggttccgtttaccgacctattccgtaccgaaaggaacgaaaccaaaccgacctaaacggtaaccgtccggtanaccgtacgtctaagaactaaaagcgaaactacggttcgtaaggaacggaaccggtaccggaaaggacccgtaacgggttcttttaaacgttttacgtaaccgtcgggaccggtacggaagggaagggtaacggggtaccggtttcggggttacccgggtttaacgacccggtttacggggtcccggggaaaccccgtaacggggtacccccggttggggacccccttaacccggg

SEQ ID NO: 184766 - DNA, 693 bp, Homo sapiens
  misc_feature: GYAE6OF02HTLJX.37.57.F02.1.454.CMB.1.raw
  modified_base (293)..(293): a, c, t, g, unknown or other
  misc_feature (293)..(293): n is a, c, g, or t
  modified_base (516)..(516): a, c, t, g, unknown or other
  misc_feature (516)..(516): n is a, c, g, or t
  modified_base (546)..(546): a, c, t, g, unknown or other
  misc_feature (546)..(546): n is a, c, g, or t
tcagtagtgtagatcacgaccggtgctcgatttagctcgatatagttgggtttgggggtctcagagaggagccttagccctggggggggactccaaggccctttccacttggtgatcagcactgagcacagaggacctcaccatggaagttggggctgagcgttgggttttccttgttgcttattttggaaggtgtccagtgtgaggtgactaagttggtggagtcggtggggggacgtccgtcgtccgaggccggtcgggggtcccgtgacgactctcctgtcgtagccttntagaactttccccgtttagctttatggatgagtcgtcgggtcccgccaggcctacggaaggggagggtcgtagggcggtggggtacgaccgaaagaagtaaacggacaaggtataagggaaacgtaaggaagggtagttagtgggtaggtacctagtaggtacggtacgggttccttacactctacgtcgagacgtaaccgaccgacaaagttaccgtccganacgtactcgtagaactaagacgtaatcgtnagacgacgacgaacgaccgtaacggttactttaacttacgtacgtgaacggtacgtaaggaacggtaacggtacggttcgggtacggttacgaccggttacggggccggaaccggtaaccgggttaacccgtcggtaccgtaccccg

SEQ ID NO: 184767 - DNA, 752 bp, Homo sapiens
  misc_feature: GYAE6OF02JUEI2.37.57.F02.1.454.CMB.1.raw
  modified_base (580)..(580): a, c, t, g, unknown or other
  misc_feature (580)..(580): n is a, c, g, or t
tcagtagtgtagatcacgaccggtgctcgatttagctcgatatagttgggtttggggtctcagagaggagccttagccctggactccaaggcctttccgacttggtgatcagcactgagcacgagaggactcaccatggaattgggctggacgtcgttcgggtttttccttgttcggccttagttttagggaaggtcgtccgaggtgtgacggtgactaagttgggtaggacgtcgtgggggacgtccccgtcgagtccggtcggggtccctgacgcctcgtccgtgcgcacgtcctacgtcggtttacattcttagctaaccgtcgctacggtcgacggcgtaccggtccgccgagtccgtacggaaggggacggtcgtggtaggtccggtacgtacgacgttacttaacggtcggtacgtacggtaacgtaccggtctaacgtaccgagacgtacgtacccggtcggtaccgggtaaccgggtccgttaccgacccgttaccgtacggaaccgttaaggaaccttaacgtacccgaaagtaccgtctacgttaagttccgaacgtaaagtacgaaacnccgtcgtaacggacggttaccgaacggaaccgtccccgtacggtaccctacgtttaacgttccggaggttacccagaacgtcgttaacgtacccggttaagggacgttaagacccttagggaaccttcggaacccgtagtttacccggacgtaaccggtacccggtaccggg

SEQ ID NO: 184768 - DNA, 692 bp, Homo sapiens
  misc_feature: GYAE6OF02FM705.37.57.F02.1.454.CMB.1.raw
  modified_base (178)..(178): a, c, t, g, unknown or other
  misc_feature (178)..(178): n is a, c, g, or t
  modified_base (192)..(192): a, c, t, g, unknown or other
  misc_feature (192)..(192): n is a, c, g, or t
  modified_base (199)..(199): a, c, t, g, unknown or other
  misc_feature (199)..(199): n is a, c, g, or t
  modified_base (307)..(307): a, c, t, g, unknown or other
  misc_feature (307)..(307): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctggtttcctgttgctatttggaagtntccagtgtgagtgnaattggnggagtcgtgggggagcctcgtccagccgtcgggggtccctgacgctctcctgtgacgcctcgtgtaacttccccgtttaggcttagttggatggacgtcgtggtcccnccgtaggcctccggaggggtacgggctagggaggtgggtcggaccgaaatagtaaacgcgaaagagtacggaaagtaaaggaacgggtagtagtacggtcggacttcgtaggtacggtaaacgggttccttaccgaccgtacgtccgtacccgaagaacgaacccgtaaccgtaaccgaaacgaacccttcggcgtaccgagttactacgaactaaagtcgaaactagtaccgtagacggacggtaccggacggaccgtaccggttacttaacgttaacgtttgtacggttaggtacggaaccgttccgtaccggttacccgttaaccccttaagaacgtccggacgtccggtcgttacggttccgtacggtttcttaacccggg

SEQ ID NO: 184769 - DNA, 607 bp, Homo sapiens
  misc_feature: GYAE6OF02FHHAL.37.57.F02.1.454.CMB.1.raw
  modified_base (489)..(489): a, c, t, g, unknown or other
  misc_feature (489)..(489): n is a, c, g, or t
  modified_base (493)..(493): a, c, t, g, unknown or other
  misc_feature (493)..(493): n is a, c, g, or t
  modified_base (508)..(508): a, c, t, g, unknown or other
  misc_feature (508)..(508): n is a, c, g, or t
  modified_base (547)..(547): a, c, t, g, unknown or other
  misc_feature (547)..(547): n is a, c, g, or t
tcagtagtgtagatcacgaccggtgctcgatttagctcgatatagttgggtctgggggaggcctcgtccagcctgggggggtccctgagactctcctgtgtagcctctgaacttcccctttacggcttattggatgagctgggtccgccaggctccagggaagggctggaggtgggtggcaacatacagggaggtggtaggtaacgaaaaactagtggtggactctgtggcggggccgattacaccatctccaagagaacaacgaccaaaaactcactagtatctgaccaaagtggacgcctagagtatcgaggacgcggctggtagtattatgtagcgaagtagtatttaacgactaacgtaaagtttcgagtagacgtggtatagatgtacttagtagacgttaaccggcggggaaccaagggactagtacgtactaccgtcttctacgacgcctaccaccggagtacccatcccggtacctcccgngccncctcgctacgagacnccgacctccgagtacgacacgagcccggtccgtacggcncgacgtcggtaacaacgtacctacctactactcttaccaccttagcgtacggtcggtacg

SEQ ID NO: 184770 - DNA, 786 bp, Homo sapiens
  misc_feature: GYAE6OF02GIQZ4.37.57.F02.1.454.CMB.1.raw
  modified_base (135)..(135): a, c, t, g, unknown or other
  misc_feature (135)..(135): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccanggaattgggctgagctggtttccttgttgctattttggaaggtgtccagtgtgaggtgctaagttggtgtagtcgtgggggagtccgtcgtccaggtcccggtcgggggtccctagacgacttcctccgtgtgtacgcctgtcgtactttccccgttaggtctttagtggactggacgtcgttcgggtcccgactaccggtcgtcccggagggggaacgggtcgtagggaggtcggggtcgaccgaaacgtaagtaaaacggcgtaaagaggtacgggaaaaggtaaagggaaacggtagttagtagggtaggtacgtgttacggtagggaaccggggttcccttaaccgtaacctacgtaccgttaccgaacggtaacgaaacccgaaacccggtaccaaaacgtaaacccgttcggtaacgacctacgttacctagtaaccgaaattacggaaactacggtacgaggaacggtaccggacccggtaacgacgtaaccgttacttttaaacggtttctaacggtggacccggtacggaaggtaaacgggtaaaccggttcggtaccgggggttttaccggtaaccgtaaccggttaccggggtaccgggttaacccggacccggggttaacccgtccggttaacccccgg

SEQ ID NO: 184771 - DNA, 740 bp, Homo sapiens
  misc_feature: GYAE6OF02JH9RN.37.57.F02.1.454.CMB.1.raw
  modified_base (505)..(505): a, c, t, g, unknown or other
  misc_feature (505)..(505): n is a, c, g, or t
  modified_base (539)..(539): a, c, t, g, unknown or other
  misc_feature (539)..(539): n is a, c, g, or t
  modified_base (630)..(630): a, c, t, g, unknown or other
  misc_feature (630)..(630): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggacctcaccataggaagttgggctgagcttgggttttccttgttgcttatttggaagtgtccagtgtgaggtgctagttggtggagtcgtgggggacgtcctcggtccaggtccggttcggggggtcccctggacgtaccttcgtccgttggtcgtacgtcctcgtagtaaccttttccccgttacggtctttagtggatggtagcggttacgggtcccgccgaggtcctaccggaaggggaacgggtcgtaggaggtgggtcggacccaaagtaacgtaaacgcgaaacgagtaggaaacgtaaaggaaggtaattaggtggtacggtacgtcgtaggtaggtaaccgggttcctttacaacctactcctaccggaanaaccggaacaaccgtaacaaacgaccgttcgganacctacgttcgacgaacttaaagcgaaactcggtacgacgaacggacgacccgggaacaacggtaccgttatttaaaccgtttataaccgngaaccggacgtaagggaaccggtaacggtaccggttcggggttaacccgttacggaccgttacggggtaccgggaaccctaccgggtaccgttccgggacccttacccgg

SEQ ID NO: 184772 - DNA, 779 bp, Homo sapiens
  misc_feature: GYAE6OF02FZIT8.37.57.F02.1.454.CMB.1.raw
  modified_base (396)..(396): a, c, t, g, unknown or other
  misc_feature (396)..(396): n is a, c, g, or t
tcagtagtgtagatcacgaccggtgctcgatttagctcgatatagttgggtttgggggaggcttggtacagcctggggggtccctgagactctcctgtgcagcctcttggtttcattcttttagcaactacgccatgagccgtcgggtccgccgaggcctccgaggggaaggggcgtgggaggtcgggttctcgtaggttactttacgtggtaaggttggtaaactaccgctaattacctaaccgcagaccttccggtcggaacggggtccggttccgaccgttcctccgaggaacgtaactaacttaccaaaggtaacgttacggtaccttaactcgttaaggaaactacgaacacggtcgtagacggacggccggaacggaccgccgtaccctntaacttcgtaggtcgagagacgatcgagtacgaagtacgagcgagcagacctagtacgaccgtacgggtcgggacctaaccggtaccgtcggtaccctcccgttacctccctcgtaccgccctacccgaacccggtaccggacccgtacgttccgttaccccttccccggccgcccctaccctcgaaccgtacgacctacccgtcccggtaccgggtacgggaccctcgggtaccgggcccggtacccgggtcggggtccctacggggtcccggtaacggtaccgtaaacggtcccttaaccggtacctacccgtaactaacctaccggttaaggaacggtaccgggccggtacgggtaggcccggtaacggcgtaagtacgg

SEQ ID NO: 184773 - DNA, 686 bp, Homo sapiens
  misc_feature: GYAE6OF02GTQMZ.37.57.F02.1.454.CMB.1.raw
  modified_base (315)..(315): a, c, t, g, unknown or other
  misc_feature (315)..(315): n is a, c, g, or t
  modified_base (356)..(356): a, c, t, g, unknown or other
  misc_feature (356)..(356): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagccgtgggggtccctgagacctctcctgtgtacgcctctgaactttcccccgtttacggctttagttggatgagtcgtgggtccnccgaggcctccgagggagggctgggagtgggacggccaaanataaagcaagagtacggaagtaagaaggagtatggtaggactcgtggtaggaacgggtccgtttacaccgtatcctaccgagacgtacgaaccgaccaagaaacctcgtacgccagttcgtagactaaagtacgaacgagtactacgacgacggtacccggaggaaccgaccgggttacttaagtttttacgttaaccgtgggacgacgggtaggaagggtaacgggtaacgggttacggggttacccggttttaccggtaaccgtttaccgggtaccggggtacccggtaacgggggtaacccccgttcggggtaccccttaaccccgg

SEQ ID NO: 184774 - DNA, 748 bp, Homo sapiens
  misc_feature: GYAE6OF02JHH04.37.57.F02.1.454.CMB.1.raw
  modified_base (67)..(67): a, c, t, g, unknown or other
  misc_feature (67)..(67): n is a, c, g, or t
  modified_base (564)..(564): a, c, t, g, unknown or other
  misc_feature (564)..(564): n is a, c, g, or t
tcagtagtgtagatcacgaccggtgctcgatttagctcgatatagttgggtttgggggtctcagagnggagccttagccctggactccaaggcctttccacttggtgatcagcactgagcacagaggactcaccatggaattggggctgagcgtgggttttccttgttgctattttggaaggtgtccagtgtgagtgcaattggtgagtcgtgggggagcctcgtccacgccgttggggggtcccctggacgactccgtctcggtgtacgcccttcgtagtaacctttccccgtttaacggtctttagttggactagtaggtccgtcgggtacccgccgaggtccgtccggtaggggaacgggtccgtgggaggtggggtacgacaaacagtaaagcgaagagtacggaaagtaaggaacggtagttacgtggtacggtctacgtggtagggtaacgggtacccgttttacgaaccgttattacccgtaccgaaacggaacggtaaccgaaaccgggtacccaaaacggtaaccgtttacccggtgaccgtacgtttaccccgngaacgtaaaaccgtcgggaaaacagttacccgtaggaaccgaacggtccgggaaaccggtaccgaaccgggttactttaagtttaccttaagtcgtaccgacgaggtaggacggttaacggtggggtccgttaccgtacgtaccgggtcgggtacccacggggtaccgtcggaccgttacccgg

SEQ ID NO: 184775 - DNA, 1004 bp, Homo sapiens
  misc_feature: GYAE6OF02FN0CG.37.57.F02.1.454.CMB.1.raw
  modified_base (665)..(665): a, c, t, g, unknown or other
  misc_feature (665)..(665): n is a, c, g, or t
tcagtagtgtagatcacgaccggtgctcgatttagctcgatatagttgggtttgggggtctcagagaggagccttagccctggactccaaggcctttccacttggtgatcagcactgagcacagagactcaccagtggaagttggggctgacgtcgttgggttttccttggttgtcttagtttttgggaaggttcgtaccgtaggttggtggtagggttgacgttaagttgggtaggtagttccgggtagggggacggtccgtccgtccgacggtccggttcggggggtccctaggacgtaccttccgtcgttggtacggttaccgccgttacgtacgtaacccttttcccccgttacgggttactttaggtttacggagttaggacggtccggttacggggtccccgcccgtacgggtcccgttaccgggagggggtaacggggtcgtaggggtagggttcggggtccggaacccaaagtaaggtaaacgcgaaacggtagttaaaggggtaaaggtaaacgggtaagggtacggttaacgttgggttacggtacgttcggtagggttaacgggtaaccgggtttccccttacaccgtacgtacccgtacggtaacgaaccggtaacgaacccggtacccgtaaacggtacccgttccgggtanaacccttagtccgttaaacgaaccgttaaagtaccgaaaccgtttaggtaccggaacggtaacgggtaaccggacccggtaaacggtaacccgggttaccggttttaagttttaaacttttacccggtttaaccgggtacgggtaccccgtaaacggggtaacgggttaaaccggggtaaacgggtttcccggggtttaaacgggggggtttttcccggtttaaacccggggtacccgggtttttaaccggggggggaccccggggttaaaacccgggggtttaccccccgggggtaaacccgtttttaccccggggaaccggttttaaccccccccgg

SEQ ID NO: 184776 - DNA, 1108 bp, Homo sapiens
  misc_feature: GYAE6OF02HA4DX.37.57.F02.1.454.CMB.1.raw
  modified_base (1103)..(1103): a, c, t, g, unknown or other
  misc_feature (1103)..(1103): n is a, c, g, or t
tcagtagtgtagatcacgaccggtgctcgatttagctcgatatagttgggtttgggggtccctgagactctcctgtgtagcctctgaacttcccctttacggcttattggatgagctgggtccgccaggctccagggaagggctggagtgggtcggccaacataaagcaagataggaagtaagaaggagtatgtggactcgtgtcggaagggtccctttcgaacccattccctaccgaggacgaaccgaaaccgaccgaaaacggtaacccttaccggtgaccgactttccgtagtaaccaaaacgttgaaaaccgacggttaccgtacggtaaggaacccggtaccgggaacgggtacccgaaccgggtttaacttttaacgtttttactttaaccggtcggtacccgggacggaacggtaaacgggtaaacggggttaccggttacggggggttacccggggtttttaaccgtaacccggttttaccggtaccgggggggtaccccgtaaaccgggggttaacccccgttccggggtttaccccgaccccggtttaccccttaccccggttaacccgtacggttaccccccctaccccgtaaacccccggtaaaccggggtacccccctttaaccggtttccccgggttttacccccccggtttaccccccccgggttaccgggggaccccccgttaccccccgggttccgggtaccccccggtttaacccgggtaccgggggtaaacccggtacccccggtaaacccccgggtttacccccggaaacggggaaccccggttaccccggtaaaccggaccccgggggttaccccccggggccccccgggtttacggggggttaacccccgtttccccggggttacccgggtttaacggggtttaccccggtaaaacccggggtttaccccttttaacccggttaaccccgtaaccgtttaaccccgttaacccgggtttaaccccttaacggggttcccggggtaaccgggtacccggggttaaccgggtaccgggaacggtaccgggacccggtaacgtaacggttacgacgtacggtaacagtcgagactagcggtacncgtac

SEQ ID NO: 184777 - DNA, 831 bp, Homo sapiens
  misc_feature: GYAE6OF02G81QQ.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaagttggggctgagcttgggttttccttgttgcttagtttggaaggtgtccagtgtgaggtgctaagtttggtagggagttcggtgggggacggtccgttccggtccgaggcccggttcggggggtccctaggacgaccttccgtccgtggtgtacgccttacgtcgtaaccgtttccccgtttaggtctttagttggtagtcgacggtcgttcgggtacccgaccgtacgggtccgtaccgggaagggggaacgggcgtagggtaggtcgggtacgaaccgaaacgaacgtaaaacggcgtaaaaggtagtaagggaaaacggtaaaggaaagggtaagttaacgtagggtacgtacgttcgtagggtagggtaaacgggttcccttaaccgacctacgtccgtacgaagtaacgaaaccgaccgaacctaacgtaaccgtcggtagacctattacgagaacgttaagacgttaacgacgttacgtagggaacgaccggtaaccgggaacggttaccgtaaccggttactttaagttttacccgtacggtccggtaacgggaccgttaagggaaaccgggttaacgggttaccggggttaccgggtttacccggtttaaccggaacggttaccggggtaccggggaaccggttaacccggggttaacccttcgggtaaccccttaccccggg

SEQ ID NO: 184778 - DNA, 734 bp, Homo sapiens
  misc_feature: GYAE6OF02FF2TH.37.57.F02.1.454.CMB.1.raw
  modified_base (313)..(313): a, c, t, g, unknown or other
  misc_feature (313)..(313): n is a, c, g, or t
  modified_base (514)..(514): a, c, t, g, unknown or other
  misc_feature (514)..(514): n is a, c, g, or t
  modified_base (547)..(547): a, c, t, g, unknown or other
  misc_feature (547)..(547): n is a, c, g, or t
  modified_base (589)..(589): a, c, t, g, unknown or other
  misc_feature (589)..(589): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctggtttctgtagctattttggaaggtgtcagtgtgaggtgcaattggtggagtcgtgggggaggcctcgtccagccgtacggggggtccctggacgactctcctgtgttacgccttctgaacttcccgtttacggcttaacttggattgacgctgggtccncgtaggcctccgaggggaagggctcggaggtgggtcgaccaacgtataaaggcaagagtacgggtaagtaaggacggagtaactggtacggtaacttcgtaggtacgggtaacgggtcccgtttacaaccgtacgttaccttaaccggaaggacgtaaccgaaacccgggtacccaaaaagggttacccttccgggtaacncccttaaagtttcccgacggaactaaacggttnaaaaccgtgttaccgagaacggtacggaccgaacggtaaacncggttacttaacttttcgactacggcggtaccaaggtaggtaaacggccggttacggggggtaccgtttttaccgaacccggttacgggttacccgggggaaccttaaccggggttaaccccctaggggttcccctaaccccggg

SEQ ID NO: 184779 - DNA, 718 bp, Homo sapiens
  misc_feature: GYAE6OF02G0LX5.37.57.F02.1.454.CMB.1.raw
  modified_base (613)..(613): a, c, t, g, unknown or other
  misc_feature (613)..(613): n is a, c, g, or t
  modified_base (626)..(626): a, c, t, g, unknown or other
  misc_feature (626)..(626): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcgttgggttttcctgttgcttatttggaaggtctaccgagtgtgaggtgctattggtgggagtacggtgggggaggcctcgttccaggtccgtcggggggtccctggtacgtacctcgtacccgtgtacgcacgtccgcgtaggtacttccgtaccgttccacggtactaacgttagtacggtacctaagttcgaccgtaaccggttccgggggtacccggtcccgaaccgggtacccgtaccccgttaacggggaccgggtaaacgggggcccgttaaggggaccggggttaggggtacgggtacggttaacggtttaacgtacgtaacgagtaagtacgggtaagtacggggtagttagggtttggaggtaccgttagtcgaacgacgtacgtcgtagggacggtacgtacgccaacgtcgtacacgagtacgaactataacgaactacaacacgttacncgtcagaccgaanccgaacgctactagactagacgcgacgtacggacgttctacggtctaaccgcgttacggtactaccgggtaccgggttagggtacgtacggg

SEQ ID NO: 184780 - DNA, 799 bp, Homo sapiens
  misc_feature: GYAE6OF02I9Y3L.37.57.F02.1.454.CMB.1.raw
  modified_base (153)..(153): a, c, t, g, unknown or other
  misc_feature (153)..(153): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccagtggaagttgggctgagngttgggttttccttgttgcttagtttggaaggtgtccaggtgtggaggtgacgtaagttgggtggaggtggtgggggacgccgtcgtccgacggtccgggtcggggggttaccctggacgtaccttccgttaccgtgttaggtacgtccttcgtagtaaccgtttaccccttacggttaccgtttagttcggtagtcggagtccggttcgggtcccgaccgacggtccgtaccggtacggggaacggtccggtgggtaacggtcggggtccggaaccaaacgtaagtaaaggacgaaaggtaggtaacgggaaaggtaaacggtaaggtaagttaacggtaggtacggttacgtacgtaggtaacgggtaacgggttaccttacgaccgtactaccgtaccgaagaacgtaaagacccgtaccgaaacgtaccggttaccgtacgacctagtaccggaaagtaaccgtaaagaacgtaacgtaaccgttcggtaaggaacggtacggaaccggaacgtaacccgtacggtaacttttaagttaacgttacaccgggtacgaggaaaggtacggaaaggttccggtaggtacggtttacgacgtaccggtacgggaccgtaaccggtaccgtccggtaccgtcccgg

SEQ ID NO: 184781 - DNA, 877 bp, Homo sapiens
  misc_feature: GYAE6OF02G4EV0.37.57.F02.1.454.CMB.1.raw
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagcttgggttttccttgttgcttagttttggaaggtgtccagtgtgaggtgactaagttggtggacgtcggtgggggacgtcctcgtccgacgtccggtcggggggtccctaggagacctcctccgtgttgtacgtcctcttacgtaacctttaccccgtttacggtctttaacgttggtactggacgtcgtcgggtcccgaccgtagccgtccggaggggacgggtcgtaggacggttcgggtctcggtaggttacgtttacggttggggttagttacgggtaacgtacccgtgtaaacgtaccgtaccggacgtaacggtaccgtccgggtacgggtacccggggttaccggttcccgaccccggttcctaccggaacgaaaccgtacccaaaccgggtaacccgtaaacggtaaacccgttccgggtctactacggttaccggtacgaaacgttaaacgtacgtaaaccgtcgttacgacggtaacggaccggtaccgggaacgaacccgggttacgttaaccttttaacgttttaaccttaccgggtttacggacccgggacgggttaaacgggacggaaccgggtttaaccgggggttcggggtttaccccggtttaccgggtaacgggtttaaccccggggaccggggttaaccccgggtaacccggggtttaaccccgggtacccgggttaccccgttacccgggtacccttaccccgggg

SEQ ID NO: 184782 - DNA, 671 bp, Homo sapiens
  misc_feature: GYAE6OF02G5ZOI.37.57.F02.1.454.CMB.1.raw
  modified_base (386)..(386): a, c, t, g, unknown or other
  misc_feature (386)..(386): n is a, c, g, or t
  modified_base (540)..(540): a, c, t, g, unknown or other
  misc_feature (540)..(540): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtcgtggggggaggcctcgtccagccgtggggggtccctgacgactctcctgtgtacgcctctgaacttcccctttaggcctttattggatgagctgggtccgcaggcctcgaggggaggggctgggagtggggtgaccgtaacaagtaaagcaaggagtaggaaagtaaggaaaggngttaagtgtggactcgtgtaggacggggtcctttacgacctatcctacgaaggtacgaaccaaccggtaccaaagtaacccgttcccggatacctagtctacgacgtaaaagtcgaaactacgtcgtagaacggacgaccgaaggacaccggtntttaaatttacgttacgcgtacggtaccggaaggtaacggaacgggtacgtagggggttcccgtttacggaaccgttacgggttccggggaacccgtaaacgggggtacccctagggtcccgtaccccggg

SEQ ID NO: 184783 - DNA, 799 bp, Homo sapiens
  misc_feature: GYAE6OF02FLYCD.37.57.F02.1.454.CMB.1.raw
  modified_base (158)..(158): a, c, t, g, unknown or other
  misc_feature (158)..(158): n is a, c, g, or t
  modified_base (166)..(166): a, c, t, g, unknown or other
  misc_feature (166)..(166): n is a, c, g, or t
  modified_base (777)..(777): a, c, t, g, unknown or other
  misc_feature (777)..(777): n is a, c, g, or t
  modified_base (788)..(788): a, c, t, g, unknown or other
  misc_feature (788)..(788): n is a, c, g, or t
  modified_base (794)..(795): a, c, t, g, unknown or other
  misc_feature (794)..(795): n is a, c, g, or t
  modified_base (797)..(798): a, c, t, g, unknown or other
  misc_feature (797)..(798): n is a, c, g, or t
tcagtagtgtagatcacgaccggtgctcgatttagctcgatatagttgggtttgggggtccctgagacctctcctgtgtagcctctgaacttcccctttacggcttagttcggatgagctcgggtccgccaggctccgagggagggctggacgtgggngacccaanagtaaagcaagatacggaagtaacgaaggtagttactggtacggaccttctggtacggaagggtccctttacacctagtccgtaccgaaggacgaaccaacccgtacccaaagtaacccgttccggtggaccctaagttccgtacgaaccgtaaaaatcggaaaaccgtagtccgtacggtaagtacgccggtaaggacctacggtacttaattttaacgtaccgcggaccgtacggaagtaaacggtacgggtacggttacggggttccgtttaccggaacgttacgggtcggggaaccccgaacgggttaaccccgttgggtaacccgtacccggttaccttacccgtacggaccgtcccctaaccgaacccgggttaaccggccctaccgggttccgtaccccgttcccccgaggggtccccgtcccgtaccgcccgtaccgtacggtaccgacccgtaccgtaccgacgtacgaccgaccggaccgtccccggtccgtccggaccgcgttaccggtacgtaccgttaaacgtcttaaccttaccgttacttacccgtactaaccgttagacgaggtccgacggtcgacgacggtaccgacgatacgntagcgtgatcncgtacnncnnc

SEQ ID NO: 184784 - DNA, 744 bp, Homo sapiens
  misc_feature: GYAE6OF02ITW5R.37.57.F02.1.454.CMB.1.raw
  modified_base (204)..(204): a, c, t, g, unknown or other
  misc_feature (204)..(204): n is a, c, g, or t
tcagtagtgtagatcacgaccggtgctcgatttagctcgatatagttgggtttgaggtctcagagaggagccttagccctggactccaaggcctttccacttggtgatcagcactgagcacagaggactcaccatggaagttgggctgagcgttggttttcttgtgcttatttggagttgtccagtgtgaggtgactagttggnggagtcggtagggggacgccgttcgtaccgaggtccggtcggggggtccctagacgtaccttcgtccgttgtacggtacgtccttacgtacgttaaaccgttttcccccgttagggttcctttaaggttggacgtaggtaccgtcgggttcgggtaccccggtcggtaaggtccccggtaacgggaagggggtacggtcgtagggtagggtcgggtacgaaccgaataaagtacgaaataaggtagtaacgggtaagaaaggtagtagtagtggtagtaccgtgtaggtaacgaagggtccgtaattaccgacgtacgtacgtacggaaactaccggtaaaccaaccgtaccgaaacgtaacgttacttaacgttagtacgtactaccgaaattaaacgagtaacagtacgaaggtgaacgtaccgaagggtactcggaacgttgttaacgtacttcgtaagggttcgaagggtaaagcgggtaaacggcggtaaagttggttaaacgggtaaacgtcggtaggtacccggtcgttaacg

SEQ ID NO: 184785 - DNA, 883 bp, Homo sapiens
  misc_feature: GYAE6OF02FRRIL.37.57.F02.1.454.CMB.1.raw
tcagtagtgtagatcacgaccggtgctcgatttagctcgatatagttgggtttgaggtctcagagaggagccttagccctggactccaaggcctttccacttggtgatcagcactgagcacagaggactcaccatggaattgggctgagcgttggtttccttgttgcttagtttggaagtgtccagtgtgaggtgcgtaagttggtggtagtcgtgggggagtccgtcgtccgagtcccggtcgggggtccctaggtacgtacttccgtccgtggtcggtacgtccgttacgttacgtaacctttcccccgttttaacggtcctttaggttacggatcggtaacggtccggttcgggtcccgtaccggtacggtccgtaccggaaggggtaacggggtaccgtaggggtagggttacggggtaccgtaaccgtaaacgtaacgttaaaacggacctaaaggtaacggttaacgggtaaaacggttaaaggaaagggttacggttaacgtacgggttacggtaccgttacggtacggtaacgggttaaccggggtttacccgtttacccgaaccgttaaccggttccgttaacccggaaagggttaaccccgaaacgtaaccccgggtaaccgtaaacggtaacccgttccggtacgaccgtttacgtaaccgtccgtaaactaaacggtaccgtaaaccgttcggtacgtaacggaaccggtcggaacccggtaaggtaccgttaccggtaactttaacgtttacgaccggtaccgtacggaacgtaacggtaacggtaacggttcccgggttacgggttacccgttaacggtccggttccgggtaaccgggtaccccgaacggttccccggttaggtccccg

SEQ ID NO: 184786 - DNA, 765 bp, Homo sapiens
  misc_feature: GYAE6OF02I1M8F.37.57.F02.1.454.CMB.1.raw
  modified_base (203)..(203): a, c, t, g, unknown or other
  misc_feature (203)..(203): n is a, c, g, or t
  modified_base (226)..(226): a, c, t, g, unknown or other
  misc_feature (226)..(226): n is a, c, g, or t
  modified_base (310)..(310): a, c, t, g, unknown or other
  misc_feature (310)..(310): n is a, c, g, or t
  modified_base (505)..(505): a, c, t, g, unknown or other
  misc_feature (505)..(505): n is a, c, g, or t
tcagtagtgtagatcacgaccggtgctcgatttagctcgatatagttgggtttgggggtctcagagaggagccttagccctggactccaaggcctttccacttggtgatcagcactgagcacagaggactcaccatggaattggggctgagtctgggttttcctgttgcttagtttggagtgtccagtgtgagtgcaattggngagtcgtggggagcctcgtaccnggccgtgggggtccctggagacctctaccgtgtgtacgcccttagtgtaaacctttccccgttacggtactttatggtataggngtcctcggggtacccgccaacgggcctaccggaggggaaggggtcctagggtggttggggacgtacccgaataaggtaaacgcgaaagagtaggaaagtacggaaaggtgttaacgtggaggtctacgtggtaacggtagggtccgttactaacgtacgtacctccgaagtcgaaaccgaccgacaaacgttacnccgtcacgtacttcgtagaaccgttaacgcgaaactccgtaacacgggaacgacgacccgggtaaccgaccgtaaccggttaacctttaagtttaaacccggcttaacggggcctacccgggtaaggtaaaccggggtaccggttaaacccgggtttcggggggttacccgtttaaccggtaccggttaaacccggggttcgggggaaaaccccggttaacccggtaccccgggtttacggaccccgtttaacccccggg

SEQ ID NO: 184787 - DNA, 828 bp, Homo sapiens
  misc_feature: GYAE6OF02GTLOC.37.57.F02.1.454.CMB.1.raw
tcagtagtgtagatcacgaccggtgctcgatttagctcgatatagttgggtttgggggtctcagagaggagccttagccctggacctccaaggcctttccacttggtgatcagcaactgagcacagaggactcgaccagtggaagttggggctggagtcgttgggtttttccttggttgtcgtttagttttagggaaggttcggtcctagttgtaggaggtgacgtaaggttgggtgggtaggttcgggtggggggacgtccgtccggtccgacggtcccgggttcgggggttccctggacgtaccgttcctccgtgttgtacgtcccgttcgtacgttacctttcccgtttacgtcttaggtggtatggacgtcggtcgggtccgaccgagggtccgtaccgggaggggacggggtcgtgggaggttcggggcgaaccgaaagtaagaagacgtaagagtagggtaaagtaaaggaagtagttagtcggtagtcgttacggtggtacgggtacggttcccttacgaaccgtgtccgtaacgagaaccgtaaaccgaaacccgtaaccgtaaacgtccgttacccgagtaaccgtacgtcgtaaacgaaactaaaggacccgtaaagtccgtaagtacgggacgaaccgtacgggaaaccggttcctaacggttatttaacgttacgcgggtaacgacgtacggaacgggttacggtaacgggtttcggtacccggggtttagtaaaccccggttacggtaaccggggggtttaccccggaacccggggttaaccccggtacccgggttccccgtaaccggttccccg

SEQ ID NO: 184788 - DNA, 851 bp, Homo sapiens
  misc_feature: GYAE6OF02JYXIF.37.57.F02.1.454.CMB.1.raw
  modified_base (138)..(138): a, c, t, g, unknown or other
  misc_feature (138)..(138): n is a, c, g, or t
tcagtagtgtagatcacgaccggtgctcgatttagctcgatatagttgggtttgggggtctcagagaggagcttagccctggactccaaggcctttccacttggtgatcgagcacgtgagcacagaggactacaccanggaattggggctgagtccgtgggttttcctggttcgcttagttttggaaggtcgtccagtggtaggaggtgacaagttggtggtagtcgttagggggtcggaccttccggtccgtacgcccgttacgggggtcccttacgggaaggtaccctcgttcccgtggttacggttaacgtccgttcttaacggtacctttaaccccgttttacgggaccttttacgtcggtaattcggaacgttccgtcgggtaccgtccgtaacggtccgtaccggaagggtaacgggtcgtagggtacggtacgggttagtaccccgaaagtacgtaaacggtaccaagggtaacgtaaggtaagttaaacggaacggtagtacggttacggtacgctacggtagtacggtacggggtacctttacgacccgtagtacctacgtaactaccgaacgtaaccccggtaccgaaacgtaccgtaccggttaacggccttagttaaccgtacgtaaccgttaaacggtttacggaaacccttaagggtacccttaaagggttaaccggaacccgggtacgttaaaccggaacgttaaccgttaagtttaaaccgttacgttaaaccgtggtacccgagtacgtaagggtaacggtcgttacgggtaaacgtcggtaacgttccggtacgggtaccggtaacggtacccttacgggtccctaccccggg

SEQ ID NO: 184789 - DNA, 203 bp, Homo sapiens
  misc_feature: GYAE6OF01D09ZL.43.34.D01.1.454.CMB.1.raw
  modified_base (203)..(203): a, c, t, g, unknown or other
  misc_feature (203)..(203): n is a, c, g, or t
tcagtgtgagtagtcacgaccggtgctcgatttagatcgtctgtgttgggtttgggcacgaccggtgctcgatttagatcgtctgtgttgggtttggtggtctccactcccaccgtcctaggtcagcccaaggccaaccccactgtcactctgttcccgccctcctcactactcacactgagcgggctggcaaggcgcatagn

SEQ ID NO: 184790 - DNA, 185 bp, Homo sapiens
  misc_feature: GYAE6OF01BMWWH.43.34.D01.1.454.CMB.1.raw
  modified_base (185)..(185): a, c, t, g, unknown or other
  misc_feature (185)..(185): n is a, c, g, or t
tcagtgtgagtagtcacgaccggtgctcgatttagatcgtctgtgttgggtttgggttgggtttggggaagaggaagactgacggtcctgctccaggagcacctccgagagcacagcggccctgggctgcctggtcaaggactacttccactactcacactgagcgggctggcaaggcgcatagn

SEQ ID NO: 184791 - DNA, 300 bp, Homo sapiens
  misc_feature: GYAE6OF01BALVB.43.34.D01.1.454.CMB.1.raw
  modified_base (291)..(291): a, c, t, g, unknown or other
  misc_feature (291)..(291): n is a, c, g, or t
  modified_base (297)..(300): a, c, t, g, unknown or other
  misc_feature (297)..(300): n is a, c, g, or t
tcagtgtgagtagtcacgaccggtgctcgatttagatcgtctgtgttgggtttgggtcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccactgtcactctgttccccacctcctcactactcacactgagcgggctggcaaggcncatagnnnn

SEQ ID NO: 184792 - DNA, 503 bp, Homo sapiens
  misc_feature: GYAE6OF01D855Y.43.34.D01.1.454.CMB.1.raw
  modified_base (334)..(334): a, c, t, g, unknown or other
  misc_feature (334)..(334): n is a, c, g, or t
tcagtgtgagtagtcacgaccggtgctcgatttagatcgtctgtgttgggtttggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaacgcccccaaactcatgatttatgagggcactaagcggccctcaggggtttcngatcgcttctctggctccaagtctggcaacacggcctcctgacaatctctgggctccaggctgaggacgaggctgattattattgctgctcatatgctaggttattacacttatgtcttaggaattgggacacggtcaccgtctaggtcagcccaaggcccaaccctcg

SEQ ID NO: 184793 - DNA, 506 bp, Homo sapiens
  misc_feature: GYAE6OF01BI8OK.43.34.D01.1.454.CMB.1.raw
  modified_base (330)..(330): a, c, t, g, unknown or other
  misc_feature (330)..(330): n is a, c, g, or t
  modified_base (361)..(361): a, c, t, g, unknown or other
  misc_feature (361)..(361): n is a, c, g, or t
  modified_base (439)..(439): a, c, t, g, unknown or other
  misc_feature (439)..(439): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaaatcatgatttatgagggcactaagcggcctcgaggggtttcngatcgcttctctggctccaagtctggcaacncggcctcctgacaatctctgggctccaggctgaggacgagctgtattattattgctgctcatatgctaggtacttacncttatgttcttggtagttgggacgtacggttcaccgtctacggtcacgcccaacggcccaaaccccg

SEQ ID NO: 184794 - DNA, 300 bp, Homo sapiens
  misc_feature: GYAE6OF01B1MRJ.43.34.D01.1.454.CMB.1.raw
  modified_base (297)..(300): a, c, t, g, unknown or other
  misc_feature (297)..(300): n is a, c, g, or t
tcagtgtgagtagtcacgaccggtgctcgatttagatcgtctgtgttgggtttgggtcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccactgtcactctgttcccgccctcctcactctcacactgagcgggctggcaaggcgcatagnnnn

SEQ ID NO: 184795 - DNA, 503 bp, Homo sapiens
  misc_feature: GYAE6OF01C3TPH.43.34.D01.1.454.CMB.1.raw
  modified_base (442)..(442): a, c, t, g, unknown or other
  misc_feature (442)..(442): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttggagttatagccttgtctcctggtaccaagtgcacccaggcaaagcccccaaaatcatgatttatgagggcactaagcggccctcaggggtttctgatcgcttctctggctccaagtctggcaacacggcctcctgacaatctctggctcaggctgaggacgaggctgattattattgctgcctcatatgcaggttattacactttangttcttcggtaattgggacgtacggtcacccgtctaggtacagcccaaggcccaaaccccg

SEQ ID NO: 184796 - DNA, 532 bp, Homo sapiens
  misc_feature: GYAE6OF01DW9A1.43.34.D01.1.454.CMB.1.raw
  modified_base (227)..(227): a, c, t, g, unknown or other
  misc_feature (227)..(227): n is a, c, g, or t
  modified_base (364)..(364): a, c, t, g, unknown or other
  misc_feature (364)..(364): n is a, c, g, or t
tcagtgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcccgggcccagtctgccctgactcagcctgcctccgtgtctgggtctcctggacagtcgatcaccatctcctgcactggaaccngcagtgatgttgggattatagccttgtctcctggtaccaagtgcacccaggcaaacgccccaaactcatgatttatgagggcactaagcggccctcgaggggtttctgatcgcttctctggctcaagtctggcaacncggcctccctgacaatctctgggctccgaggctggaggacgaggctgatttattattgctgctcatatgtctaggttattacacttagtgttcgttacggtaagttggggaactacgggttcacccgttccgtaggtccacgaccccaaggaccccaaccccgtgtcg

SEQ ID NO: 184797 - DNA, 530 bp, Homo sapiens
  misc_feature: GYAE6OF01D527F.43.34.D01.1.454.CMB.1.raw
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcaccaggcaaacgcccccaaatcatgatttatgaggcactaagcggccctgagggttctgatcgtcttctctggctaccgaagtctgcaacacggccctccctagacaactctcgtcgggctccgaggctggaggacgaggctagtatttattatgctgctactatatgactaggtagtttacactttatcgttacgttaggtaagttcgggacgtacggtcaccggtctaggtcacgacccacggcccaacccgtcg

SEQ ID NO: 184798 - DNA, 529 bp, Homo sapiens
  misc_feature: GYAE6OF01AQRPT.43.34.D01.1.454.CMB.1.raw
  modified_base (318)..(318): a, c, t, g, unknown or other
  misc_feature (318)..(318): n is a, c, g, or t
  modified_base (327)..(327): a, c, t, g, unknown or other
  misc_feature (327)..(327): n is a, c, g, or t
  modified_base (337)..(337): a, c, t, g, unknown or other
  misc_feature (337)..(337): n is a, c, g, or t
  modified_base (373)..(373): a, c, t, g, unknown or other
  misc_feature (373)..(373): n is a, c, g, or t
  modified_base (414)..(414): a, c, t, g, unknown or other
  misc_feature (414)..(414): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatggttgggagttatagccttgtctcctggtaccaagtgcaccaggcaaacgcccccaaactcatgatttatgaggcactaagcgcctnagggtttcngatcgcttcnctgctcagtctggcacacggcctcctgacatctcgnggctcgagctgaggacgaggctgattattatgctgctcatngtacaggtacgttacactttagtcgttcttacgggtaagtttgggaaccgtaccgggttacacccggttacccgtaggttcccaacggacccctaagggtaccccctaaaccccg

SEQ ID NO: 184799 - DNA, 516 bp, Homo sapiens
  misc_feature: GYAE6OF01BZAIF.43.34.D01.1.454.CMB.1.raw
  modified_base (303)..(303): a, c, t, g, unknown or other
  misc_feature (303)..(303): n is a, c, g, or t
  modified_base (333)..(333): a, c, t, g, unknown or other
  misc_feature (333)..(333): n is a, c, g, or t
  modified_base (364)..(364): a, c, t, g, unknown or other
  misc_feature (364)..(364): n is a, c, g, or t
  modified_base (422)..(422): a, c, t, g, unknown or other
  misc_feature (422)..(422): n is a, c, g, or t
tcagtgtgagtagtcacgaccggtgctcgatttagatcgtctgtgttgggtttgggggggtcacaagaggcagcgctctcgggacgtctccaccatggcctggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttangagggcactaagcggccctcgagggtttcngatcgcttctctggctccaagtctggcaacncgcctcctgacatctctgggctccgagctgaggacgaggctgattattattgctgctnatatgctaggttattacactttatgttcgttcggaagttgggacgtacggtcacccgtcctaggtcacggaccccaacggccccaaccccgtac

SEQ ID NO: 184800 - DNA, 590 bp, Homo sapiens
  misc_feature: GYAE6OF01ACEM7.43.34.D01.1.454.CMB.1.raw
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (303)..(303): a, c, t, g, unknown or other
  misc_feature (303)..(303): n is a, c, g, or t
tcagtgtgagtagtcacgaccggtgctcgatttagatcgtctgtgttgggtttggggggtcgacgaagaggcgagcgctctcgggacgtctccaccatggcctggctctgctgctcctcactctcctcgctcaggacacagggtcctgggcccagtctgccctgactcagcctgcctccgtgtctgggtctcctggacagtcgatcaccatctcctgcactggaaccngcagtnatgttgggagttatagccttgtctcctggtaccaagtgcaccagcaaacgcccccaaactcatgatttnagaggcactaagcgcctcgagggttctgatcgtcttctctggtctccgaagtctgggacaacgaccggtcctcccctgacaatcctcgtgggcctcccgaggccgttgacgggacgaggtctcgtaatttaagtttagttcgccttggtccttactagttattcggacctagggtttaagtttacctacctttagtcgtttacgttacggtaaaggtttcggggaacgtacggtttccaacccggttcgtacggtaccacgtaccccgaggtaccccacccgtaacg

SEQ ID NO: 184801 - DNA, 298 bp, Homo sapiens
  misc_feature: GYAE6OF01BG1PI.43.34.D01.1.454.CMB.1.raw
  modified_base (293)..(298): a, c, t, g, unknown or other
  misc_feature (293)..(298): n is a, c, g, or t
tcagtgtgagtagtcacgaccggtgctcgatttagatcgtctgtgttgggtttgggtcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccatgtcactctcgttccacctctcactactcacactgagcggctggcaaggcgcatagnnnnnn

SEQ ID NO: 184802 - DNA, 303 bp, Homo sapiens
  misc_feature: GYAE6OF01CWPZS.43.34.D01.1.454.CMB.1.raw
  modified_base (299)..(303): a, c, t, g, unknown or other
  misc_feature (299)..(303): n is a, c, g, or t
tcagtgtgagtagtcacgaccggtgctcgatttagatcgtctgtgttgggtttgggtcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcacgcccaaggcccaaccccatgtcactctcgtccccaccctctcactactcacactgagccggctggacaaggcgcatgnnnnn

SEQ ID NO: 184803 - DNA, 611 bp, Homo sapiens
  misc_feature: GYAE6OF01DEM4Y.43.34.D01.1.454.CMB.1.raw
  modified_base (310)..(310): a, c, t, g, unknown or other
  misc_feature (310)..(310): n is a, c, g, or t
  modified_base (347)..(347): a, c, t, g, unknown or other
  misc_feature (347)..(347): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgtggattatagccttgtctcctggtaccaagtcgccacccgaggaccaaacgacccccaaactcatgtatttanggagggcaacgtaacgccggccctcgtaggggtttcngattcgcttcgtcgtggtcctaccgaagttcgacgggtaccaaaccgtaccggtcccttaccctggaacctaacgtcctcgttcgggaccttcccgagggtcctagggacgggtacggaggtccttagtaacgttttattacgttgtctgtcttatatagtgactaggttacttactacgtttattcgttaccgttacggtaagttcgggaacgtcggttaccaccgttccgtagtccgacgacccaacggcccaacccgtacg

SEQ ID NO: 184804 - DNA, 578 bp, Homo sapiens
  misc_feature: GYAE6OF01BCBAR.43.34.D01.1.454.CMB.1.raw
  modified_base (272)..(272): a, c, t, g, unknown or other
  misc_feature (272)..(272): n is a, c, g, or t
  modified_base (339)..(339): a, c, t, g, unknown or other
  misc_feature (339)..(339): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtncaccaggcaaacgacccccaaatcatagtatttatgagggcacgtaagccggacctgtagggtttcngatcgcttctctaggctacaagtctggaccaacaccggcctaccctagacctaatcctacgtcgggctccaggtctaggaacggacgtaaggtctagtattattagttgctagcttctatacgtgacttaggttaacttacaacgtttatcgttacgttacggtaagttcgggaaccgttacggtccgtaaccgtccgtaacggttaccacggaccccgaacgaccccgtaaccctacg

SEQ ID NO: 184805 - DNA, 574 bp, Homo sapiens
  misc_feature: GYAE6OF01CBTTX.43.34.D01.1.454.CMB.1.raw
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatggttggagttatagccttgtctcctggtaccaagtgcacccaggcaaacgcccccaaactcatgatttatgaggcactaagccggccctcgtagggttctgatcgcttctctggctccaagtcncgacacncggcctccngacatctctcgggctccgaggtctaggacggacgaggtctagtaatttatttattcgcgttgactctaagttatcgacgttaagggttacgtttaactacgtttatcggtttaccgtttacgggtaagtttacgggggaccggtaccgggtccgtacccgttccgttaggtaccaacggacccctaacggcccctaaaccccg

SEQ ID NO: 184806 - DNA, 514 bp, Homo sapiens
  misc_feature: GYAE6OF01BPX2Q.43.34.D01.1.454.CMB.1.raw
  modified_base (329)..(329): a, c, t, g, unknown or other
  misc_feature (329)..(329): n is a, c, g, or t
  modified_base (360)..(360): a, c, t, g, unknown or other
  misc_feature (360)..(360): n is a, c, g, or t
  modified_base (414)..(414): a, c, t, g, unknown or other
  misc_feature (414)..(414): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggattatagccttgtctcctggtaccaagtgcaccaggcaaagccccaaatcatgatttatgaggcataagcggcctgtagggtttctgatcgnttctcgtggctcaagtctgcacacgcctccngacaatctcgtgggctcgagctggagacgagctgtatttattatgctgctcatntgctaggttacttactacttattgttacgttacggtaagtttgggacgtcggtacctacccgtccgttaggtaccaagtcccaaggtcccctaaaccccg

SEQ ID NO: 184807 - DNA, 819 bp, Homo sapiens
  misc_feature: GYAE6OF01BSBKX.43.34.D01.1.454.CMB.1.raw
tcagtgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtcctccgtggacagtcgatccacctattcctcctgacctacgtacggaaccagctaggtgagttggttagggagttatacgtcctttgtcctccgtggtaaccaagtcgaccacccgaggaccaaaccgacccccaaatcatagtatttagaggacggtacctaacgtaacgggcccggtaccccgttacggttacggggttttccaggtacgttccgtcctttccgtccgtcggtccctaccgtaagttccgtacggacccaaacccgtacccggtccccttacccgtagtaacctaacgttcccgttaccggtcgggtacccttacccggagggtccgtacgggaacgggtaccggtacgggttccgttaaggttaacttttaagtttacgtttcgtacgttcgtaccttacgtaagttacgttacggtaaccggttaagggtttaactttaacccgttaacgttttacggttacggttttacccgggtttaaacgggttaacgggtttacccgggggtaacccgttaacccggggttaccccgttaaccccggttaccggttaaccggttacccgaaccccgggttaacccccggaaacccgggtacccccctaaaccccgttaaccgg

SEQ ID NO: 184808 - DNA, 536 bp, Homo sapiens
  misc_feature: GYAE6OF01BI0SO.43.34.D01.1.454.CMB.1.raw
  modified_base (311)..(311): a, c, t, g, unknown or other
  misc_feature (311)..(311): n is a, c, g, or t
  modified_base (344)..(344): a, c, t, g, unknown or other
  misc_feature (344)..(344): n is a, c, g, or t
  modified_base (384)..(384): a, c, t, g, unknown or other
  misc_feature (384)..(384): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatggttgggagttatagccttgtctcctggtaccaagtcgcacccgaggacaaacgcccccaaactcatgtatttanggaggcacgtaagccggcctcgtaggggtttcngatcgtcttctcgtgctcaagtctgacacaccgcctaccngactatctcgtggctccgagcgtagacggacgaggctgtaattattatgctgctacatagtgcgtaggtattactacttatcgttcgtacggtagttcgggacgtacggtccaccggttacgacggtcacgacccgaacgcccaaccctacg

SEQ ID NO: 184809 - DNA, 790 bp, Homo sapiens
  misc_feature: GYAE6OF01D2P4E.43.34.D01.1.454.CMB.1.raw
  modified_base (242)..(242): a, c, t, g, unknown or other
  misc_feature (242)..(242): n is a, c, g, or t
  modified_base (468)..(468): a, c, t, g, unknown or other
  misc_feature (468)..(468): n is a, c, g, or t
tcagtgtgagtagtcacgaccggtgctcgatttagatcgtctgtgttggggtttggggggggtcacaagaggcagcgctctcgggacgtctccaccatggcctgggctctgctgctcctcactctcctcgctcaggacacgagggtcctgggcccagtctcgccctgactcagtcctgcctccgtgtcgtgggtcctccgtggactagtcgactccacctatcctcctgcacgtaggaaccngcagtgtagttggttagggtacgttatacgtccgttgtccttccgtacggtaaccaagtcgaccgacccgaaggacctaaacccgacccctaaactcgtaattacggtatttagacggacggtactaaccgtaacggccggtaccttacggtacgggtttctgtacgtcgtcgttctcgtcgtaccctacgaagtacgtacgacctaacgccgtaccctaccgtanactacgttccgtacggtcggtccctacggacggtacggtaggaacgggtacggtacggtacttttagtaacgttttaacgtgttacgtccgttacgttcctaacgttacgtttacggtacggttaaccgtttaacgggttaactttaaccgtttacgttaagtttaccggggtttaccccgggtaaagggtttaacgggtttacccgggggtaacccgttacccgggtttaccccggaaccccggttttacggaaaccgggttaccccgaaacccggtaaccccccggtaaaccggttaccccccgtaaaaccccgttcggg

SEQ ID NO: 184810 - DNA, 813 bp, Homo sapiens
  misc_feature: GYAE6OF01BK273.43.34.D01.1.454.CMB.1.raw
  modified_base (228)..(228): a, c, t, g, unknown or other
  misc_feature (228)..(228): n is a, c, g, or t
  modified_base (277)..(277): a, c, t, g, unknown or other
  misc_feature (277)..(277): n is a, c, g, or t
tcagtgtgagtagtcacgaccggtgctcgatttagatcgtctgtgttgggctgggtcacaagaggcagcgctctcgggacgtctccaccatggcctgggctctgctgctcctcactctcctcgctcaggacacgagggtcctgggccagtctgccctgactcagcctgcctccgtgtcgtgggtctccgtggacagtcatcacctatctcctgaccacgtcggaaccngcaggtgagttggtaggattatacgtcttgtctcgtaggtaccaagtcncaccaggaccaaacgtccccaaatctatagtatttagtcggaacggtacaagtaacgggccgtccgttagggtacgggtttcagtacgtcgtcgttcgtcgtcggtaccttacgtaacgttccgtacgaaccgtaaccggtaccggtcccttaccgtacgtaacctaaccgtttccggtccgtacggggttaccctccgggtaacgggtccgttagggaaccgggtaccgggtaacggttacgttacggttaacgttttaacgtttacgtttaacggtccgttcgttaaccgttaccttaacgggttttaacgaccgggttaaccgggttaaaggtttaacccgtttaaacggtttaacggtttaaccttaccggggttttaaccgggtttaaacgggttaacgggtttaaccggggggtaacccggtttaaacccggggtaaccctttaaccccccgggggttaagtttaaccgggggcccctaaaaccccggggtccccttaaaaaccccgggtccccggttaaaacccccccg

SEQ ID NO: 184811 - DNA, 661 bp, Homo sapiens
  misc_feature: GYAE6OF01CQ3Y3.43.34.D01.1.454.CMB.1.raw
  modified_base (228)..(228): a, c, t, g, unknown or other
  misc_feature (228)..(228): n is a, c, g, or t
  modified_base (353)..(353): a, c, t, g, unknown or other
  misc_feature (353)..(353): n is a, c, g, or t
tcagtgtgagtagtcacgaccggtgctcgatttagatcgtctgtgttgggtttggggggggtcacaagaggcagcgctctcgggacgtctccaccatggcctggctctgctgctcctcactctcctcgctcaggacacagggtcctgggcccagtctgtcctgactcagcctgcctccgtgtctgggtctcctggacagtcgatcaccatctcctgcactcggaaccngcagtgagttggttagggattatacggtccttgtctccgtaggtaccaagtcgccaccgaggaccaaacgcccccaaactcatgtattatggaggctacgtaagccggcctcggtacgggtttcngatccgtctttcgtcgtcggtctccgaacgtcgtcggtaccaaccgaccggtccctacccgtgaacctaacgttccgtccggttcgggccttacccgagggtctaggacgggtacgacggtccttagtaactttactttagttcgcgttcgcttactagttcgtacgtacgtaacggtttacgttactacgtttgttacgttaccgttacggtaaggtttcggggacccgttacggttcccgtaaccggttaccgttaccggtcccgaacggttacccccggaaacggtccccctaaaccccggtacg

SEQ ID NO: 184812 - DNA, 642 bp, Homo sapiens
  misc_feature: GYAE6OF01BKAWP.43.34.D01.1.454.CMB.1.raw
  modified_base (226)..(226): a, c, t, g, unknown or other
  misc_feature (226)..(226): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctcgtgtctggtctcctggacagtcgatcaccatctcctgcactggaaccngcagtgattggttggagttatagccttgtctccgtggtaccaagtgaccaccaggaccaaacgccccaaatcatgtatttagtgacggacaacgtaacggccggtccctacggtagggtttcctagacttccggtcttcgtctcggtcctaccgaaggtcgtacggacctaaaccgccggtccctaccgtacgtaacctacgttccgtacgtcggtaccttacccggcggtaccgtagggaacgggtacggaacggttcgtagttaactttaagttacgttgtcgttcgtctactattacgtgtacgtaggttactactacttagttcgttacgttaggttaggttcgggtacggtaccggtccgttaccgtaccgttacggtaccacggtacccaacggccccgtaaccccgtag

SEQ ID NO: 184813 - DNA, 203 bp, Homo sapiens
  misc_feature: GYAE6OF01BVEPS.43.34.D01.1.454.CMB.1.raw
  modified_base (202)..(203): a, c, t, g, unknown or other
  misc_feature (202)..(203): n is a, c, g, or t
tcagtgtgagtagtcacgaccggtgctcgatttagatcgtctgtgttgggtttgggcacgaccggtgctcgatttagatcgtctgtgttgggtttggtggtctccactcccaccgtcctaggtcagcccaaggccaacccactgtcactctgttcccgccctcctcactactcacactgagcgggctggcaaggcgcatagnn

SEQ ID NO: 184814 - DNA, 781 bp, Homo sapiens
  misc_feature: GYAE6OF01BIX7I.43.34.D01.1.454.CMB.1.raw
  modified_base (216)..(216): a, c, t, g, unknown or other
  misc_feature (216)..(216): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctccngcactggaaccagcagtgatggttgggagttatacgtccttgtcctccgtaggtaaccaaggtcgccacccgaggaccaaaccgacccccaaactcatagtaatttagtggagggacctaacgtaacggtcccggtacccgtcggtacgggggttttctgtacgttccgtcttcgtcgtcggtcctaccgtaacggttcgtacggacctaacgcccggtccctaccgtacgaacctacgtccgtcgtcgggtcctaccggacgggtcgtacgggaacgggaccgggtaggtaccgttaggttaacttttagtttaacgtttcggtccgttacgtccgttacttaacgttacggttaacggtaccggtttaaacgggtttaaccgtttaaccgtttaaccgttttaacgtttaccgggttttaccggtttaaccgggggttaaagggtttaccgggggtaacccggttacccggggttacccgttaaccccgggttacccggttaacgggtacccgttaccccggaaaccccgtaaacccgggacccccctaaaccccgttacccg

SEQ ID NO: 184815 - DNA, 515 bp, Homo sapiens
  misc_feature: GYAE6OF01EBMJY.43.34.D01.1.454.CMB.1.raw
  modified_base (299)..(299): a, c, t, g, unknown or other
  misc_feature (299)..(299): n is a, c, g, or t
  modified_base (324)..(324): a, c, t, g, unknown or other
  misc_feature (324)..(324): n is a, c, g, or t
  modified_base (447)..(447): a, c, t, g, unknown or other
  misc_feature (447)..(447): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgtggattatagccttgtctcctggtaccaagtcgacacccaggacaaacgccccaaatcatgtattangaggcactaagcgcctgagggttcngatcgcttctcgtggctccaagtctaggacaacgacggcctccagacaactctcgtcgggctcgaggctgaggacgaggctagacttattatgctgactcatatgactaggtacttacagttntcgtacttacggaagttgggactacggtcctaacgtccgtagtaccagacccgaaggccctaaacccg

SEQ ID NO: 184816 - DNA, 890 bp, Homo sapiens
  misc_feature: GYAE6OF01A7WVU.43.34.D01.1.454.CMB.1.raw
tcagtgtgagtagtcacgaccggtgctcgatttagatcgtctgtgttgggcgtgggtcgacaagaggcagcgctctcgggacgtctccaccatggcctgggctctgctgctcctcactctcctcgctcagacacgacgggtcctgggccagtctcgccctagacctcagcctgccctcgtgtctgggtcctccgtaggacgtagtcgactccaaccacttcttcctggactacgtacggaaccagcaggtcgattgggtaggtagttactaacgtccgtttcgtctaccgttggtaaccctaaggttcggtacccaaaccccgacggggaacccaaaaccggtaaccccccctaaaagttccctaagttacggttaactttttaacggacgggaaccggggtaactaaacgttaaacgggcccccggttaccgggtttaccgttaaaacggggggttttccttacggtaacggtttccctaccggttttctccgggttaaccgggtccttacccggttaaaacggttccgtacccgggttaacgaaaacccggcccgggttaccctcccgttacgaaccgttaacgttcccgttacggttccgggtacccgttaacccgacgggttcgtaaccggacgggggtacctacggggtactttacgttaatttacggtttaagttttccgggaccgtttacggtccttaacgtaagtttacgtaccgggttcttaaacgggtttagtttaacccgttaaacttgtttaccggttacgttaaaggggtacgtttacggggaaacccggtttaccggttacttacccccgggtttagtaacccggggttacaacccgggtaacccccgttaaacggggaaccccctaaaccccggg

SEQ ID NO: 184817 - DNA, 587 bp, Homo sapiens
  misc_feature: GYAE6OF01C6WNX.43.34.D01.1.454.CMB.1.raw
  modified_base (347)..(347): a, c, t, g, unknown or other
  misc_feature (347)..(347): n is a, c, g, or t
  modified_base (369)..(369): a, c, t, g, unknown or other
  misc_feature (369)..(369): n is a, c, g, or t
tcagtgtgagtagtcacgaccggtgctcgatttagatcgtctgtgttggggtttggggggggtcacaagaggcagcgctctcgggacgtctccaccatggcctgggctctgctgctcctcactctcctcgctcaggacacgagggtcctgggcccagtctgccctgactcagcctgcctccgtgtctgggtctccgtggacagtcgatcaccatcctcctgccactcggaaccagcagtgattggttagggagttatagtccttgtcttcctcggtaacaagtcgaccaccaggccaaacgcccccaaactcatgtattagtgaggcactagcgcctgtagggttcngatctcttctcgtgctcagtcngacaacgcgcctcctgactactctcgtggcctcgaggtctaggaggacgaggtctagtactttatttagttgcgttcgacctagtaacttatcggtataacggttacttactaattacgttacgttaccgttaggtaacggttcgggtaccgtaaccgggttcctaacccggttctaacggtccaacggccccgtaaacggcccctaacccgtaaccg

SEQ ID NO: 184818 - DNA, 658 bp, Homo sapiens
  misc_feature: GYAE6OF01BN9HR.43.34.D01.1.454.CMB.1.raw
  modified_base (229)..(229): a, c, t, g, unknown or other
  misc_feature (229)..(229): n is a, c, g, or t
  modified_base (271)..(271): a, c, t, g, unknown or other
  misc_feature (271)..(271): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacgagggtcctgggcccagtctgccctgactcagcctgcctccgtgtctgggtctccgtggacagtcatcaccatctcctgcactggaaccngcagtgatggtggattatagcttgtctcctggtaccaagtcncaccgagaccaaacgcccccaaatcatgtatttagaggaggacaacgtaaggccgtcccgtagtacgggtttctgactcgtccttgtcgtaggctacctaagtcgtacggaccaaacgccgtccctaccgtacgactaactccgtcgtcggcctaccgagtcgaggaacggacgtggtcttagtactttattacgttcgcttcgaccttactagttacgtacgtacgttaacgggttacgttaaccttaacgtttacgttacggtttaccggttacgggtaaggtttaccgggggtaacgtaccgggttccccgtaaccggttaccggtaccggttaccgaacccggtaaccccggaaccggtaaccccccgtaaaccccggtaccg

SEQ ID NO: 184819 - DNA, 768 bp, Homo sapiens
  misc_feature: GYAE6OF01DCFZZ.43.34.D01.1.454.CMB.1.raw
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatcctcctgcactggaaccagcagtgagttggttgggagttatagtccttgtcctccgtggtaaccaagtcgcaccccgaggacaaaccgacccccaaactcagtacgtattttagtaggacgggaccaacgtaacggccggtcccgtacgtaggggtttctaggtactccgtcttcgtcgtcggctccgtaagtcgttacggactaaccgacccggtcccttacccgtacgaacctaacttccgttaccgtcggggtacccttcccggaacgggtccttagggaccgggtaaccggaacggtcgtaggttaacttttaagtttacttcggtctttacggaccttacgtaacgttacgtaggttaccgttaagggtttaccttttaaaccgttaaccgttttagtttaccggtttaccggtttaaacgggttaaacgggtttccggggaaacccgggttaccgggttaccccgttaaccccgggtttacccgtttaccggggtaaacccgtacccgggtaaaccccccggtaaaccgggtacccccccgttaaaaaccccccgg

SEQ ID NO: 184820 - DNA, 631 bp, Homo sapiens
  misc_feature: GYAE6OF01DFCIF.43.34.D01.1.454.CMB.1.raw
  modified_base (208)..(208): a, c, t, g, unknown or other
  misc_feature (208)..(208): n is a, c, g, or t
  modified_base (370)..(370): a, c, t, g, unknown or other
  misc_feature (370)..(370): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacagggtcctgggtccagtctgccctgactcagcctgcctcgtgtcgtgggtctccgtggactagtcgatcaaccntcctctgcacgtcggaaccgcagtgacttgggtggtagttatacgtccttcgtcctccgtggtaaccaagtcgaccaccgaggaccaaaccgtaccccaaactcaagtgtaatttagtaggacggactaacgtaacggccggtacccgtgtacgggtttacngtactcgtcgttctcgtcggtacctacgaacgttcgtacggacgaaaccgtccggtacctccgtaacacgtactccgtcggtcggtccctccgaggtcgacggacggacggacggtccgtagttactttagttacgttgcgtactcgtactacgtgtacggtacgttaattacgtactagtttacgtcgttagtacggtaggttacggacgttccggtaccgtaccgtaccgtacgtacacggacccagcccctaaacccg

SEQ ID NO: 184821 - DNA, 523 bp, Homo sapiens
  misc_feature: GYAE6OF01BKVW0.43.34.D01.1.454.CMB.1.raw
  modified_base (299)..(299): a, c, t, g, unknown or other
  misc_feature (299)..(299): n is a, c, g, or t
  modified_base (326)..(326): a, c, t, g, unknown or other
  misc_feature (326)..(326): n is a, c, g, or t
  modified_base (427)..(427): a, c, t, g, unknown or other
  misc_feature (427)..(427): n is a, c, g, or t
  modified_base (433)..(433): a, c, t, g, unknown or other
  misc_feature (433)..(433): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggattatagcttgtctcctggtaccagtgcaccagcaaacgccccaaatcatgatttangaggcactaagcgcctcgagggtttcngatcgcttctctggctcgaagtctggcaacgcggcctcctagactatctcgtcgggctcccgaggctaggaggacgaggctagtatttattattgctgctnatatgntaggttacttactacttagtcgttcgttacggtagttgggaccgtacggtcctacggtctaggtccacgacccgaacgcccaacccgtcg

SEQ ID NO: 184822 - DNA, 566 bp, Homo sapiens
  misc_feature: GYAE6OF01CEYZ3.43.34.D01.1.454.CMB.1.raw
  modified_base (223)..(223): a, c, t, g, unknown or other
  misc_feature (223)..(223): n is a, c, g, or t
  modified_base (262)..(262): a, c, t, g, unknown or other
  misc_feature (262)..(262): n is a, c, g, or t
  modified_base (293)..(293): a, c, t, g, unknown or other
  misc_feature (293)..(293): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccngcagtgatggttggattatagcttgtctctgtaccagtncaccaggcaaacgccccaaatcatgatttangaggacactaacgcgcctgtagggtttctgtactcgtcttctcgtcggctaccgaacgtccgacgtaaccgaaccgtccgtccctacgacgtaaacctcgttaccgtcggcgtaccgtcggacgtcggacggacggaacggtcgtacgtagtttaatttacttcgtacgtgtctacctatagttcagtacgttagttactacttagttgtcgttacgtacggtaggtacggacgtcgaccgtacgtactacggaccacgaccgacaccctacg

SEQ ID NO: 184823 - DNA, 793 bp, Homo sapiens
  misc_feature: GYAE6OF01EVY5C.43.34.D01.1.454.CMB.1.raw
  modified_base (215)..(215): a, c, t, g, unknown or other
  misc_feature (215)..(215): n is a, c, g, or t
  modified_base (222)..(222): a, c, t, g, unknown or other
  misc_feature (222)..(222): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacgagggtcctgggcccagtctgccctgactcagcctgcctcgtgtctggtctcctggacagtcgatcacatctcctgctacncgaaccngcagtgtatggttggaattactacgtcctttgtcctccgttaggtaaccaagtccgaccacccgaagggacccaaaaccgaccccctaaaacgtcaacttgtaatttagacggacgggtaccaacgttaacggcccggtcccgtaggttacggggtttctacggtacgttccgtcgtttaccgtcggtacggtacccttaccgtaaacgttccggtacggtaacccgaaacccggtacccggtccccttaacccggtcgtaaaaccttaccgttcccgttacgggttccggggtaccccttaccggggtacgggtacgtaacgggaaccgggtaccgggtaacgtcgtttaaggtaattttaccgttacgtgtaaccgttcgtaaccttaagtagttaaccgtcggttaacggttaaggttaacctttaacgttaacgtttaacgtttcgggttaaccgttacggggtaacggttacggggaacccgtacccgggttacccggtacgttaccccgggttaaggaaccccgtaaccccaacccgggtaaacccgaccccggttaaacccccg

SEQ ID NO: 184824 - DNA, 547 bp, Homo sapiens
  misc_feature: GYAE6OF01B4807.43.34.D01.1.454.CMB.1.raw
  modified_base (306)..(306): a, c, t, g, unknown or other
  misc_feature (306)..(306): n is a, c, g, or t
  modified_base (338)..(338): a, c, t, g, unknown or other
  misc_feature (338)..(338): n is a, c, g, or t
  modified_base (443)..(443): a, c, t, g, unknown or other
  misc_feature (443)..(443): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatccaccatctcctgcactggaaccagcagtgatggttagggattatagccttgtctcctggtaccagtgcacccaggcaaacgcccccaaatcatgatttanggaggcaactacgccggcctgtacgggtttcngactcgcttctctggcctccagtcgtgacaacgcggtcctcctagacatctcgtcggctccgagtcgtaggacggacggaggtctagtattatttagtgctgctnatagtcgagttaagtagttactagttgtgttcgttaggtagttcgggaccgtacggtcacccgttcgtaacggtccaacggacccgaacggccccaacccgtcg

SEQ ID NO: 184825 - DNA, 738 bp, Homo sapiens
  misc_feature: GYAE6OF01CKISU.43.34.D01.1.454.CMB.1.raw
  modified_base (229)..(229): a, c, t, g, unknown or other
  misc_feature (229)..(229): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctccgtggacagtcgatccaccatctcctgcactgaaccngcagtgatgttgggatatagccttgtcctcgtgtaccaagtcgcaccgaggaccaaacgacccccaaatcatagtatttacgtaggacggactaacgtaacggccggtcccgttacggtaacggggttttcctacgtacgttccgtctttccgtcgttcggtacccttaccgtaacgttcgtacggaccctaaaccggtcccggtccccttaccgtacgaacctaacgttctccggtcggtcctaccggaggtcgtagggacgggtacgtacggtcgttagttaactttaagtttacgtcggtaccgttgtaccttacgtaattaccggttggtaccggttaaaggtttaacctttaccgttaacgttttaccgtttaggtttaccccgtttaggggttaacggttaccggggtaacccggttaacggttccccggttaacccgttaccgggttaacgttaccccgaaccggttaaccccgaaccgggaaccccctaaccccggttacg

SEQ ID NO: 184826 - DNA, 309 bp, Homo sapiens
  misc_feature: GYAE6OF01BW7DI.43.34.D01.1.454.CMB.1.raw
  modified_base (240)..(240): a, c, t, g, unknown or other
  misc_feature (240)..(240): n is a, c, g, or t
  modified_base (301)..(309): a, c, t, g, unknown or other
  misc_feature (301)..(309): n is a, c, g, or t
tcagtgtgagtagtcacgaccggtgctcgatttagatcgtctgtggtttggggtttgggtcaggggtttctgatcgcttctctggctccaagtctggcaacacggcctccctgacaatctctgggctccaggctggaggacgaggctgattattattgctgctcatatgcaggtattacacttatgtcttggaattggggacgacggtcaccgtcctaggtcagccaaggccaaaccccntgtcactctgttcccaccctctcactactcacactgagcggctggcaaggcgactaatagnnnnnnnnn

SEQ ID NO: 184827 - DNA, 765 bp, Homo sapiens
  misc_feature: GYAE6OF01EJHI3.43.34.D01.1.454.CMB.1.raw
  modified_base (265)..(265): a, c, t, g, unknown or other
  misc_feature (265)..(265): n is a, c, g, or t
tcagtgtgagtagtcacgaccggtgctcgatttagatcgtctgtggttggggtttggggggggtcacaagaggcagcgctctcgggacgtctccaccatggcctggctctgctgctcctcactctcctcgctcaggacacgacgggtcctcgggccagtctcgccctgacctcacgcctcgtccgttccgtcgtcgtcgggttcctccgtggacacggttcactaccacctacttcctcctgaccacgtacggaaccagcgtagnggtagttggtaggtagttatcgtcttcgttccgtcgtacgtacagtcgaccgtaccgaaggaaccgtaaacccaacccctaacgtactaagtacttaagttagacggacgactaacgtacggcgtcccgttaggtacggttcacggtacctcgttacttcgtcgtacgtacctacgtacgtcgtacgaccacggtcctcctaccgtacgaactcgtccgtcgtacggtactccggtagcggtacgggaacggagtacggttactttagttaaatttaacgtttcgttacgtacgtactaccgtaagttacgtacggtacgttaacggttaaggtttaacctaactttaaacgggtttacgtttcgggttttaaacggtaacggtttacggggttaccggggtaacccggttaacccggtaacccgtttaccgggtaaccgtacggttaaaccccgaccggttaaaacccgacccccggttaaaccccaccgtttacccgg

SEQ ID NO: 184828 - DNA, 562 bp, Homo sapiens
  misc_feature: GYAE6OF01B9PRS.43.34.D01.1.454.CMB.1.raw
  modified_base (309)..(309): a, c, t, g, unknown or other
  misc_feature (309)..(309): n is a, c, g, or t
  modified_base (341)..(341): a, c, t, g, unknown or other
  misc_feature (341)..(341): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatggttgggattatagtccttgtcctcctggtaccaagtcgccacccgaggaccaaacgcccccaaactcatgtatttanggaggcacgtaagccggccctgtagggtttcngatcgtcttctcgtggctcgaagtctggaccaacgccggtcctaccgtgactaactctacgtcggcctccgaggctggacggacgaggctagtatttagttatcgctcgactatagtatacgtacgtaggttatactattagtcgttacgtacggtaagttgggaccgtcggtaccgtaccgtacgtacggtacaccgacccgaacggtcccctaaccccg

SEQ ID NO: 184829 - DNA, 779 bp, Homo sapiens
  misc_feature: GYAE6OF01EBD2N.43.34.D01.1.454.CMB.1.raw
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtcgtgggtctcctggacagtcgatcaccatcctcctgcactggaaccagcagtgattggttggagtttatagtcccttgtcctccgtgggtaaccaagtcgaccacccgtaaggaccaaaaccgacccccaaactccgatcgtaattttagcggagggctaaacgtaacggccggtcccgttacggtacggggtttctagtactcgtcttcgtcgtcgcctacgtaagtccgtaggtacaaccgacccggtcccttacccgtacgtaacctaacgttccgttaccggtcgggttaccctacccggtaacggacggttaacgggaacgggtaaccgggtaacgggtccgtttaaggttaaactttttaacgtttaacgttttcgtaccgttacgttaccgttacctaagttaacgttcggtaacggttaacggtttaacgtttaaccgtttaccgtttaaagtttccggtttacggtttaacgggttaacggtttacggggtaacccgggttaccggttacccggtaacccggttaccgttaaccgggtccgaacccggaaccccggtaaacccggacccccgtaaccccgtaaccgg

SEQ ID NO: 184830 - DNA, 595 bp, Homo sapiens
  misc_feature: GYAE6OF01DS9TP.43.34.D01.1.454.CMB.1.raw
  modified_base (228)..(228): a, c, t, g, unknown or other
  misc_feature (228)..(228): n is a, c, g, or t
  modified_base (310)..(310): a, c, t, g, unknown or other
  misc_feature (310)..(310): n is a, c, g, or t
  modified_base (343)..(343): a, c, t, g, unknown or other
  misc_feature (343)..(343): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccngcagtgatggtgggattatagccttgtctcctggtaccaagtgccaccgaggacaaacgacccccaaactcatgtatttagnggacggcaactaaggccgccctcgagggtttcngtactcgctttctcgtcggcttaccagtcgtggacaaccgacggccctacccgtagactactccgtcgtcgggcctccgaggctggaacggcgagtctagtatttattgtgtctcgcttacagtagtgtacgtaggttacgttactatttacgttcgttcgttacgggtaagttcggggaccgtacgggttcctacccgggttcctacggtaccgaaccgtaccccaaaccgggtccccaaccccgttaccg

SEQ ID NO: 184831 - DNA, 640 bp, Homo sapiens
  misc_feature: GYAE6OF01CA2JV.43.34.D01.1.454.CMB.1.raw
tcagtgtgagtagtcacgaccggtgctcgatttagatcgtctgtgttgggctggggtcacaagaggcagcgctctcgggacgtctccaccatggcctgggctctgctgctcctcactctcctcgctcaaggacacgaggggtcctcgggcccagtcctcgccctgactcagcctgcctcgtgtctgggtctccgtggacagtcgatcaccatcctctgcacgtggaaccagcagtgagttggttagggattagacgtccttgtctcgtacggtaaccagtcgccaccgaggaccaaaccgtaccccaaatcgaattcgtaatttagcggaaggtacacgtacggccggccgttaggtacgggtttcagtactcgtcttctacgtcggctacgaagtcgtacggacaacgtccgcctccagactactccgtcggtcggcctacgacggtcgtaggacggacgtcgtcttagtacgtttagttatcggtactcggacttactattacggcgtaacggttacggttaacttaaccgtacgtttagtaccggtttacggttacgggtaacgttggggtaaccggtaccgtcccggtaacgttccgtaacggaccgtaccgacccgtaaacgtccccgtaaaccg

SEQ ID NO: 184832 - DNA, 766 bp, Homo sapiens
  misc_feature: GYAE6OF01CT2ER.43.34.D01.1.454.CMB.1.raw
  modified_base (225)..(225): a, c, t, g, unknown or other
  misc_feature (225)..(225): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatcctctgcacgtaggaaccngcaggtgagttggttggtagttatagtccttgtcctccgtaggtaccagtcgaccacccgaggaccaaaccgaccccctaaactcatacgtatttagtacggacggacaacgtaacgccggtcccgtacggtaggggtttcctggtacttccggtcttcgtcgtcggtacctccgtaagtccgtaggaccaaccgaccggtcccctcccgtacgaacctaactttcccgtacgttcgggacccctaccggacggtcggtacggaacgggaacggtacgggtactaacggtttaattttacgttactttcggtacgttacggtaccttacgtaagtttacgtcgggtaacgttaacgggttttaacggttaaccttaacggttttaacgttccgggtttaaccggttaacgggggttaaacggtttcgggggtaaaccccggttaccggttaaccccgttaacccgggttaccggtttaaccgggttaacccgaacccggttaaacccccggaaacccggtaaccccccgtaaaacccccgg

SEQ ID NO: 184833 - DNA, 696 bp, Homo sapiens
  misc_feature: GYAE6OF01DF0IC.43.34.D01.1.454.CMB.1.raw
  modified_base (544)..(544): a, c, t, g, unknown or other
  misc_feature (544)..(544): n is a, c, g, or t
  modified_base (580)..(580): a, c, t, g, unknown or other
  misc_feature (580)..(580): n is a, c, g, or t
  modified_base (585)..(585): a, c, t, g, unknown or other
  misc_feature (585)..(585): n is a, c, g, or t
tcagtgtgagtagtcacgaccggtgctcgatttagatcgtctgtgttgggctggggtcacaagaggcagcgctctcgggacgtctccaccatggcctgggctctgctgctcctcacctctcctcgctcaggacacgagggtcctcgggcccagtctcgccctgacctcacgtccctcgcctccgtgtcgttcgggtcctccgtaggactaggtcactaccacctatcctcctgcctacgtacggaaccagctaggtgtagttcgggttagggtaagttatacggtccttcgtacctccgttacggtaacctaagtcgacccgaaccgacggaaccaaaccccggaccccctaaaatccgtaagtagttaagtttagtaacgggacggtacctaaacggtaccggtcccggtacccggttccgttagggtttctacgtacgttcgtaccttcgtacgtcggcccttacgtaacgtcgtaacgacccgaccgtccgtcccctacctacgtaactactcgtccggtacggtaccctccgaggtacgnggtaacggacggtacgtcgttagttatttagttgtntcgtntactatatgacgtgttaagtacttattacgttgtcgtcgttaggttacggtacggaccggttcggaccttaccgtacgtacgtaccacccgacccaaccgtaccctacccg

SEQ ID NO: 184834 - DNA, 704 bp, Homo sapiens
  misc_feature: GYAE6OF01DC637.43.34.D01.1.454.CMB.1.raw
  modified_base (204)..(204): a, c, t, g, unknown or other
  misc_feature (204)..(204): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctcgccctgacctcacgcctgcctccgtgtcgtgggtcctcctggacngtcgatccaccatccgtcctgactacgtacggaaccagcaggtgtagttggttgggtaattagtacgtccgttgtccttccgtacggtaccaagtcgaccaccgaggaaccaaaccgaccccaactctaagtgtaattagtacggaacgggacctaacgtaaccggcccggtacccgtacggtacgggttctaggtaccttcgtcttttccgcgttcggtacctccgtaagtccgtacgaccgaaccgtccgtaccctaccgtacgactacgtcgtcggtcgctacgagtcgtaggacgtacggaggtctagttatttagttacgtgtcgtcgtacctagtatacgtacggtaacgttagttaaccgttattaaccgtttagtcgggttaccggttaggtaaacgggtttcggaacccgggttaacggttcccgttaacccgggttacgttacgggtacctaacccggaacccgaacccgtaaccccgtacccgtaccgg

SEQ ID NO: 184835 - DNA, 750 bp, Homo sapiens
  misc_feature: GYAE6OF01B1CQ7.43.34.D01.1.454.CMB.1.raw
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacgcgggtcctcgggcccagtctcgccctagactcacgtcctgccctccggtgtcgttcggtcctcgtaggacagtcgactaccaccgtactcctccgtcgacacgtacgaaccagactagtgtagttgggttaggtattagtacgtcctttagtccgttaccgtacggtaaccgaagtccgacccgtaaccggacggaacccaaaacccgtccccctaaaagttcctagttacgttagtttacggacgggtacggtaacctaacggtaccggtacccggtaccgttacgggttacggttcgacggtacgttccgttcttccgtcgttcgacctacgtcgtccgtacgaccaccggtaccgtcctacgagtactacttcgtcgtacggtaccacgtcggtacgtacggacggacgttacgtcgttaacgttaatttagttcgacgttccgtagtcccttaaacgtgttaccggtagggttaaccttaagggtttacttaaccgttaaggttacggttttcgggtaaccgtttaaggggtaccgttaaccggggtaccttccggtacccgtacgttaacgtacggaccccgaacgtaccccgaccgtaacccctaacgg

SEQ ID NO: 184836 - DNA, 713 bp, Homo sapiens
  misc_feature: GYAE6OF01CXSEH.43.34.D01.1.454.CMB.1.raw
  modified_base (248)..(248): a, c, t, g, unknown or other
  misc_feature (248)..(248): n is a, c, g, or t
  modified_base (435)..(435): a, c, t, g, unknown or other
  misc_feature (435)..(435): n is a, c, g, or t
tcagtgtgagtagtcacgaccggtgctcgatttagatcgtctgtgttgggtcggtggggtcacaagaggcagcgctctcgggacgtctccaccatggcctgggctctgctcgcctcctcactcctcctcgctcacggacacgagggtcctgggccctagtcctcgccctcgactcacgcctcgtccgtccgtgtcgtcggtctccgtggaccagtcgactcaccactcctctcgaccacgtagaaccngcgtagtgtagttggtggtactttacgtacgttccttcgttcctaccgttacggtaaccgtaacgtccgaaccgtaccccggaaacgaacccaaaccgtaccccctaaagttactacgttagttaacgtttacgacggtaccggaccttacggtaccggcccggttaccgtacggttacggtttacncggtacgtccgttacgttcgtcgttacgacctacggttacgccgtacgaccgtacgccgtcccttacgagttaccacgttcgtacggcgtaccgacgtacggcgtacgggtacgaaccggttacgtcttacggtaatttacgtcgttacgcgtacgtaactacgtacgttaagtccggttaagttacgtacgttaacgtcttacggacggttacgtaggtacgtaccggacgtccgacgtccgttacgacgtacccgagaacccgtcgtacccgtacc

SEQ ID NO: 184837 - DNA, 666 bp, Homo sapiens
  misc_feature: GYAE6OF01AI1JZ.43.34.D01.1.454.CMB.1.raw
  modified_base (231)..(231): a, c, t, g, unknown or other
  misc_feature (231)..(231): n is a, c, g, or t
  modified_base (370)..(370): a, c, t, g, unknown or other
  misc_feature (370)..(370): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctccgtggacagtcgatcaccatcctcctgcacgtggaaccngcagtgattggttagggattatagtccttgtcctccgtggtaccaagtcgccacccgaggacaaaccggcccccctaaagtcaactgtaatttagtaggacgggcaacgtaaggcccggtaccctcggtagggttttcngactccgtcttactcgtcggtcctacctaaggtcgtacggaccaaaccgtccggtaccctccgtagtacctacgttcctacggtcgggtcctaccgacgggtctagggaacgggaccgaggtccgtagtactttagttcttcggcttgcttacgtatacgtgacgttaggttaacttacgttaacttggttcgttacgttaaccgggttaggtttaccggggaacgttccggacccgttaccggtaccgttaggtacccacccggtaacccgaccgggacccccttaacccgtacg

SEQ ID NO: 184838 - DNA, 598 bp, Homo sapiens
  misc_feature: GYAE6OF01BIBPO.43.34.D01.1.454.CMB.1.raw
  modified_base (229)..(229): a, c, t, g, unknown or other
  misc_feature (229)..(229): n is a, c, g, or t
  modified_base (460)..(460): a, c, t, g, unknown or other
  misc_feature (460)..(460): n is a, c, g, or t
  modified_base (474)..(474): a, c, t, g, unknown or other
  misc_feature (474)..(474): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctccgtggacagtcgatcaccatctcctgcactggaaccngcagtgagttggttagggattatagtccttgtctcctggtaccaagtcgccaccgaggaccaaaccgacccccaaatcatagtatttagtaggagggacacgtaacggccggtccctcggtacgggtttctgtactccgtctttctcgtcggctaccgtaagtcgtcggactaaccgccgtccctccgtagactactcctcgtcgggtctccgaggtcgtaggacggacgnggtactgtaacttnttatgctgctacatatgtactaggttacttactacttagtcgttcgtacgggtaagtcgggtaccggttaccggttccgtacggtacgtccgtaaccggacccaacggcccaaccgtcgtaccg

SEQ ID NO: 184839 - DNA, 350 bp, Homo sapiens
  misc_feature: GYAE6OF01B685Y.43.34.D01.1.454.CMB.1.raw
  modified_base (162)..(162): a, c, t, g, unknown or other
  misc_feature (162)..(162): n is a, c, g, or t
  modified_base (313)..(350): a, c, t, g, unknown or other
  misc_feature (313)..(350): n is a, c, g, or t
tcagtgtgagtagtcacgaccggtgctcgatttagatcgtctgtgttgggtttgggtcgaggggtttctgatcgcttctctggctccaagtctggcaacacggcctccctgacaatctctgggctccaggctgaggacgaggctgattattattgctgcttnatatgctaggtagttacacttatgtcttcggaattgggacgacggtcaccgtcctaggtcacgcccctaaggcccaaccccatgtccactcgtcgttccccgccctcctcactactcacactgacgcggtctcggcaaggccacgatacgnnnnnnnnnnnnnnnnnnnnnnnnnnnnnnnnnnnnnn

SEQ ID NO: 184840 - DNA, 610 bp, Homo sapiens
  misc_feature: GYAE6OF01AZ9AH.43.34.D01.1.454.CMB.1.raw
  modified_base (228)..(228): a, c, t, g, unknown or other
  misc_feature (228)..(228): n is a, c, g, or t
  modified_base (313)..(313): a, c, t, g, unknown or other
  misc_feature (313)..(313): n is a, c, g, or t
  modified_base (482)..(482): a, c, t, g, unknown or other
  misc_feature (482)..(482): n is a, c, g, or t
  modified_base (488)..(488): a, c, t, g, unknown or other
  misc_feature (488)..(488): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccngcagtgattggttagggagttatagccttgtcctcctggtaccaagtcgccacccaggacaaacgcccccaaatcatgtatttanacggaggacacgtaacgccggtccctgtacggggtttctggactcgcttcgtcgtcggtcctacctaagtctcggacccaaccgacccggtccctacccgtagacctaacttccgtcgtcgggcctccgaggctaggacgacgaggtctagtatttattagtcgtcgtntcctanattacgtgtacgttaaggttacgttaactacgttagttcgttacgttacggtaaggttcgggaccgtacggtcctacccggttcgtacggtccgaccgacccgaccggaccctaacccgtcg

SEQ ID NO: 184841 - DNA, 637 bp, Homo sapiens
  misc_feature: GYAE6OF01A8719.43.34.D01.1.454.CMB.1.raw
  modified_base (352)..(352): a, c, t, g, unknown or other
  misc_feature (352)..(352): n is a, c, g, or t
  modified_base (588)..(588): a, c, t, g, unknown or other
  misc_feature (588)..(588): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatccaccatctcctgcactggaaccagcagtgatggttgggagttatacgccttgtcctcctggtaaccaagtcgccacccgaggccaaacgcccccaaactcatgtatttatggaggtcaactaacgccggcctcggtaggggtttcngtactcgctttctcgtcgctcgaacgttcgacggaccaaccgaccggtccctcctagaacctaactccgtcgtcgggtcctaccgagggtctaggaacgggacgtacggtacgttagtaaactttagtttacgttgtccgttagtacctacattacgtcggacgttaaggttacttaacctaacgtttgtcggttacggttaggtaaacggtttcggggaccgttaccgggtaccncggttaccgtacggtaccgaccgaccccgtaacggccccaacccgtacg

SEQ ID NO: 184842 - DNA, 366 bp, Homo sapiens
  misc_feature: GYAE6OF01A7QTY.43.34.D01.1.454.CMB.1.raw
  modified_base (140)..(140): a, c, t, g, unknown or other
  misc_feature (140)..(140): n is a, c, g, or t
  modified_base (314)..(314): a, c, t, g, unknown or other
  misc_feature (314)..(314): n is a, c, g, or t
  modified_base (317)..(318): a, c, t, g, unknown or other
  misc_feature (317)..(318): n is a, c, g, or t
  modified_base (320)..(366): a, c, t, g, unknown or other
  misc_feature (320)..(366): n is a, c, g, or t
tcagtgtgagtagtcacgaccggtgctcgatttagatcgtctgtgttgggtttgggtcaggggtttctgatcgcttctctggctccaagtctggcaacacggcctccctgacaatctctgggctccaggctggaggacgnggctgattattattgctgctcatatgcaggtattacacttatgtcttacggaattggggacgacggtcaccgtcctaggtcagcccaaggcccaaccccatgtcactctcgttccccgcctcctcactactcacctactggacgccgggctggacaaacggcgtactagtacgncgnnannnnnnnnnnnnnnnnnnnnnnnnnnnnnnnnnnnnnnnnnnnnnnn

SEQ ID NO: 184843 - DNA, 792 bp, Homo sapiens
  misc_feature: GYAE6OF01BJPXS.43.34.D01.1.454.CMB.1.raw
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacgagggtcctgggcccagtctcgccctgactcagcctgcctccgtgtcgtgggtctccgtggacagtcgatcaccatctcctgcacgtacggaaccagcagtgagttggttagggtaagttatacggtcctttcgtccttccgttacgggtaacctaaggtcgacccgaccgacggaccaaaaccgaccccccaaactacctaagttagtagtttagtcgggaacgggactaaccggtaacggcccggtccccgttacggttacggggtttcctacggtacgttccgttccgtttccgtacggtcggtaccttaccgtaacgttcggtacggtaacccgtaaccggtacccgggtccccttacccgttacgaacctaaccgttccgttcggtaccgggtacccttaccggacggtacgtacgggaacgggaccggtacgggtacttaagttacttttaagtttactcggtacttacggtaccttacgtaagttacgtacggttacgttaacggttaacgtttaactaccgttttaacgttccggtaacggtttaacgggtaacggttaccggggtaaccggtaccggtacccgttaaacccggtccggttaacggtacccgaacccgtaacccggaaacccgtaaccccgtaacccccg

SEQ ID NO: 184844 - DNA, 710 bp, Homo sapiens
  misc_feature: GYAE6OF01AOUG6.43.34.D01.1.454.CMB.1.raw
  modified_base (231)..(231): a, c, t, g, unknown or other
  misc_feature (231)..(231): n is a, c, g, or t
  modified_base (352)..(352): a, c, t, g, unknown or other
  misc_feature (352)..(352): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacgagggtcctgggcccagtctgccctgactcagcctgcctcgtgtctgggtctcctggacagtcgatcaccatcctcctgccactcggaaccngcagtgagtggtagggtagttatacgtccttgtctccgtggtaccagtcgaccaccgaggaccaaaccgcccccaaatcatgtattgagaggcacgtaagccggtaccctggtaggtttcngtacttcgtcttctcgtcgccttaccgaagttcgtcggacctaaccgccggtcccctaccgtagtaacctaacgttccgttaccggtcggtccctaccggtagggtccgtaggggaaccggacggtaggtcctttaggttaacttttaacgtttacgttgaccgttacggtacctttaacgtaagttacgtacggtaaccgtaaggtttaccgttaacgtacggttttattccgggtttaaccgtacgggttaaacggttccgggggtaaccggtacccggttcgtaaccccgggttaccgtacggtaacccgacccgtaaccccggaaacccgggtccccctaaacccgttacccgg

SEQ ID NO: 184845 - DNA, 685 bp, Homo sapiens
  misc_feature: GYAE6OF01EBA0I.43.34.D01.1.454.CMB.1.raw
  modified_base (222)..(222): a, c, t, g, unknown or other
  misc_feature (222)..(222): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctctaggacacagggtcctgggcccagtctgccctgactcagcctgcctcgtgtctgggtctctggacagtcgatcaccatctcctgcactggaaccngcagtgatgttggattatagtccttgtcctcctaggtaaccagtcgcacccgagtacaaacgcccccaaactcactggtaatttagtcggaggtacaacgtaaggccggtaccctcggtacgggtttcctagactcgtcttcgtcgtggtccttaccgaagtcgtaggccaacgccggccctaccctagaactactccgtacgtcgggtcctccggaggtaccgttacggacgggaccggtaggtaccttaggtaatttagttaacttcggtcttcggtcctactaagttacgtcggtacgtaagggtttacctttaacgaccgttttaaggttcggtttacccggtttacgggtaaacggtttccgggggaaaccggttacccgggttaaccgtaccccgggttaccgttacggtaaccccgaaccggtacccccgaaacgggaccccccttaaaacccccg

SEQ ID NO: 184846 - DNA, 687 bp, Homo sapiens
  misc_feature: GYAE6OF01B06NN.43.34.D01.1.454.CMB.1.raw
  modified_base (215)..(215): a, c, t, g, unknown or other
  misc_feature (215)..(215): n is a, c, g, or t
  modified_base (250)..(250): a, c, t, g, unknown or other
  misc_feature (250)..(250): n is a, c, g, or t
  modified_base (342)..(342): a, c, t, g, unknown or other
  misc_feature (342)..(342): n is a, c, g, or t
  modified_base (404)..(404): a, c, t, g, unknown or other
  misc_feature (404)..(404): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacgaggggtcctgggccccaggttcctcggcccctagactcagtccctgtcccgtccgtgtccgttcgggtcctccgtggacngtccgatccaccatcctcgtgcactacggaaaccngcgagtgagttggttaggaagtttatcgtccgtttgttcctccgttaggacctaagtccgacacccgaggaaccaaaccgtccccaaaactntagttagtagtttacgaggacggactaacgtaccggtccggtaccgttacggttacgggttntcgacgttcgtctttcgcgttggaccctacgtaagtccgtggaccgaacggtcccgtcctaccgtacgtaactacctcgtcgtacggcctcggagcgtacgggacggttgacggtatttacggtattttacgttacgcgtcttcgacttaggtattagtccgtaaggtaagtttaccgtacttaacgtttgtccggttaacggttaggtaaccgtacggggtactacggttaccgtccggtttaacgcgggtaaccacccgaccggtaaaccgccccgtaacg

SEQ ID NO: 184847 - DNA, 817 bp, Homo sapiens
  misc_feature: GYAE6OF01EWHVY.43.34.D01.1.454.CMB.1.raw
  modified_base (199)..(199): a, c, t, g, unknown or other
  misc_feature (199)..(199): n is a, c, g, or t
tcagtgtgagtagtcacgaccggtgctcgatttagatcgtctgtgttgggtttggggggggtcacaagaggcagcgctctcgggacgtctccaccatggcctggctctgctgctcctcactctcctcgctcaggacacgagggtcctgggcccagtctcgccctgactcagcctgcctcgtgtcgtggtctcgtggacngtcatcacatcctcctgacacgtaggaaccagctagtgtagttggttagggtaatttagtacgtcctttcggttcctcccgttacggtaaccctaaagttccgacccgaaccccgaaggtaaccccaaaacccgtacccccctaaaactcctaagttacgtaacttttaagtaggaacgggtaacctaaccgttaaccgggcccggttacccgttacgggttaacgggttttcacgttaacgttccgtctttaccgttcgtacggtccttaacccgtaagtccgtacggaacccaacggtacccggtcccttacccgtagtaacctaaccgttccgttcggtacgggtcctacccggtaggccggttaggaacggacggtacggtccgttaagttaacggtttactttaagttcggctttacggtaccttacgtaagttacgtacggttaccggttaacgggtttactttaaccgttaaccgtttggttacccggtttacggtttacgggtaaaacgggtttcccgggtaaccgttaacccgggtccttaaccccgggttagtaacccggtacggaaccccgaacccggtaacccgaaccccgtaaccccgttaacgg

SEQ ID NO: 184848 - DNA, 581 bp, Homo sapiens
  misc_feature: GYAE6OF01ASCVW.43.34.D01.1.454.CMB.1.raw
  modified_base (358)..(358): a, c, t, g, unknown or other
  misc_feature (358)..(358): n is a, c, g, or t
  modified_base (447)..(447): a, c, t, g, unknown or other
  misc_feature (447)..(447): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatccaccatcctcctgccactggaaccagcagtgatggttgggagttatacgcctttgtcctccgtggtaccaagtcgaccacccgaggaccaaaccgaccccccaaatcatagtatttagtgaggcactaacggccggccctggtagggtttcngtactcgtcttctcgtcggcctccgaagtcctagaccaaccgccggtccctcctgactacttctcgtggcctccgaggctggagacggngtctagtattattacgtgtctagcttacagttacgtcgtacgtaggttacttactacttgtacgttagtacggtaggttcgggacgtcggtcctacgtccgtacggtacacggacccaacggccccaacccgtg

SEQ ID NO: 184849 - DNA, 717 bp, Homo sapiens
  misc_feature: GYAE6OF01DUOLM.43.34.D01.1.454.CMB.1.raw
  modified_base (228)..(228): a, c, t, g, unknown or other
  misc_feature (228)..(228): n is a, c, g, or t
tcagtgtgagtagtcacgaccggtgctcgatttagatcgtctgtgttggggtttggggggggtcacaagaggcagcgctctcgggacgtctccaccatggcctgggctctgctgctcctcactctcctcgctcaggacacgagggtcctgggcccagtctgccctgactcagcctgcctcgtgtctgggtctcctggacagtcatccacatctcctgcactggaaccngcaggtgagttggttagggattatacgtccttgtcctccgtaggtaccaagtcgaccaaccgaggaccaaaccgaccccctaaatctagtagtaatttagaggagggactaacgtaacggccggtaccctaggtacgggtttcaggtacgttcgtctttcgtcgtggtaccctacgtaagtccgtcggacctaaccggtaccggtccctacccgtaagacctaacgtccgtaccgtcgggacctacgacgggtcgtagggacggtacggagtcgttagttaatttagtttagtcgtaccgtacgtcctttaacgactttacgtcggtaaccggtttaggtttaaccgtttacttaacggttttacgttacgggtttaccgttacggggttaaacgggttaccggggtaccggttacccgggttacctaaccccggttacggttacggtacccaaccggtacccggaacccgtaccccctaacccgtcgg

SEQ ID NO: 184850 - DNA, 942 bp, Homo sapiens
  misc_feature: GYAE6OF01DU7LH.43.34.D01.1.454.CMB.1.raw
  modified_base (182)..(182): a, c, t, g, unknown or other
  misc_feature (182)..(182): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggaccacgagggtcctgggcccagtctgccctgactcagcctgcctcgngtcgtgggtctccgtggactgtcatcacctatcctcctgcctacgtcggaaccagcgagtgagttggttgggattagtacgttccgttcgtccttaccgttacggtaaccgaacgtcggacccaaccgacgggaaccaaaaccccggaacccccctaaaacgttccgtaaagtttaggttaacgttttacggaagggtaccgggaacctaaaccggttaaccgggccccggttacccgttacggggttaacgggggttttcctacggggtacttccggttacctttcggttaccggtccggtacccgttacggtaaacggtcggttaccggaaccggtaaaccgtcccgggtcccctttaaccgacggtaaacctaacgtttcccgtaccggttcggggtacccttacggacgggtacgtacgggaaccgggtaacgtcggggtacctttaagggtaacctttttaggtttaacgtccggttaccgttaacggtacttttaaccgtaaaggtttacgggtaccgggtttaaccggtttaacggggttttaactttaccgtttaaacggtttaacccggttttcgttaaacccggggttttaaacggggttttaggggttaaaacccccgggggtaaggggtttaccccccggttaacgttaccccgggggtttaaccccttaaaccgggggaacccgttaaacccccggaaaccccccggtaaacccgggtaaccccccgtaaaccccccggtttaacgg

SEQ ID NO: 184851 - DNA, 624 bp, Homo sapiens
  misc_feature: GYAE6OF01EK4CC.43.34.D01.1.454.CMB.1.raw
  modified_base (233)..(233): a, c, t, g, unknown or other
  misc_feature (233)..(233): n is a, c, g, or t
  modified_base (281)..(281): a, c, t, g, unknown or other
  misc_feature (281)..(281): n is a, c, g, or t
  modified_base (315)..(315): a, c, t, g, unknown or other
  misc_feature (315)..(315): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacgacgggtcctcgggcccagtcctcgccctgacctcacgcctgcctccgtgtcgtgggtctccgtgacagtcactcacctatctcctgcacgtggaaccngcagtgagttggtgggtattatagtccttgtcctcgtggtaccagtcnccaccgagacaaccgacccaatcgatgtattagngacgtcacgtacgccggtacgttcggtacggttctagactcgtcttcgcgtcgtctacgagtccgacggacaccgtaccggtccctaccgtacgacctaacgtcgtacggtcggccctaccggaggtcgtacggaaggacggtagtcgttagttacgtttaagttccgtcggtactcgtactcgtaagttacgtccggtacgttacggttacttaccgtagtttacgtcggttactaacgggtcggttaacgggacgtccgtaccgtaccggttactacggaccgtaccgaccgtaccggccgtacccg

SEQ ID NO: 184852 - DNA, 700 bp, Homo sapiens
  misc_feature: GYAE6OF01CNYOU.43.34.D01.1.454.CMB.1.raw
  modified_base (213)..(213): a, c, t, g, unknown or other
  misc_feature (213)..(213): n is a, c, g, or t
  modified_base (331)..(331): a, c, t, g, unknown or other
  misc_feature (331)..(331): n is a, c, g, or t
  modified_base (367)..(367): a, c, t, g, unknown or other
  misc_feature (367)..(367): n is a, c, g, or t
  modified_base (381)..(381): a, c, t, g, unknown or other
  misc_feature (381)..(381): n is a, c, g, or t
  modified_base (447)..(447): a, c, t, g, unknown or other
  misc_feature (447)..(447): n is a, c, g, or t
tcagtgtgagtagtcacgaccggtgctcgatttagatcgtctgtgttggggtttggggggggtcacaagaggcagcgctctcgggacgtctccaccatggcctgggctctgctgctcctcactctcctcgctcaggacacagggtcctgggcccagtctgccctgactcacgcctgcctccgtgtctgggtctccgtggacagtcgatcaccntcctcctgcacgtcggaaccagcagtgagtggttagggtattatacgtcctttgtcctccgtaggtaaccaagtcgaccacccgagaccaaaccgcccccaaatcagtgtaatttagnggacggcaacgtacgccggtccctcggtagggttcngtacgtcgtcttcncgtggctacgagttcgcgaccaaccgcccgtccctaccgtgaacctacgtccgtcgtcgggacccnccggtagggtccgtagggaccggtacgggaacgtcttaagttattttaagtttgttcgacgttcggtaccttacgtagttacgttcgtacgttaacggtttaccttaccgttaacgtttacgttcggtttaaccgggtacggttaaggggttccggggtaaccgtacccgggttccccttaccgggttacccgtacgggtaaccccgacccggtaaccccggtaacccgacccccgtaacccccggttaaccg

SEQ ID NO: 184853 - DNA, 691 bp, Homo sapiens
  misc_feature: GYAE6OF01ESLB9.43.34.D01.1.454.CMB.1.raw
  modified_base (314)..(314): a, c, t, g, unknown or other
  misc_feature (314)..(314): n is a, c, g, or t
tcagtgtgagtagtcacgaccggtgctcgatttagatcgtctgtggttgggtttgggggggtcacaagaggcagcgctctcgggacgtctccaccatggcctggctctgctgctcctcactctcctcgctcaggacacagggtcctgggcccagtctgccctgactcagcctgcctcgtgtctgggtctccgtggacagtcgatccacgatctctgcactggaaccagcagtgagtgttggagttatagccttgtctcctggtaccaagtcgactacccaggccaaacgcccccaaactcaagtcgattttagngagggtcacgtaacgccgtccctcgagggttttcagtactccgtcttctcgtcggccttaccgaagttcgtacgggacctaaacgaccggtcccttacccgtgaacctaacgttcccgtcgttagggcccttccgtaacgggcgttacgggaacggtaccggagggtccttaggtaacgttttaacgttagtttcggccgttacgccttaacaagttacgtaggtacccgttaagggtttaaccgttaaccgtacgtttaagtaccggttttccgttaaccgggttaagtttccgggggaacccgttaccggttacccgtaccgttacccggttaaggtcccaacggtaccccaaaggttacccccaacccgttacg

SEQ ID NO: 184854 - DNA, 709 bp, Homo sapiens
  misc_feature: GYAE6OF01AWAT9.43.34.D01.1.454.CMB.1.raw
  modified_base (245)..(245): a, c, t, g, unknown or other
  misc_feature (245)..(245): n is a, c, g, or t
tcagtgtgagtagtcacgaccggtgctcgatttagatcgtctgtgttgggtttggggggggtcacaagaggcagcgctctcgggacgtctccacatggcctggctctgctgctcctcactctcctcgctctaggacacgagggtcctggggcccctaggttcctgcccttgacctcacgtcctcgcctccggtgtcgtgggtcctccgtggacaggtcgatccacactctcctgcacgtgaaccngctagtcgagttggttaggagttactacgtccgtttacggtccttaccggtacggtaaccgaacggttcgaccccgtaaccggtacggtaacctaaaacccggtaccccctaaaacgtccgtaacgtagtaacgtttacgacggtaaccgggactaaccggtaaccggtccgggtacccgttacggtacggggtttcctaggtaccgttccgtacttccgtcgtcggtacctacgtacgtcgtaccgacctaccgtcgccctacgtgaacctcgtccgtacgtcggtcctacggcgacgtacgaacggcgtacggtcttacgtagtttacgtcgtcgtctacgtcttacacgtacgtgtacgtaacgttctactacgttacgtcggtacggttacgtacgggtacggtcgtaccggtctacccgtcggtacgtaccgactacccggacctacccgacgttaccg

SEQ ID NO: 184855 - DNA, 808 bp, Homo sapiens
  misc_feature: GYAE6OF01BYWF2.43.34.D01.1.454.CMB.1.raw
tcagtgtgagtagtcacgaccggtgctcgatttagatcgtctgtgttggggtttggggggggtcacaagaggcagcgctctcgggacgtctccaccatggcctgggctctgctgctcctcactctcctcgctcaggacacgagggtcctgggcccagtctgccctgactcagcctgcctccgtgtcgtggtctccgtggacagtcgactcaccatcctcctgccacgtacggaaccagcagtgtagttgggttggtagttatacgtccttgtcctccgtggtaacctaagtcgaccacccgaggaccaaaccgacccccaaactacacgtacgttaatttagtacggagggacctaaccgtaacggtcccggtacccgttcggttaacggggtttcctagtacgtccgttacctttcgttccgtcggtccctaccgtacggttccgtacggaccgtaacccgaccgggtccctacccgtacgaaccgttaactccgttaccgtccgggacctacccggcggtacgtagggaccgggacgggtacggtccgttagtttaacgtttacgtttagttcgtccgttacgtacttacctaacgtttacgtacggtaacggttaacgtttaaccggtttaaacgttacgtttaacgggtttacgttttaccgggttaacccgggttaagggttaccggggtaaccgggttaaccggttccccgtaccccgggtttaacgttacccgggttaacccacccgggtaaacccccggtaaccccggtaacccccgtaaaacccccggtttaaccccgg

SEQ ID NO: 184856 - DNA, 313 bp, Homo sapiens
  misc_feature: GYAE6OF01AVLPC.43.34.D01.1.454.CMB.1.raw
  modified_base (297)..(297): a, c, t, g, unknown or other
  misc_feature (297)..(297): n is a, c, g, or t
  modified_base (302)..(313): a, c, t, g, unknown or other
  misc_feature (302)..(313): n is a, c, g, or t
tcagtgtgagtagtcacgaccggtgctcgatttagatcgtctgtgttgggtttgggtcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtccagcccaaggccaaccccgactcgtcactcgtcgttcccgccctacctcactctcacactgagcggctggccaaggcncatgnnnnnnnnnnnn

SEQ ID NO: 184857 - DNA, 757 bp, Homo sapiens
  misc_feature: GYAE6OF01DCJ81.43.34.D01.1.454.CMB.1.raw
  modified_base (149)..(149): a, c, t, g, unknown or other
  misc_feature (149)..(149): n is a, c, g, or t
  modified_base (216)..(216): a, c, t, g, unknown or other
  misc_feature (216)..(216): n is a, c, g, or t
  modified_base (236)..(236): a, c, t, g, unknown or other
  misc_feature (236)..(236): n is a, c, g, or t
  modified_base (259)..(259): a, c, t, g, unknown or other
  misc_feature (259)..(259): n is a, c, g, or t
  modified_base (333)..(333): a, c, t, g, unknown or other
  misc_feature (333)..(333): n is a, c, g, or t
  modified_base (742)..(742): a, c, t, g, unknown or other
  misc_feature (742)..(742): n is a, c, g, or t
tcagtgtgagtagtcacgaccggtgctcgatttagatcgtctgtgttggggtttggggggggtcacaagaggcagcgctctcgggacgtctccaccatggcctgggctctgctgctcctcactctcctcgctcaggacacgagggtccngggcccagtctcgccctgactcagcctgcctccgtgtcgtgggtctccgtggacagtcgatcaaccntctcctgacacgtggaaccngcagtgagtggttgggtaattanacgtcttgtctcgtacggtacagtcgaccaccgaggaacctaaaccgacccctaaatctagtagtatttacggnggaacggacaacgtacggccggacccgttaggtcgggttactcgtacgttccgtcttcgtcgtcggacctacgaacgttcgacggaacctaaccggtccggtccctacgtagtaaccttacgtttcgcggtcctacgaggtacgtagggacggtacggaggtcttaaggtatttacgtgtcgtcgtacgtaccgttaagtagttacgtcgggtaaaccgttagggttaaacctttaacccgttaggtttacccggttacggttttaccgggttaaaccgggtaaaggggttcccggggttaaacccggttacccgggtaaccggtttaccccgggttaccggttaaaccggggacccgtaaaccccgggtacccccggtaaacccggaaccccccctttaaacccgggngttttaaacccccgg

SEQ ID NO: 184858 - DNA, 682 bp, Homo sapiens
  misc_feature: GYAE6OF01CVNFF.43.34.D01.1.454.CMB.1.raw
  modified_base (323)..(323): a, c, t, g, unknown or other
  misc_feature (323)..(323): n is a, c, g, or t
  modified_base (478)..(478): a, c, t, g, unknown or other
  misc_feature (478)..(478): n is a, c, g, or t
tcagtgtgagtagtcacgaccggtgctcgatttagatcgtctgtgttggggtttggggggggtcacaagaggcagcgctctcgggacgtctccaccatggcctgggctctgctgctcctcactctcctcgctcaggacacagggtcctgggcccagtctgccctgactcagcctgcctcgtgtctgggtctccgtgacagtcatcactatctcctgcactaggaaccagctagtgagttggttagggagttatcgtcctttgtcctaccgtcggtaaccaagtcgaccaccgaggacaaaccgaccccaaatcatgtattagnggaggtcaacgtaacggcccgtcctaggtacgggttcagtactcgtcttcgtcgtcgtacctacgaagttcgacggaccaaccggtcccgtccctaccgtagaacctacgttccgtacggtacggtccctacgacggtacgtaaggacggtacgngtacgttagtaatttacgttagttcgacttcgtacgtattaacgtagtcgtaagtacgggtttaacttactaacgtttaggtacgttacgtttaacgggacgggttacgggtaacccggtaccggttacccgttaacccgttacggttaaccggtaacccggaacccgtaccccggaaacccgtacccccgtaaccccgttacg

SEQ ID NO: 184859 - DNA, 779 bp, Homo sapiens
  misc_feature: GYAE6OF01CGEQQ.43.34.D01.1.454.CMB.1.raw
  modified_base (201)..(201): a, c, t, g, unknown or other
  misc_feature (201)..(201): n is a, c, g, or t
  modified_base (282)..(282): a, c, t, g, unknown or other
  misc_feature (282)..(282): n is a, c, g, or t
tcagtgtgagtagtcacgaccggtgctcgatttagatcgtctgtgttggggtttggggggggtcacaagaggcagcgctctcgggacgtctccaccatggcctgggctctgctgctcctcactctcctcgctcaggacacgaggggtcctgggcccagtcctgccctgactcacgcctgcctcgtgtctggtctctggacngtcatcaccatctcagcactggaaccagcgagttgtatgggttacggattatacgtcttcgtactccgtagtaccaagtcnccacgacgaccaacgacccctaatcatagtatttagaggacggtacaacgtacggcccgtcgtacggtacgggttttctacgtacttccgtactttccgtacgttcgaccttaaccgtacgttaccggcgtaaacccgaaccggtacccggtaccccgtacctaccgtaacctaacgttcccgttacgggtaccggtacccgttaaccccggtagggtacccggtaagggaaccgggtaacgggtaccgggttaaccgttacggttaaagttttaccgtttaaacggtttcgggtaaccctttggtaaccctttaagaccgttaacggttcgggaacgtttaacggtttaacgtttaacctaacggttttacgttacggttacggttttaaaccggaagggtttaccgggtaaccggtacccggttaccgtacccggtttaacgtacccgtaccgtacccggaaccttaacccgggtacccctaacccgttacccgg

SEQ ID NO: 184860 - DNA, 699 bp, Homo sapiens
  misc_feature: GYAE6OF01CMXXD.43.34.D01.1.454.CMB.1.raw
  modified_base (197)..(197): a, c, t, g, unknown or other
  misc_feature (197)..(197): n is a, c, g, or t
  modified_base (505)..(505): a, c, t, g, unknown or other
  misc_feature (505)..(505): n is a, c, g, or t
  modified_base (608)..(608): a, c, t, g, unknown or other
  misc_feature (608)..(608): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacgagggtcctgggcccagtctcgccctgactcagcctgcctcgtgtctcgggtctacctggacngtcgatccacagtcctcctgcacgtacggaaccagcgaagtgagttgggttggtagttagtacgtcgttcgtaccttccgtaggtaaccctaaggtcgaaccaccgacggaccaaaaccgcccctaaaagtccagttacgtactttaggacggacggtacaacgtacgcccggtaccgttcggtaacgggtttctagtacgttcggtccttcggtcgtacgtcgtaccgtaacgtcgtacggacctaaccgtacccggtcctaccgtactaacggtacttcccggtcggttaaggccccgttaaccgnggtctacgggaacggtaggacggtaccttagtagtttaaccttgttagccttaggtacctcgtaacgttgtacggacgtttagggttactactacggttttanaccggttggttaaacgttggtaccggggtacctacgggttcctaaccgggttctcgggaaccgtaacccgtccgaaaccggtcccacccgg

SEQ ID NO: 184861 - DNA, 767 bp, Homo sapiens
  misc_feature: GYAE6OF01EW5R1.43.34.D01.1.454.CMB.1.raw
  modified_base (214)..(214): a, c, t, g, unknown or other
  misc_feature (214)..(214): n is a, c, g, or t
  modified_base (235)..(235): a, c, t, g, unknown or other
  misc_feature (235)..(235): n is a, c, g, or t
  modified_base (378)..(378): a, c, t, g, unknown or other
  misc_feature (378)..(378): n is a, c, g, or t
tcagtgtgagtagtcacgaccggtgctcgatttagatcgtctgtgttggggtttggggggggtcacaagaggcagcgctctcgggacgtctccaccatggcctgggctctgctgctcctcactctcctcgctcaggacacgagggtcctgggcccagtctgccctgactcagcctgcctcgtgtctgggtctccgtggactagtcgatccaccntctcctgcacgtacggaaccngctagtgtagtggtagggtattatacgtccttgtctccgtaggtaccaacgtgaccacccgaggacctaaaccgacccctaaatcgatttcgaatttaggagtacgggtacaacgtacggcccggtcctacgggtgggttccngtacgtcgtcttcgtcgtacgctacgtagtcgtacgaacctaaccgccgtaccctacgttagaaccttacgttccgtcggtccgggtaccgtaccgtaagggtcgtaacgggtaaccggtcgggaaacgttcggttaagtttaactttagtaacgtttcggacccttggtaaacccttattaaagggttcctaacgggaaccgttttaaggtaaccttttaacggtagttaaccgttttgggttaaacccgttaacgggggtttaaagggtaccccggggttaagggttaaacccccgttacgggttaaaccccgttaacccgggtttaccggaaaccgtacccgggaaaccccgtttaaccccgaaacccccgtacgtttaaaccccg

SEQ ID NO: 184862 - DNA, 821 bp, Homo sapiens
  misc_feature: GYAE6OF01BNVXF.43.34.D01.1.454.CMB.1.raw
  modified_base (228)..(228): a, c, t, g, unknown or other
  misc_feature (228)..(228): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacgagggtcctgggcccagtctgccctgactcagcctgcctcgtgtctgggtctcctggacagtcgatcaccatctcctgcactggaaccngcagtgatggtggagttatagcttgtctcgtgtaccaagtcgcaccgagaccaaacgacccccaaatcatgtaatttataggtacggactaacgtaaacgccggtacccttcggtacggggtttactacgtacgttccgtccttcgtcgtcgggtacctaccgtaacgttccgtacgggaccaaaccggtcccggtacccctacccgtacgtaactaacgttcccgtacggtaccggggtccctacccgtacgggtacgtcgggtaaacgggtacggtacgggtacttaggttaacgtttaacgttaacgttcgtaccgttcgtaccgtacgttaacgttaacgttcggtaaaccggttagggtttaaacctttaaccgttaaaccggtttttacggttaccggttttaaccccggtttaacggggttaaaaccgggttacccggggggttaaaacccggtttaacccccgggtttacccggttaaacccccggtttaacccggggttaaccggttaaaccccgtaacccccgggtaaaccccccggttaaaccccgggtaaacccccccgtaaaccccccggtttaacccgg

SEQ ID NO: 184863 - DNA, 695 bp, Homo sapiens
  misc_feature: GYAE6OF01CMLGJ.43.34.D01.1.454.CMB.1.raw
tcagtgtgagtagtcacgaccggtgctcgatttagatcgtctgtgttgggctggggtcacaagaggcagcgctctcgggacgtctccaccatggcctgggctctgctgctcctcactctcctcgctcacggacacgacgggtcctcgggcccagtcctcgccctgactcacgcctcgcctcgtgtcgttcgggtctccgtaggacagtccgactcacctactcctccgtgacctacgtacggaaccagacgagtgtagttggttaggtattactacgtcttgtcctaccgtagtaaccacgtcgaccgaccgaggaacccaaaccgacccctaaatcgaagttagttaacgtttagacgggaaccggtactaacgtaaccggcccggtaccgttaggttacgggtttcacgtacttcgttacttcgttcgtcgtacctacgtacgtccgacgaacctaaccgtccgtccttaccgaagtaacctaccgttcgtacgggccggtaccttacggacggtcgaggtacggacgtacgtacgttagtttattacgttactcgtctacgtacgtacaacgttgacgttacgtaaggttacttacttaggttcttcggtaacgttacgggtacggtcggtacccgtacggtaccgtaccgttacggtacgtaccaccgaaccccgtcgtaaccctaacccg

SEQ ID NO: 184864 - DNA, 732 bp, Homo sapiens
  misc_feature: GYAE6OF01D1FXD.43.34.D01.1.454.CMB.1.raw
  modified_base (230)..(230): a, c, t, g, unknown or other
  misc_feature (230)..(230): n is a, c, g, or t
  modified_base (324)..(324): a, c, t, g, unknown or other
  misc_feature (324)..(324): n is a, c, g, or t
tcagtgtgagtagtcacgaccggtgctcgatttagatcgtctgtgttggggtttggggggggtcacaagaggcagcgctctcgggacgtctccaccatggcctgggctctgctgctcctcactctcctcgctcaggacacgagggtcctgggcccagtctgccctgactcagcctgcctcgtgtcgtgggtctcctggacagtcgatcaccatctcctgcactggaaccngcagtgagtggttagggattatacgtccttgtcctccgtaggtaccaagtcgaccaccgaggaccaaaccgcccccaaatcagtagtatttagnggacgggtacctaacgtaacggccgtcccgttacgggtagggttttcagacgttccggtctttcgtcggtcgtcctaccgtaagtccgagtaccaaccggtaccgtccctaccgtagaactaacgtcgtcggtcggtcctaccgaggtcgagggtaacggcgtacggttacgtagtttaacttaagtttcgtacgtcgtacgtaccttatacgtttaacggtcgttaacgtaacggttttaacgtttaaccgttacgttttaggtaccggtttaacggttaacggggttaaacggtttaccgggggtacccggtacgggttaaccccgttaccccgggttacggttaaaccgggtaccccgaaaccggaacccccggtaaacccggtcccccgtaaaccccgttccgg

SEQ ID NO: 184865 - DNA, 552 bp, Homo sapiens
  misc_feature: GYAE6OF01ESNOR.43.34.D01.1.454.CMB.1.raw
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaaagcccccaaaactcatgatttatgagggcactaagcggcctcagggtttctgatcgcttctctggctccaagtctgcaacacggcctccctgacaactctctgggctcaggctgaggacgaggctgattatattgctgctacatatgactagtagttacacttatgttcgttacgggtaagtttggggaacgtaaccgggttccaacccggttaccctaacggggttaccaacggaccccctaaagggcccccaaaacccccgtaacg

SEQ ID NO: 184866 - DNA, 912 bp, Homo sapiens
  misc_feature: GYAE6OF01DH3L6.43.34.D01.1.454.CMB.1.raw
tcagtgtgagtagtcacgaccggtgctcgatttagatcgtctgtgttggggtttggggggggtcacaagaggcagcgctcgtcgggacgtctccaccatggccgtgggctcgtgctgctcctcactcctcctcgctcgaggacacgacgggtccgcgggccagtcctcgcccgtagacctcacgtcctcgtccgtcggtgtcgtcgggttctccgtaggacgtacgtacgtactaccaacctacttccgtccgtacggaccgtaacgtacggaacctaggtacgtacgttggtaaggttgggttaggggttaatttacgtcgttaccgtttccggtccgttaccggtaacgggttaaccgaacggttccgaaccccaaacccggtacgaaaccccgtaaaaaccccgtacccctaaacgttacgtactttaacggttacgtttaggaccgggtaacggtccgtaaacgtaccgggtcccggtaccgttaacgggggttcgttataccgttcgttcgttcctttacggtcgtccgtaacccgttacgtcggtacgtacgaactacccggtacccgtccgtacccgtaagtaccgtacgttccggttacggtacggtacgtccggtacgggtacggtacgggtacggtaaccgggtggttaacgttacggttttaacgtttaacgtttcggttaacggttccgttaacgttaccgtacttaacggtcgtttacggaaccgggtttaacggttttaacttacggtacgttacggtttaacggttccgggtttaaaggtaacggggttccgggtaaccgttaacccggttcccgggttaacccggtttacgaaacccggggttccccgaaacccgggttaccccgtaaccccgggtacccctaaccggttaccccg

SEQ ID NO: 184867 - DNA, 711 bp, Homo sapiens
  misc_feature: GYAE6OF01BNIE3.43.34.D01.1.454.CMB.1.raw
  modified_base (226)..(226): a, c, t, g, unknown or other
  misc_feature (226)..(226): n is a, c, g, or t
tcagtgtgagtagtcacgaccggtgctcgatttagatcgtctgtgttggggctggggtcacaagaggcagcgctctcgggacgtctccaccatggcctgggctctgctgctcctcactctcctcgctcaggacacgagggtcctgggcccagtctgccctgactcagcctgcctccgtgtctgggtctccgtggacagtcgactcacatctcctgcactggaaccngcagtgtagttggttaggtagttatacgtcctttgtcctcgtaggtacaagtcgaccaccgacggaccaaaccgaccccaactcgtatgtatttagaggacggtacaacgtaacggccggtccgtacggtacgggtttccgacgtccgtcttcgtcgtcggtccctacgtacgtcgtacggaccaaccgtcccggtccctaccgtaacgtacctaacgttcccgtacggtcgggtccctacggtacgggtcgtacgggaacgggaccggagggttaccttagtttaatttacgtttagttcgtcgtcgtaccttacgtagttacgtcggtaacggttaacggtttaacgttaccttacgttttacgtcggtttaccggtacgggttaacgggttcggggtacccggttaccgggttcccttaccgggtaccgttacgggtacccgtaaccggaaccccgtaaccggtacccctaacccgttacgg

SEQ ID NO: 184868 - DNA, 701 bp, Homo sapiens
  misc_feature: GYAE6OF01DNESK.43.34.D01.1.454.CMB.1.raw
  modified_base (346)..(346): a, c, t, g, unknown or other
  misc_feature (346)..(346): n is a, c, g, or t
tcagtgtgagtagtcacgaccggtgctcgatttagatcgtctgtgttggggttgggggggtcaacaagaggcagcgctctcggacgtctccaccatggcctggctctgctgcctcctcactctcctcgctcaggacacgagggtcctgggccagtctgacctgactcagtcctcgcctcggtgtccgtggtcctacgtggacagttcgactaccacctatccgtcctgaccgtacgtacggaaaccagtccgaggttatagtggttacgggaagtttactacggtccttcgtccttccgtacgtacctaagtccgacctaaccgacgaccaaacctccccaaactntagtagtatttacgacggacggactaaccgttacggaccggtcctcgggttacggtttcaggtctcgtaccgtttctacgtggtacctacgtacgtcgtcgacctacgtaccggtcctacgtcgaacgtaacttcgtccggtcgaccgttacggacggtacgtagggacggtacgaacggttccgttaagtagtttaacttcggtacttcctcggtactactagtacgtcgtacgtagttaaccgtcgtaacgtttacgtcggttacggttagaccgggttacgtaacccggtcggttacccaccggttacggtacgtaccctaaccggacccgtaaccggtcccctcggttacc

SEQ ID NO: 184869 - DNA, 623 bp, Homo sapiens
  misc_feature: GYAE6OF01COJQI.43.34.D01.1.454.CMB.1.raw
  modified_base (326)..(326): a, c, t, g, unknown or other
  misc_feature (326)..(326): n is a, c, g, or t
  modified_base (338)..(338): a, c, t, g, unknown or other
  misc_feature (338)..(338): n is a, c, g, or t
  modified_base (381)..(381): a, c, t, g, unknown or other
  misc_feature (381)..(381): n is a, c, g, or t
  modified_base (411)..(411): a, c, t, g, unknown or other
  misc_feature (411)..(411): n is a, c, g, or t
  modified_base (486)..(486): a, c, t, g, unknown or other
  misc_feature (486)..(486): n is a, c, g, or t
tcagtgtgagtagtcacgaccggtgctcgatttagatcgtctgtgttggggtttggggggggtcacaagaggcagcgctctcgggacgtctccaccatggcctggctctgctgctcctcactctcctcgctcaggacacagggtcctcgggcccagtctcgccctgactcagcctgcctccgtgtcgtgggtcctccgtggacagtcgactccacctattcctcctgaccacgtcggaaaccagctagtgatggttagggattatacgtccttgtcctccgtaggtaaccaagtcgaccacccgagaccaaaccgacccctaaacncatagtattagnggacggactaacgtaacggccgtacccgtcggtacgggtttcngactcgtcttcgtcgtcgctacagttccgngaccaacgcgtccctacctgacacgtctcgcggctacgagcgtaggacggacgcgtcgtagtatttattagtcgngtctctatatacgtgtacgtaaggttactacgttaacttagtcggtttactaacgggtaggttccggggaccgtacggtacccgtccgttaccgtaacgtaccaccgaaccccggtaaacctccccgacccgtaccg

SEQ ID NO: 184870 - DNA, 731 bp, Homo sapiens
  misc_feature: GYAE6OF01B3ZUL.43.34.D01.1.454.CMB.1.raw
  modified_base (361)..(361): a, c, t, g, unknown or other
  misc_feature (361)..(361): n is a, c, g, or t
  modified_base (404)..(404): a, c, t, g, unknown or other
  misc_feature (404)..(404): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacgagggtccgtcgggccctagtcctgccctgactcagcctgcctccgtgtcgttcgggtcctcctggacaggtcgactccacctactcctcctgccaacgtacggaaccaggctaggtggtagttagggttagggtagtttaagtacgttcctttcgttcctaccgttacggtactagtaccgccaaccgaacggaaccaaaccgaccccaactcattgtaagttagnggacggactaccggtacggcccgtccgttacggtcgggttacnggtactctcgtctacgtcgactacgtagtcgtacggaccaaccgtccggtccctacgtacgtaacctacctccggttacctacgggtcgtaccgtacgggtcgtacggggacgtaagggtacgtacgttagttaacgtttatttacggttcgacgtcgttcttacgtagttacgtcgttaacgttacgggtttaacttaccgttagttacgttacggtttacggttaaccgggttaggttaccgggacgttacccggttaccgggtaaccgttaccgggtaccgtacccggtaaccccggacccggtaacccgaccccggttaaccc

SEQ ID NO: 184871 - DNA, 499 bp, Homo sapiens
  misc_feature: GYAE6OF02GFCV0.43.34.D01.1.454.CMB.1.raw
tcagtgtgagtagtcacgaccggtgctcgatttagatcgtctgtgttgggtttgggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaatcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgttcttggaattgggacacgggtcaccgtctaggtcagcccaaggccaaccctc

SEQ ID NO: 184872 - DNA, 213 bp, Homo sapiens
  misc_feature: GYAE6OF02IZBWG.43.34.D01.1.454.CMB.1.raw
  modified_base (186)..(213): a, c, t, g, unknown or other
  misc_feature (186)..(213): n is a, c, g, or t
tcagtgtgagtagtcacgaccggtgctcgatttagatcgtctgtgttgggtttgggttgggtttgggggaagaggaagactgacggtcctgctccaggagcacctccgagagcacagcggccctgggctgcctggtcaaggactacttccactactcacactgagcgggctggcaaggcgcatagnnnnnnnnnnnnnnnnnnnnnnnnnnnn

SEQ ID NO: 184873 - DNA, 533 bp, Homo sapiens
  misc_feature: GYAE6OF02G7N2K.43.34.D01.1.454.CMB.1.raw
  modified_base (305)..(305): a, c, t, g, unknown or other
  misc_feature (305)..(305): n is a, c, g, or t
  modified_base (333)..(333): a, c, t, g, unknown or other
  misc_feature (333)..(333): n is a, c, g, or t
  modified_base (364)..(364): a, c, t, g, unknown or other
  misc_feature (364)..(364): n is a, c, g, or t
  modified_base (428)..(428): a, c, t, g, unknown or other
  misc_feature (428)..(428): n is a, c, g, or t
tcagtgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaacgcccccaaactcatgatttangaggcactaagcgcctcgaggggtttcngatcgcttctctggctccaagtctggcaacncggcctcctgacatctcgtgggctccgaggctggaggacgaggctgtattattattgctgctanatatgctaggttagttacactttatgttcgttacggaagttcggggaaccgtacggtacctacccgttcgtacggtccaacggccccaacggccccaacccctcg

SEQ ID NO: 184874 - DNA, 301 bp, Homo sapiens
  misc_feature: GYAE6OF02F9NVD.43.34.D01.1.454.CMB.1.raw
  modified_base (297)..(301): a, c, t, g, unknown or other
  misc_feature (297)..(301): n is a, c, g, or t
tcagtgtgagtagtcacgaccggtgctcgatttagatcgtctgtgttgggtttgggtcaggggtttctgatcgcttctctggctccaagtctggcaacacggcctccatgacaatctctgggctccaggctgaggacgaggctgattattattgctgctcatatgcaggtagttacacttatgtcttcggaattgggacgacggtcaccgtcctaggtcagcccaaggccaaccccactgtcactctgttcccgcctcctcactactcacactgagcgggctggcaaggcgcatagnnnnn

SEQ ID NO: 184875 - DNA, 507 bp, Homo sapiens
  misc_feature: GYAE6OF02FWCXD.43.34.D01.1.454.CMB.1.raw
  modified_base (302)..(302): a, c, t, g, unknown or other
  misc_feature (302)..(302): n is a, c, g, or t
tcagtgtgagtagtcacgaccggtgctcgatttagatcgtctgtgttgggtttggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaatcatgatttangagggcactaagcggcctcaggggtttctgatcgcttctctggctccaagtctggcaacacggcctcctgacaatctctgggctccaggctgacggacgaggctgattattattgctgctcatatgctaggttattacactttatgttcttcggaagttgggactacggtcaccgttctaggtcacgcccaaggcccaaccctcg

SEQ ID NO: 184876 - DNA, 368 bp, Homo sapiens
  misc_feature: GYAE6OF02IIZ3O.43.34.D01.1.454.CMB.1.raw
  modified_base (302)..(302): a, c, t, g, unknown or other
  misc_feature (302)..(302): n is a, c, g, or t
  modified_base (304)..(309): a, c, t, g, unknown or other
  misc_feature (304)..(309): n is a, c, g, or t
  modified_base (312)..(327): a, c, t, g, unknown or other
  misc_feature (312)..(327): n is a, c, g, or t
  modified_base (329)..(368): a, c, t, g, unknown or other
  misc_feature (329)..(368): n is a, c, g, or t
tcagtgtgagtagtcacgaccggtgctcgatttagatcgtctgtgttggggtttgggtcaggggtttctgatcgctttctctggctccaagtctggcaacacggcctccctgacaactctctgggctccaggctgaggacgaggctgattattattgctgctcatatgcaggtagttacacttatgtcttcggaattgggacgacggtcaccgtcctaggtcagcccaaggccaaccccactgtcactctgtcccgcctctcactactcacactgagcgggctggcaaggcgctataggctntnnnnnngcnnnnnnnnnnnnnnnncnnnnnnnnnnnnnnnnnnnnnnnnnnnnnnnnnnnnnnnn

SEQ ID NO: 184877 - DNA, 202 bp, Homo sapiens
  misc_feature: GYAE6OF02HE68O.43.34.D01.1.454.CMB.1.raw
  modified_base (202)..(202): a, c, t, g, unknown or other
  misc_feature (202)..(202): n is a, c, g, or t
tcagtgtgagtagtcacgaccggtgctcgatttagatcgtctgtgttgggtttgggcacgaccggtgctcgatttagatcgtctgtgttgggtttggtggtctccactcccaccgtcctaggtcagcccaaggccaacccactgtcactctgttcccaccctcctcactactcacactgagcgggctggcaaggcgcatagn

SEQ ID NO: 184878 - DNA, 302 bp, Homo sapiens
  misc_feature: GYAE6OF02H1KH3.43.34.D01.1.454.CMB.1.raw
  modified_base (291)..(291): a, c, t, g, unknown or other
  misc_feature (291)..(291): n is a, c, g, or t
  modified_base (297)..(302): a, c, t, g, unknown or other
  misc_feature (297)..(302): n is a, c, g, or t
tcagtgtgagtagtcacgaccggtgctcgatttagatcgtctgtgttgggtttgggtcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccactgtcactctgttccccgcctcctcactactcacactgagcggctggcaaggcncatagnnnnnn

SEQ ID NO: 184879 - DNA, 495 bp, Homo sapiens
  misc_feature: GYAE6OF02GS107.43.34.D01.1.454.CMB.1.raw
  modified_base (332)..(332): a, c, t, g, unknown or other
  misc_feature (332)..(332): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (401)..(401): a, c, t, g, unknown or other
  misc_feature (401)..(401): n is a, c, g, or t
  modified_base (409)..(409): a, c, t, g, unknown or other
  misc_feature (409)..(409): n is a, c, g, or t
  modified_base (420)..(420): a, c, t, g, unknown or other
  misc_feature (420)..(420): n is a, c, g, or t
  modified_base (423)..(423): a, c, t, g, unknown or other
  misc_feature (423)..(423): n is a, c, g, or t
  modified_base (425)..(426): a, c, t, g, unknown or other
  misc_feature (425)..(426): n is a, c, g, or t
  modified_base (433)..(433): a, c, t, g, unknown or other
  misc_feature (433)..(433): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggccaaacgcccccaaatcatgatttatgagggcactaagccggccctcgagggtttcngatcgcttctctggctccgaagtctgcaacncgcctccgnacatctctgggctcgagctaggaggacgngctgattnttatgctgctnatngnngtattanacttatgtctaggtagttggacgtacgtcaccgtcgtaggtcacgcccacggccctaacccg

SEQ ID NO: 184880 - DNA, 654 bp, Homo sapiens
  misc_feature: GYAE6OF02I689M.43.34.D01.1.454.CMB.1.raw
  modified_base (227)..(227): a, c, t, g, unknown or other
  misc_feature (227)..(227): n is a, c, g, or t
  modified_base (431)..(431): a, c, t, g, unknown or other
  misc_feature (431)..(431): n is a, c, g, or t
tcagtgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccngcagtgatgttgggattatagccttgtctcctggtaccaagtgcacccaggacaaacgcccccaaatcatgattatgaggcacaagcgccctgacgggttctgactcgtcttctctggcctacgaagttctggacaaccgacggtccctaccctagaacctaatctacgtcgggcctaccgagggtctacggacggtaaccggnggtccgttaggtaactttacgtttagtttcggccgttacgtcttacctaagttacgtacgtcgtaagggtttacgtttaaccaaaccgttttgttacggtttaccgttacgggttaacggttacggggtaacccgtacggggtttaccaccccggttttacgaaccggggtttccaaaccggtacccccgggtaaacggtacccccgtaaacccccgttacgg

SEQ ID NO: 184881 - DNA, 326 bp, Homo sapiens
  misc_feature: GYAE6OF02JWALS.43.34.D01.1.454.CMB.1.raw
  modified_base (310)..(310): a, c, t, g, unknown or other
  misc_feature (310)..(310): n is a, c, g, or t
  modified_base (312)..(326): a, c, t, g, unknown or other
  misc_feature (312)..(326): n is a, c, g, or t
tcagtgtgagtagtcacgaccggtgctcgatttagatcgtctgtgttgggtttgggtcgagggtttctgatcgcttctctggctccaagtctggcaacacggcctccatgacaatctctgggctccaggctgaggacgaggctgattattattgctgctcatatgcaggtagttacacttatgtcttcggaattgggacgacggtcaccgtcctaggtcacgcccaaggcccaaaccccactgtccactctgttccccaccctcctcactacctcaccacgtgacgcgggctcggacaaggccacatagncnnnnnnnnnnnnnnn

SEQ ID NO: 184882 - DNA, 549 bp, Homo sapiens
  misc_feature: GYAE6OF02HOHZ4.43.34.D01.1.454.CMB.1.raw
  modified_base (335)..(335): a, c, t, g, unknown or other
  misc_feature (335)..(335): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttcngatcgcttctctggctcaagtctggcaacgacggcctccctgacaatctcgtgggctccaggctgaggacgaggctgatttatattgctgctcatatgactaggttaattacacgtttatgttacgttacggtaagtttcggggaccgtaacgggttccaacccggttccgtaacgggtcaacggaccccgaaacggtaccccaaccccgtacg

SEQ ID NO: 184883 - DNA, 631 bp, Homo sapiens
  misc_feature: GYAE6OF02I5OFN.43.34.D01.1.454.CMB.1.raw
  modified_base (351)..(351): a, c, t, g, unknown or other
  misc_feature (351)..(351): n is a, c, g, or t
tcagtgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctcgtgtctgggtctcctggacagtcgatcaccatctcctgcactggaaccagctagtgatgttgggagttatagccttgtctccgtggtaccaagtgacacccgaggacaaacgacccccaaaattccatgaactttatcgagggcaactaacgcggtccctacgtaggggtttcngatcgtcttctctggctcgaagtctaggacaaccgaccggtcctccgtagactaactctacgtcgggctaccgtaggcgttaggacgggtacgaggtcttggtaactttacttaacgtcggtctcggtaccttacgtatacgtacggtctaagggtttaacttacgtaacgtttatacggttacgttagggtaacgtttcgggaacgtacggttaccgtacccgttaccgttacgggtactaccggtacccggtaacggtacccctaaccccgttaacgg

SEQ ID NO: 184884 - DNA, 541 bp, Homo sapiens
  misc_feature: GYAE6OF02IOEO1.43.34.D01.1.454.CMB.1.raw
  modified_base (338)..(338): a, c, t, g, unknown or other
  misc_feature (338)..(338): n is a, c, g, or t
  modified_base (441)..(441): a, c, t, g, unknown or other
  misc_feature (441)..(441): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgccacccaggaccaaacgcccccaaactcatgtatttatggagggcaactaagccggccctgtagggtttcngatcgtcttctctggctcgaagtctggaccaacgacggcctcctagacaatctcgtcgggctccgaggtctggacggacgaggctagtattattatgctgctnatatgacgtaggttagttactattatgttcgttacggtaagttcgggacgtacgtccgtaccgttcgtacggtccacggtacccgacggcccctaacccg

SEQ ID NO: 184885 - DNA, 208 bp, Homo sapiens
  misc_feature: GYAE6OF02H8RIU.43.34.D01.1.454.CMB.1.raw
  modified_base (205)..(208): a, c, t, g, unknown or other
  misc_feature (205)..(208): n is a, c, g, or t
tcagtgtgagtagtcacgaccggtgctcgatttagatcgtctgtgttgggtttgggcacgaccggtgctcgatttagatcgtctgtgttgggtttggtggtctccactccccaccgtcctaggtcagccccaaggccaacccactgtcactctgttccccaccctcctcactactcacactgagcgggctggcaaggcgcatagnnnn

SEQ ID NO: 184886 - DNA, 595 bp, Homo sapiens
  misc_feature: GYAE6OF02F87DP.43.34.D01.1.454.CMB.1.raw
  modified_base (307)..(307): a, c, t, g, unknown or other
  misc_feature (307)..(307): n is a, c, g, or t
  modified_base (334)..(334): a, c, t, g, unknown or other
  misc_feature (334)..(334): n is a, c, g, or t
  modified_base (344)..(344): a, c, t, g, unknown or other
  misc_feature (344)..(344): n is a, c, g, or t
tcagtgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatcctcctgcactggaaccagcagtgattggttgggagttatagtccttgtctcctggtaccaagtgcaccaggcaaacgcccccaaatcatgatttangaggcactaagcgcctcgagggtttcngatcgcttcnctggctcaagtctaggtaacacggcctccctagactatctcgtggcctcgagctgacggacgaggcttagatttaattagttcggccttgcctacgtaattactggaccgtaaggtttacgttaacctactttagttcggtttcctttagggtaaacgtttcgggggaaccgtaccgggttaccgtaccccgttaccgttacgggtctaacccggcccccgtaaaggcccccctaaaccccgtgttaccgg

SEQ ID NO: 184887 - DNA, 304 bp, Homo sapiens
  misc_feature: GYAE6OF02HJNEX.43.34.D01.1.454.CMB.1.raw
  modified_base (159)..(159): a, c, t, g, unknown or other
  misc_feature (159)..(159): n is a, c, g, or t
  modified_base (289)..(289): a, c, t, g, unknown or other
  misc_feature (289)..(289): n is a, c, g, or t
  modified_base (295)..(304): a, c, t, g, unknown or other
  misc_feature (295)..(304): n is a, c, g, or t
tcagtgtgagtagtcacgaccggtgctcgatttagatcgtctgtgttgggtttgggtcaggggtttctgatcgcttctctggctccaagtctggcaacacggcctccctgacaatctctgggctccaggctgaggacgaggctgattattatgctgctnatatgcaggtagttacacttatgtcttcggaattgggacgacggtcaccgtcctaggtcacgccaaggccaaacccatgtcactctcgttcccacctctcactactcacactgagcgggctggcaaggcncatagnnnnnnnnnn

SEQ ID NO: 184888 - DNA, 596 bp, Homo sapiens
  misc_feature: GYAE6OF02HUJ8F.43.34.D01.1.454.CMB.1.raw
  modified_base (345)..(345): a, c, t, g, unknown or other
  misc_feature (345)..(345): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatggttgggagttatagccttgtctcctggtaccaagtgcacccaggaccaaaacgccccccaaaatcatgatttatgagggcactaagccggtccctcgtaggggtttcnggatcgtcttctctggctccaagtctggaccaacgccggtcctcccgtgacatcctcgtgggcctccgaggctggacgggacgaggtctagtatttattagtgctgtcctctatagtgacgtaggttacgttactaactttgtcgtttacgtttacggtaaggtttcggggaaccgtaccgggttacctaacccggttccgttaacgggtccaaccggtacccccgaacgggtaccccctaaccccgtacg

SEQ ID NO: 184889 - DNA, 188 bp, Homo sapiens
  misc_feature: GYAE6OF02GVQ41.43.34.D01.1.454.CMB.1.raw
  modified_base (187)..(188): a, c, t, g, unknown or other
  misc_feature (187)..(188): n is a, c, g, or t
tcagtgtgagtagtcacgaccggtgctcgatttagatcgtctgtgttgggtttgggttgggtttggggggaagaggaagactgacggtcctgctccaggagcacctccgagagcacagcggccctgggctgcctggtcaaggactacttccactactcacactgagcgggctggcaaggcgcatagnn

SEQ ID NO: 184890 - DNA, 564 bp, Homo sapiens
  misc_feature: GYAE6OF02G7BGA.43.34.D01.1.454.CMB.1.raw
  modified_base (341)..(341): a, c, t, g, unknown or other
  misc_feature (341)..(341): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatggttgggagttatagccttgtctcctggtaccaagtgcacccaggcaaacgcccccaaactcatgatttatgagggcaactaagccggccctcgtaggggtttcngatcgcttctcgtggctccaagtctggcaacactcgccctcctgacatctctgggcctaccgaggctggaggacggaggctagtattattatgctgctcatatgactaggttacttaactattagttcgttcgttacgggtaagtttcggggaaccgtacggttcccgtaccggttccggttacggtccaacggaccccgtaacgggaccccctaaacccccg

SEQ ID NO: 184891 - DNA, 568 bp, Homo sapiens
  misc_feature: GYAE6OF02JZFTP.43.34.D01.1.454.CMB.1.raw
  modified_base (229)..(229): a, c, t, g, unknown or other
  misc_feature (229)..(229): n is a, c, g, or t
  modified_base (308)..(308): a, c, t, g, unknown or other
  misc_feature (308)..(308): n is a, c, g, or t
  modified_base (337)..(337): a, c, t, g, unknown or other
  misc_feature (337)..(337): n is a, c, g, or t
tcagtgtgagtagtcacgaccggtgctcgatttagatcgtctgtgttggggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatccaccatctcctgcactggaaccngcagtgatgttggagttatagccttgtctcctggtaccaagtgcacccaggccaaacgcccccaaatccatgaatttangagggcactaagcggcctcgagggtttcnggatcgcttctctcggctcaagtctggcaacacggcctacctgaccatcctgtcgggctccgaggctacggacggacgaggctagatttatacgttgctgctacattagcgactaggttattacaacttatggttaccttacggtaaggttcgggaaccgttacggttacctaccggttaccttaggggtacctacggaccccgtaaccggtacccctaaccccggttacg

SEQ ID NO: 184892 - DNA, 660 bp, Homo sapiens
  misc_feature: GYAE6OF02I80O5.43.34.D01.1.454.CMB.1.raw
  modified_base (306)..(306): a, c, t, g, unknown or other
  misc_feature (306)..(306): n is a, c, g, or t
tcagtgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctccgtggacagtcgatcaccatctcctgcactggaaccagcagtgatgttgggagttatagccttgtctccgtgtaccaagtcgcaccaggcaaacgcccccaaatcatgattttanggaggcaacgtaacgcggccctcgtaggggtttctgacgtcgtctttctcgtgtctactaaggtctacggcaaccaccggccctacccgtagaacctaacgtcgtccgtacggtacctcccgagggtaccttaggaacgggaccggtaggtccgttagttaacgtttacgttaacttcgggccttacgggaccttacgtagttacgttcggtaaccgttacgggtttaacttaacgtaccgttttaacgtcggtttaccgtttaacgggtaacgtttcggggaacttaccgggtaccttacccggttacctagggtccctaacgaccccggttaacggacccctaacccctcgg

SEQ ID NO: 184893 - DNA, 530 bp, Homo sapiens
  misc_feature: GYAE6OF02GTGHT.43.34.D01.1.454.CMB.1.raw
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatcctcctgcactggaaccagcagtgatggttgggagttatagccttgtctcctggtaccaagtgcaccaggcaaacgccccaaactcatgatttatgagggcactaagcggccctcgagggtttctgatcgcttctcgtggctccgaagtcgtggcaacgcggccctccctgacaactctcgtcggctccaggctggaggacgaggctagtattattattgctgctacatatgctaggttacgttactattatgttcgttcggtaagttgggacgtacggtctaccgtcgtaggtcacgacccgacgacccacccgtacg

SEQ ID NO: 184894 - DNA, 528 bp, Homo sapiens
  misc_feature: GYAE6OF02I8FAF.43.34.D01.1.454.CMB.1.raw
  modified_base (304)..(304): a, c, t, g, unknown or other
  misc_feature (304)..(304): n is a, c, g, or t
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
  modified_base (352)..(352): a, c, t, g, unknown or other
  misc_feature (352)..(352): n is a, c, g, or t
  modified_base (387)..(387): a, c, t, g, unknown or other
  misc_feature (387)..(387): n is a, c, g, or t
  modified_base (404)..(404): a, c, t, g, unknown or other
  misc_feature (404)..(404): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatggttggattatagccttgtctcctggtaccaagtgcaccaggacaaacgcccccaaatcatgtattangaggcataagcgcctgagggtttcngatcgcttcncgtgctcaagtcngacacgccgtcctccgtgactatctcgtggctcgngcgtaggaggacgaggntagtattagttatgcgtgctcatagtgacgtagttagttacatttagttgtacgttaggagtttcgggacgtaccggtctaccgttactacggtacaccgtacccgaacggccccaacccgtcg

SEQ ID NO: 184895 - DNA, 584 bp, Homo sapiens
  misc_feature: GYAE6OF02I0DGK.43.34.D01.1.454.CMB.1.raw
  modified_base (311)..(311): a, c, t, g, unknown or other
  misc_feature (311)..(311): n is a, c, g, or t
  modified_base (349)..(349): a, c, t, g, unknown or other
  misc_feature (349)..(349): n is a, c, g, or t
  modified_base (361)..(361): a, c, t, g, unknown or other
  misc_feature (361)..(361): n is a, c, g, or t
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
  modified_base (427)..(427): a, c, t, g, unknown or other
  misc_feature (427)..(427): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctccgtggacagtcgatcaccatctcctgcactggaaccagcagtgatggttgggagttatagccttgtctcctggtaccaagtcgcaccaggacaaacgaccccaaactcactgtatttanggagggcaacgtaacggccggtccctcgtagggtttcngactcgctttcnctggctcagtctgacacncgcctccngacactctcgtcggcctccgaggtcgtaggaacgggacgnggtctagtatttattgtcgtctcgctacgtatacgtgacgtaggttaacttactagtttagtcgttacgttacggtaaggtttcgggaaccgtaccggttccacccggttccggttacggtccaacggaccccgaacgggtacccccaacccgtacg

SEQ ID NO: 184896 - DNA, 656 bp, Homo sapiens
  misc_feature: GYAE6OF02FFDLG.43.34.D01.1.454.CMB.1.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (309)..(309): a, c, t, g, unknown or other
  misc_feature (309)..(309): n is a, c, g, or t
  modified_base (338)..(338): a, c, t, g, unknown or other
  misc_feature (338)..(338): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcacatctcctgcactggaaccngcagtgatggttggagttanacgtccttgtctccgttaggtaccaagtcgaccacccgagaccaaacgcccccaaatcatgatttanggaggcactacgccgccctgagggtttcngactcgtcttcgtcgtcgcctacgaagtcctagaaccaaccgccggtccctaccgtacgaactacttccgtacggtcgggtccctaccggtacggtctagggaacggacggtaggtcttaggtaactttagttagttcggtccttagaccgttaccgaagtttacgtcggtaacgttaaggttaacgtttaccgtaacgtttacgttccggttacgttacgggttaacggttaccggggaacccgttacccggtacccgttaccggttacccgtacgggtacccgaccggaaccccgtaccggaccccctaaccccgg

SEQ ID NO: 184897 - DNA, 598 bp, Homo sapiens
  misc_feature: GYAE6OF02JYVLZ.43.34.D01.1.454.CMB.1.raw
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (300)..(300): a, c, t, g, unknown or other
  misc_feature (300)..(300): n is a, c, g, or t
  modified_base (331)..(331): a, c, t, g, unknown or other
  misc_feature (331)..(331): n is a, c, g, or t
tcagtgtgagtagtcacgaccggtgctcgatttagatcgtctgtgttgggtttggggggtcgacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcatggaaccngcagtgatgttggagttntagcttgtctcctggtaccagtgcaccagacaaacgccccaaactcatgactttanagaggacacgtaacgcgcctacgagggttcncgatccgtcttctactcggactctaagtctggacctaacgccggtcctcccgtagacctaatcctacgtcggccttaccgacggcgttacgacggtacggaacggtctcggtaatttacgttaattgtccgttgtccttacatttagtcgtacgtaaggttaacttacgtaactttagtcgttacgttaccggttaagtcggggtaaccgtacggtccgtaccgtaccgttaggtacctacggacccctaaggcccctaacccgtac

SEQ ID NO: 184898 - DNA, 506 bp, Homo sapiens
  misc_feature: GYAE6OF02F00PS.43.34.D01.1.454.CMB.1.raw
  modified_base (227)..(227): a, c, t, g, unknown or other
  misc_feature (227)..(227): n is a, c, g, or t
  modified_base (264)..(264): a, c, t, g, unknown or other
  misc_feature (264)..(264): n is a, c, g, or t
  modified_base (292)..(292): a, c, t, g, unknown or other
  misc_feature (292)..(292): n is a, c, g, or t
  modified_base (320)..(320): a, c, t, g, unknown or other
  misc_feature (320)..(320): n is a, c, g, or t
  modified_base (322)..(322): a, c, t, g, unknown or other
  misc_feature (322)..(322): n is a, c, g, or t
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
  modified_base (431)..(431): a, c, t, g, unknown or other
  misc_feature (431)..(431): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggttcctgggcccagtctgccctgactcagcctgcctcgtgtctgggtctcctggacagtcgatcacgatctctgcactggaaccngcagtgatgtggattatgccttgtctctagtacagtncaccagcaacgccccaatcatgattagngaggcacgtagccgtcctgtagggttcngntcgtcttctcgtgctcagtctgctaacgcgtcctccgtanactactctcgnggctcgagtcgtagacgacgtagctagtacttagttactgctcgctagatacgtacgngtagtatacgtattattcgttcgtaggtagtcggacgtacgtccacgtcgtagccacgccgtaacgcccacctcg

SEQ ID NO: 184899 - DNA, 371 bp, Homo sapiens
  misc_feature: GYAE6OF02HBZW2.43.34.D01.1.454.CMB.1.raw
  modified_base (269)..(269): a, c, t, g, unknown or other
  misc_feature (269)..(269): n is a, c, g, or t
  modified_base (311)..(311): a, c, t, g, unknown or other
  misc_feature (311)..(311): n is a, c, g, or t
  modified_base (313)..(313): a, c, t, g, unknown or other
  misc_feature (313)..(313): n is a, c, g, or t
  modified_base (315)..(315): a, c, t, g, unknown or other
  misc_feature (315)..(315): n is a, c, g, or t
  modified_base (318)..(371): a, c, t, g, unknown or other
  misc_feature (318)..(371): n is a, c, g, or t
tcagtgtgagtagtcacgaccggtgctcgatttagatcgtctgtgttggggtttgggtcaggggtttctgatcgcttctctggctccaagtctggcaacacggcctccctgacaatctctgggctccgaggctgaggacgaggctgattattattgctgctcatatgcaggtagttacacttatgtcttcggaattgggacgacggtcaccgtcctaggtcagcccaaggccaaaccccactgtaccacttctcgttccccaccctccncactacctcacactgacgcgggctggacaaggcgacagtagncngngcnnnnnnnnnnnnnnnnnnnnnnnnnnnnnnnnnnnnnnnnnnnnnnnnnnnnnn

SEQ ID NO: 184900 - DNA, 708 bp, Homo sapiens
  misc_feature: GYAE6OF02GPPFA.43.34.D01.1.454.CMB.1.raw
  modified_base (193)..(193): a, c, t, g, unknown or other
  misc_feature (193)..(193): n is a, c, g, or t
  modified_base (212)..(212): a, c, t, g, unknown or other
  misc_feature (212)..(212): n is a, c, g, or t
  modified_base (303)..(303): a, c, t, g, unknown or other
  misc_feature (303)..(303): n is a, c, g, or t
  modified_base (335)..(335): a, c, t, g, unknown or other
  misc_feature (335)..(335): n is a, c, g, or t
  modified_base (442)..(442): a, c, t, g, unknown or other
  misc_feature (442)..(442): n is a, c, g, or t
  modified_base (471)..(471): a, c, t, g, unknown or other
  misc_feature (471)..(471): n is a, c, g, or t
  modified_base (541)..(541): a, c, t, g, unknown or other
  misc_feature (541)..(541): n is a, c, g, or t
tcagtgtgagtagtcacgaccggtgctcgatttagatcgtctgtgttgggtttgggggggttcgacaagaggcagcgctctcgggacgtctccaccatggcctgggctctgctgctcctcactctcctcgctcaggacacacgggtcctgggcccagtctcgccctgaactcacgcctcggcctccgtgtcgngggtccttccgtcggaacnggttcgatcacccatccgtctgaccactggaaccagcagtgtatgtttcggggaagttatagccttgtctcgtgtacctagtacgcaccgnggacaaccgacccaaacgtcaatctaatttcngagggacctacaacgtccggcctaccgtagggttcgtgatccgcttttcgtcgtcgtacgtacccgtaagtccgttaggacctaaaccgccggtacctccccggtanaccgtaactcgtaccgtcggaccttccgngcgttacggcgtaacggacggctacggtacttacgttaagtttcgtcgttacgctcgtacttacggttanacccggttaggtaactttaacgtacctttttagaccggtttcttaacgggttaaccggttggggtaaccgttaccggggttaacccgtaaccgggtttacccgttaccgggttaccaacccggggtaaccccgtaaaccgggtaccccggttaaccccctaacccgg

SEQ ID NO: 184901 - DNA, 564 bp, Homo sapiens
  misc_feature: GYAE6OF02F71OE.43.34.D01.1.454.CMB.1.raw
  modified_base (303)..(303): a, c, t, g, unknown or other
  misc_feature (303)..(303): n is a, c, g, or t
  modified_base (331)..(331): a, c, t, g, unknown or other
  misc_feature (331)..(331): n is a, c, g, or t
  modified_base (371)..(371): a, c, t, g, unknown or other
  misc_feature (371)..(371): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggattatagccttgtctcctggtaccaagtgcaccaggcaaacgcccccaaatcatgatttangaggcactaagcggccctgagggtttcngatcgcttctctggctccaagtctggcaacgcggcctccngacaatctctgggcctcgaggctaggacggacgaggctagtatttatagttgctagctacatatcggtactagggttactttaacctactttagttcgttacgttacgggtaacgtttcggggaccgtaccgggttcctacccggttacctacgggttccaaccgtacccgtaacggacccctaacccctacg

SEQ ID NO: 184902 - DNA, 613 bp, Homo sapiens
  misc_feature: GYAE6OF02GC4XI.43.34.D01.1.454.CMB.1.raw
  modified_base (232)..(232): a, c, t, g, unknown or other
  misc_feature (232)..(232): n is a, c, g, or t
  modified_base (319)..(319): a, c, t, g, unknown or other
  misc_feature (319)..(319): n is a, c, g, or t
  modified_base (358)..(358): a, c, t, g, unknown or other
  misc_feature (358)..(358): n is a, c, g, or t
tcagtgtgagtagtcacgaccggtgctcgatttagatcgtctgtgttggggtttgggggggggtcacaagaggcagcgctctcgggacgtctccaccatggcctgggctctgctgctcctcactctcctcgctcaggacacgagggtcctgggcccagtctgccctgactcagcctgcctccgtgtctgggtctcctggacagtcgatccacatctcctgcacgtggaaccngcagtgagttggtgggagttatagccttgtctccgtggtaaccagtgaccaccaggaccaaacgaccccaaactcatagtatttagnggacgggcaacgtaacggccgtacctcgtacgggtttcngtactcgtcttctcgtcgcttaccgagtctcggaccaacgaccggtccctcctagactactcgtcgcggctaccgaggtctaggacggcgaggcttagtatttaatacgttcgctcgtctatacgtagttcggacgtttaagttaacgttacgtactttagtgtttaccgttaagggtacggttagggaaccgttaccggtacgttacccggtcgtacgggtaccacggacccctaaccggaccccacccgtacg

SEQ ID NO: 184903 - DNA, 658 bp, Homo sapiens
  misc_feature: GYAE6OF02GDSDR.43.34.D01.1.454.CMB.1.raw
  modified_base (230)..(230): a, c, t, g, unknown or other
  misc_feature (230)..(230): n is a, c, g, or t
  modified_base (318)..(318): a, c, t, g, unknown or other
  misc_feature (318)..(318): n is a, c, g, or t
tcagtgtgagtagtcacgaccggtgctcgatttagatcgtctgtgttggggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatcctcctgcactggaaccngcagtgatggttgggagttatacgccttgtctcctggtacctaagtcgcacccgaggaccaaacgcccccaaactcatagtatttagnggacgggactacgtaacggccggtccctacggtacgggtttctgtattcgctttcgtcgtggcctctaacggtcgtcggaccaacgtaccggtcccttccgtacgaactaacgttctacggttcgggccttcgaggtcgtagggacggacggaggtctagtaacttattacgttagtcctgtctacgtagtacgtcggtacgttaggttacgttaacgtactttacgttcgttacggtttacgggaacggttttcggggaaccgtccgggttaccgtacccggtttaccgttaacggtaccgtaccggacccgtaaccgggtacccctaaccccgtacgg

SEQ ID NO: 184904 - DNA, 613 bp, Homo sapiens
  misc_feature: GYAE6OF02I49KG.43.34.D01.1.454.CMB.1.raw
  modified_base (227)..(227): a, c, t, g, unknown or other
  misc_feature (227)..(227): n is a, c, g, or t
  modified_base (305)..(305): a, c, t, g, unknown or other
  misc_feature (305)..(305): n is a, c, g, or t
  modified_base (335)..(335): a, c, t, g, unknown or other
  misc_feature (335)..(335): n is a, c, g, or t
tcagtgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctctggacagtcgatcaccatctcctgcacgtggaaccngcagtgatgttgggattatagccttgtctcctggtaccaagtgccaccgaggcaaacgcccccaaatcatgatttagngacggcaacgtaagccgcctgagggtttcngatcgcttctctggctacgaagtcgtggcaacctcggccctcccgtagaaccaatcctcgtcgggcttccgaggctaggacggacgaggtctgtactttattagttcgcttgtctacgtattagtcgtaccgtaaggttaactttacctaacgtttagttcggttacgtttccgggtaaagtttcggggaccgttaacggggttaccctaacccggttaccgttacgggttacccgaaccggtacccccggtaaacggacccccctaacccctaccgg

SEQ ID NO: 184905 - DNA, 632 bp, Homo sapiens
  misc_feature: GYAE6OF02HVV8M.43.34.D01.1.454.CMB.1.raw
  modified_base (316)..(316): a, c, t, g, unknown or other
  misc_feature (316)..(316): n is a, c, g, or t
  modified_base (347)..(347): a, c, t, g, unknown or other
  misc_feature (347)..(347): n is a, c, g, or t
tcagtgtgagtagtcacgaccggtgctcgatttagatcgtctgtgttggggtttgggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatccaccatcctcctgcactggaaccagcagtgatggttgggattatagtccttgtcctccgtaggtaccaagtcgccaccgaggacaaacgcccccaaatcatgtattangaggcacgtaacgccggtcctgtagggttcngtatcgtcttcgtcgtggtctaccaagtcgtacggacaacgaccgtcctcccgtagaccaactcctcgtacggcctaccgaggcgtaggaacgggacgaagggtcttagtaacttttagttacgttcggtacttgaccttacgtagttagtccggtacgttaaggtttaactttaaactacgtttaagttcggtttactttacgggtaaggttcggggtaaccggtacggttcccacggtttaccgaggttaccgaccgtacccgaaccggtaccccaacccgtc

SEQ ID NO: 184906 - DNA, 634 bp, Homo sapiens
  misc_feature: GYAE6OF02GQTAJ.43.34.D01.1.454.CMB.1.raw
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgattggttgggagttatacgtccttgtctccgtggtaccaagtcgccaccgacggacaaaccgaccccaaactcatgtatttagtggacggactacgtaacggccggtaccgtcggtacgggtttctgtactcgtcttctcgtcggtacctaccgtaagtcgtacggaccaaccgaccggtccctcccgtagactacgtcgtcgtcggtcgtccgacggtacgtacggacggacggacggtacgtagttatttattagttcgtcgttcgtactactatagtgtacgtagttaacgttactacttacgttcgttacgttacggtacggttacgggtacggtacggtaccgtaccgtacgtacggtacgaccgaccgaccgttttttttacccgaccctaccg

SEQ ID NO: 184907 - DNA, 630 bp, Homo sapiens
  misc_feature: GYAE6OF02GI0N2.43.34.D01.1.454.CMB.1.raw
  modified_base (228)..(228): a, c, t, g, unknown or other
  misc_feature (228)..(228): n is a, c, g, or t
  modified_base (307)..(307): a, c, t, g, unknown or other
  misc_feature (307)..(307): n is a, c, g, or t
  modified_base (337)..(337): a, c, t, g, unknown or other
  misc_feature (337)..(337): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccngcagtgatggttgggattatagccttgtctcctggtaccaagtcgcaccaggcaaacgccccaaactcatgtatttagngacggcacgtagcggcctagacgggtttcngatcgcttctcgtggctacaagttcgtacgacaaccgcggtccctccgtgaacctaactccttcggtcggtacctccgaggtctagggacggaccggaggtcttaggtaatttacttagttacgtccgttagtcgtacctaagttacgtcggacgttaagggttactttaacgtaagtttacgtacggttacgttaacgggtaacggttaccgggggaacggttaccggtaccgttacccggttaccgtacgggtccgaaccggaccccgaacggtacccctaacccctaccg

SEQ ID NO: 184908 - DNA, 556 bp, Homo sapiens
  misc_feature: GYAE6OF02I39SJ.43.34.D01.1.454.CMB.1.raw
  modified_base (293)..(293): a, c, t, g, unknown or other
  misc_feature (293)..(293): n is a, c, g, or t
  modified_base (306)..(306): a, c, t, g, unknown or other
  misc_feature (306)..(306): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (445)..(445): a, c, t, g, unknown or other
  misc_feature (445)..(445): n is a, c, g, or t
tcagtgtgagtagtcacgaccggtgctcgatttagatcgtctgtgttggggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctctggacagtcaatcacatctcctgcactggaaccagcagtgatggttggagttatagccttgtctcgtgtaccaagtgccaccaggcaaacgcccccaaancaatgactttagngaggcaactaacggcggtaccctgtagggttcngatcgcttnctgctacaagtctggacacgcgcctactgactaactctcgtcggtactccgaggctaggacggacgagcttgtacttattagttgccgtagccttanatagtcgacgtagttactactagtattggtacgtttacggaaggttcgggaaccgtcgggtacctaccggtccgttaggtccgagaccccgaacggtccctaacccgtacg

SEQ ID NO: 184909 - DNA, 532 bp, Homo sapiens
  misc_feature: GYAE6OF02GBG4E.43.34.D01.1.454.CMB.1.raw
  modified_base (306)..(306): a, c, t, g, unknown or other
  misc_feature (306)..(306): n is a, c, g, or t
  modified_base (334)..(334): a, c, t, g, unknown or other
  misc_feature (334)..(334): n is a, c, g, or t
  modified_base (344)..(344): a, c, t, g, unknown or other
  misc_feature (344)..(344): n is a, c, g, or t
  modified_base (436)..(436): a, c, t, g, unknown or other
  misc_feature (436)..(436): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggattatagccttgtctcctggtaccaagtgcacccaggcaaacgcccccaaaactcatgatttangagggcactaagcgccctgagggtttcngatcgcttcnctggctcagtctgacaacgcgcctcctgactatctcgtgggcctccgaggtctggacggtacgaggtctgtaatttagttattgcttgtctnatatgactaggtattacacttagtgttcgttacggtaagtttgggaacgtacggtcctaccgttactaggtcaccggcccaaggaccccaccctcg

SEQ ID NO: 184910 - DNA, 743 bp, Homo sapiens
  misc_feature: GYAE6OF02HJRXH.43.34.D01.1.454.CMB.1.raw
  modified_base (347)..(347): a, c, t, g, unknown or other
  misc_feature (347)..(347): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgccctcgtgtcgtgggtcctccgtggacagtcgatccaccatcctcctgccacgtcggaaaccagcaggtgtagttgggttaggggtaagtttatacgtcctttggtccttccgttggtaaccaaggtcgaccacccgaggaccaaccgaccccccaaactcatagtatttagnggagggacaacgtaacggcccggtccctcggtacggggtttctaggtacttccggtcctttcgtaccgttcgggtcccttaccgtaaggttccgtacgggaccaaccggacccggtcccttcccgtacgaactaacttcctcggtcgggtccctaccgagggtccgtacgggaacgggacgggacggtcgttagttaacgtttttatttaacgtttcgtccttcggtaccttactaagttacgtcggtacgttaagggtttaacgttaccttaacgtttagttcgtttacgtttacgggttaagtttcggggaaccggttacggtacccgtacccggtttacccgttacgggtacccgaaccggaccccgtaaccggacccccgaacccctaccgg

SEQ ID NO: 184911 - DNA, 717 bp, Homo sapiens
  misc_feature: GYAE6OF02I5RY5.43.34.D01.1.454.CMB.1.raw
  modified_base (236)..(236): a, c, t, g, unknown or other
  misc_feature (236)..(236): n is a, c, g, or t
tcagtgtgagtagtcacgaccggtgctcgatttagatcgtctgtgttgggtttggggggggtcgacaagaggcagcgctctcgggacgtctccaccatggcctgggctctgctgctcctcactctcctcgctcaggacacagggtcctgggcccagtctgccctgactcagcctgcctcgtgtctgggtctccgtaggacagtcgatccaccatcctcctagccactggaaacccngacagtgattggttagggagttagtacgtcttcgtcgtactacggtactagtcgaccgacccaggaccaaaccgacccccaacgtcacgtagtactttagtggacggtactaaccgtaacggcccggtcccgttacggtacgggtttcctagacttccgtcctttacttcgtcggtacttaccgtaagtccgtacggcctaaaccgccggtaccctcccgtacgaaccgtaacttccgttaccggtacgggtccctacggacggtacgtcgggaacggtaccgggagtcgttagtacgtttaattcgttacgtcgtcgtaacttcgtaagtcttacggacgttacggttaacgttaccgttaagttacgtttccgttacgttacggttaagttccggggtaacggttcccggtaaccgttacccggtacgtttaccgggcgaacccggaccccgtaacggtacccccgtaccccttaacgg

SEQ ID NO: 184912 - DNA, 187 bp, Homo sapiens
  misc_feature: GYAE6OF02IFMCL.43.34.D01.1.454.CMB.1.raw
  modified_base (186)..(187): a, c, t, g, unknown or other
  misc_feature (186)..(187): n is a, c, g, or t
tcagtgtgagtagtcacgaccggtgctcgatttagatcgtctgtgttgggtttgggttgggtttggggggaagaggaagactgacggtcctgctccaggagcacctccgagagcacagcggccctgggctgcctggtcaaggactacttccactactcacactgagcggctggcaaggcgcatagnn

SEQ ID NO: 184913 - DNA, 695 bp, Homo sapiens
  misc_feature: GYAE6OF02GMEHP.43.34.D01.1.454.CMB.1.raw
  modified_base (228)..(228): a, c, t, g, unknown or other
  misc_feature (228)..(228): n is a, c, g, or t
  modified_base (309)..(309): a, c, t, g, unknown or other
  misc_feature (309)..(309): n is a, c, g, or t
  modified_base (334)..(334): a, c, t, g, unknown or other
  misc_feature (334)..(334): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccngcagtgatggttgggattatagccttgtctcctggtaccaagtcgccaccaggacaaacgcccccaaactcatgatttagngaggcacaaggcgcctgagggttcngactcgtcttctcgtcggtcctacgtaacgtcgtcggacaaccgtaccggtcccctcccgtacgaacctaacgtccttccggtcgggtccctaccgacgggtcctagggaaccgggacggtacggttaccgttaggttaacttttaacgtttacgttcggcgtttcgtccttacgtaatttacgttcgggtaacgttaacgggtttaacgtttaccgtaacgtttttacgttacgggttttacgttaccgggttaaggtttccgggggttaaaccgtaccgggtttaccctaaccccgggtttccgttaacgggtcccgtaaccggtaccccgaacgggttaccccccaacccgttaccgg

SEQ ID NO: 184914 - DNA, 592 bp, Homo sapiens
  misc_feature: GYAE6OF02ID8PQ.43.34.D01.1.454.CMB.1.raw
  modified_base (311)..(311): a, c, t, g, unknown or other
  misc_feature (311)..(311): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatggttgggagtttatagtcctttgtccttccgtaggtaccaagtgccaccaggacaaacgcccccaaatcatgtatttagngaggacacgtaagccggtccctgtagggttctgacttcgcttctcgtcggctaccgtagtcgtaggcaaccgccggtccctcctagactaactcctcgtcggcctccgaggtcgtaggaggaacgaggtcttacggtatttagttattcgctgtactatattcgtagcgtagttacgttactacttagtcgttcgttaacggtagttacgggaaccgtccggttacgacccggttacgttacgggtaccaccggtacccgtaacccggccctaaacccccg

SEQ ID NO: 184915 - DNA, 796 bp, Homo sapiens
  misc_feature: GYAE6OF02IH3MW.43.34.D01.1.454.CMB.1.raw
  modified_base (302)..(302): a, c, t, g, unknown or other
  misc_feature (302)..(302): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacagggtcctgggcccagtctgccctgactcagcctgcctcgtgtctgggtctcctggacagtcgatcaccatctcctgcactggaaccagcagtgatggttggagttatagccttgtctcctggtaccaagtgcacccaggacaaacgcccccaaactcatgtatttangagggcaactaagccggccctcgtagggtttctgactcgtcttctctcggtcctaccgtaagttccgtacgggtacccaaaccgtaacccgggtccccttaccccgtacggtaaaccctaaacgttcccgttaccgtcggggtcccttacccggaacggggtccgtacgggaaacggggaaccggtaacgggtccgttaaggttaactttttaaacgttttacgtttacggccgtttcggaccctttaccgtaagttaacgttacgggtaccgttaaacggggtttaaaccgttttaaaccgttaacgtttttaacgtttccgggtttaccggttttacggggttaaacggtttttaccggggggaacccgggtttaacccggggtttaccccgtaaccccgggttttacccggttaaaccggggttttaccccggaaaccgggttaacccccccggtaaacccggggaacccccccgttaaaaccccccccgg

SEQ ID NO: 184916 - DNA, 503 bp, Homo sapiens
  misc_feature: GYAE6OF02IFKDC.43.34.D01.1.454.CMB.1.raw
  modified_base (301)..(301): a, c, t, g, unknown or other
  misc_feature (301)..(301): n is a, c, g, or t
  modified_base (327)..(327): a, c, t, g, unknown or other
  misc_feature (327)..(327): n is a, c, g, or t
  modified_base (333)..(333): a, c, t, g, unknown or other
  misc_feature (333)..(333): n is a, c, g, or t
  modified_base (363)..(363): a, c, t, g, unknown or other
  misc_feature (363)..(363): n is a, c, g, or t
  modified_base (414)..(414): a, c, t, g, unknown or other
  misc_feature (414)..(414): n is a, c, g, or t
  modified_base (417)..(417): a, c, t, g, unknown or other
  misc_feature (417)..(417): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggattatagcttgtctcctggtaccaagtgcaccaggcaaagcccccaaatcatgatttangaggcactaagcgcctgagggtttcngatcgnttctctgctcaagtctgcacacggcctccngacactctctggctcgaggctgaggacgagtctagatttattatgctgctnatntgactaggttatacatttagtgttcgttacggaagttgggactacggtctaccgttcgtaggcctacgccaacggccccaacctcg

SEQ ID NO: 184917 - DNA, 191 bp, Homo sapiens
  misc_feature: GYAE6OF02GZF3J.43.34.D01.1.454.CMB.1.raw
  modified_base (186)..(191): a, c, t, g, unknown or other
  misc_feature (186)..(191): n is a, c, g, or t
tcagtgtgagtagtcacgaccggtgctcgatttagatcgtctgtgttgggtttgggttgggtttgggggaagaggaagactgacggtcctgctccaggagcacctccgagagcacagcggccctgggctgcctggtcaaggactacttccactactcacactgagcgggctggcaaggcgcatagnnnnnn

SEQ ID NO: 184918 - DNA, 557 bp, Homo sapiens
  misc_feature: GYAE6OF02FT8O5.43.34.D01.1.454.CMB.1.raw
  modified_base (303)..(303): a, c, t, g, unknown or other
  misc_feature (303)..(303): n is a, c, g, or t
  modified_base (330)..(330): a, c, t, g, unknown or other
  misc_feature (330)..(330): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcaccaggcaaacgccccaaatcatgatttangaggcactaagccgcctgagggtttcngatcgcttctctggctcaagtctggacaacgcgcctccctgactaatctcgtcggctccgaggctggacggacgaggtctagtattagttattgctgctacattagtgtcgtaggttacgttactacgtttatcgttcgttacggtagtttcgggaacgtaccgggtacctaccggttaccgttacggtccaaccgtaccccgaacggtacccctaaccccgtaccg

SEQ ID NO: 184919 - DNA, 670 bp, Homo sapiens
  misc_feature: GYAE6OF02JUEOG.43.34.D01.1.454.CMB.1.raw
  modified_base (351)..(351): a, c, t, g, unknown or other
  misc_feature (351)..(351): n is a, c, g, or t
  modified_base (386)..(386): a, c, t, g, unknown or other
  misc_feature (386)..(386): n is a, c, g, or t
tcagtgtgagtagtcacgaccggtgctcgatttagatcgtctgtgttgggtttgggggggggtcacaagaggcagcgctctcgggacgtctccaccatggcctgggctctgctgctcctcactctcctcgctcaggacacgagggtcctcgggcccagtcctcgccctgactcacgtcctgccctccgtgtcgtcgggtcctccgtggaccagtcgactccaccattcctcctgctacgtacggaaccagctaggtgtagttggttaggtagttatacgtccttgtcctccgtaggtaaccgaagtcgccaccgacggaccaaacccgaccccaaactctagtgtattagnggacgacacgtacgccgtaccgtcgtacgggttcngactcgtctctcgtcgctacagtcgtacgactaccgccgacctcgacgtactactcgtcgtcggtcgtcgcgtcgtacggacgacgtacgtacgtagttagttattacgttcgtcgtcgtctactacgtacgtacgtacgtagttaacgttacttacgttacgttacgttacgttacggtacggttacgggtacggttaccggtaccgttaccgttaccggttacgtaccgtacccgtaccctaaccggggggggggggggggggggtaccctaacccgtaccg

SEQ ID NO: 184920 - DNA, 876 bp, Homo sapiens
  misc_feature: GYAE6OF02H1M6M.43.34.D01.1.454.CMB.1.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (255)..(255): a, c, t, g, unknown or other
  misc_feature (255)..(255): n is a, c, g, or t
  modified_base (280)..(280): a, c, t, g, unknown or other
  misc_feature (280)..(280): n is a, c, g, or t
tcagtgtgagtagtcacgaccggtgctcgatttagatcgtctgtgttgggtttgggggggtcgacgaagaggcagcgctctcgggacgtctccaccatggcctgggctctgctgctcctcactctcctcgctcaggacacagggtcctgggcccagtctgccctgactcagcctgcctccgtgtctgggtcctcctaggacagtcgatccacatcctccngcacgtggaaaccancagtagatggttggaagttntagtcttgtctcgtaggtacaagtnaccaccgacgacaaaccgaccccaaactactagtataacttatcggaaggtacaacgtaacgtccgaccgtacgttaggggttctacgtacgtcgttaccgttcgttacggtcgtaccgttaaccgaacggtttcgtaacgtaccgtaaaccggtaacccggttccccgttacccgtaacgtaaaccaaccgtttccgttacccggtacgggggtccttaacccggacgggtcccgttaacgggtaacgggaaccgggtaacgggttaccggttaaggtttaacgttttaaacgtttcgtttaacgggtacccttgggtttacccttaaaccgtagtttaacggttacccgggtaaacggttttacgggggttaaacctttttaacggtaaacccgttttttaacgtcgggttttaaccccggtttaagggttttaaaacccggggttacggggtaaaccccgggggtttaccgtaccccgggggttttaaaaccccgttacccggggtttacgggggttaaaccccgttaacccggggaaccccccggggtttaaaacccggtttaccccccccaaaaccggggtttaacccccg

SEQ ID NO: 184921 - DNA, 653 bp, Homo sapiens
  misc_feature: GYAE6OF02FTY0A.43.34.D01.1.454.CMB.1.raw
  modified_base (229)..(229): a, c, t, g, unknown or other
  misc_feature (229)..(229): n is a, c, g, or t
  modified_base (336)..(336): a, c, t, g, unknown or other
  misc_feature (336)..(336): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcacgtggaaccngcagtgatggttgggagttatagtccttgtccttccgtacggttaaccaaggtcgaccacccgtaggacccaaaaccgcccccctaaaactccaagtgtaatttagnggacgggcaacgtaacggccgggcccttacggtacggggtttctggtaccttcgtcctttctccgtcggtcctaccgaagttccgtgaccaaccgccggtccctccgtagacctaacgtccgtcgtcgggtcctaccggaggccgttagggaacgggaccggtaggtcgtagttatttaattcgttgcttgcctatagtatcgacgttacgttacttactagttacgttgttaccgttaggtacgttcgggaaccggttaccgccgttacccgtaccgtaggtaccgaccgacccgtaaccgacccctacccgtacg

SEQ ID NO: 184922 - DNA, 787 bp, Homo sapiens
  misc_feature: GYAE6OF02HR6BD.43.34.D01.1.454.CMB.1.raw
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctctggacagtcgatcaccatctcctgcactacggaaccagcagtgtagtggttgggtagttatacgcctttggtccttccgttacggtaaccaaggttcgacctacccgaaggaccgaaaaccgacccccccaaaacgtcaactagtaacttttagtacggacgggtacaacgttaaacgggcccggtaccccgttaccggttaacgggggttttccgtcggtaacgttccggtaccttttcgtccgttacgggtccttaccggaaacgttcgttacgggaacccaaccgtacccgggtaccttccccgtacgtaaactacttccgtaccgttcgggaccttccgaggtccgtagggacggacggtacggtacgttgtaaattttacgttattcggtaccgtagtacctactaagttacgtcggtacgttagggttaaacgtttacttaacgtttacgttacggtttaccgttagggttaacgggttaacggggttaacccggtaccgggttaaccccgtacccggttacccggttaaccggttacccgtaacccggtaccccgtaaacccgggacccctaaccccccggttaaccg

SEQ ID NO: 184923 - DNA, 536 bp, Homo sapiens
  misc_feature: GYAE6OF02HCHSL.43.34.D01.1.454.CMB.1.raw
  modified_base (305)..(305): a, c, t, g, unknown or other
  misc_feature (305)..(305): n is a, c, g, or t
  modified_base (333)..(333): a, c, t, g, unknown or other
  misc_feature (333)..(333): n is a, c, g, or t
  modified_base (368)..(368): a, c, t, g, unknown or other
  misc_feature (368)..(368): n is a, c, g, or t
  modified_base (427)..(427): a, c, t, g, unknown or other
  misc_feature (427)..(427): n is a, c, g, or t
  modified_base (443)..(443): a, c, t, g, unknown or other
  misc_feature (443)..(443): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggattatagccttgtctccgtaggtaccaagtgcaccaggcaaacgcccccaaatcatgatttangaggcactaagcggccctgagggtttcngactcgcttctcgtggctaccaagtctggacaacncggtcctcctagacactctcgtcgggctcgaggctggaggacgaggctagatttagttnttgctgcctacatacngactaaggttacttacagtttatgttacgtaggtagttgggaacgtacggtaccacgttcgacggttcaccggacccaagaccccaccctacg

SEQ ID NO: 184924 - DNA, 748 bp, Homo sapiens
  misc_feature: GYAE6OF02IBFU3.43.34.D01.1.454.CMB.1.raw
tcagtgtgagtagtcacgaccggtgctcgatttagatcgtctgtgttggggtttgggggggggtcacaagaggcagcgctctcgggacgtctccaccatggcctgggctctgctgctcctcactctcctcgctcaggacacagggtcctgggcccagtctgccctgactcagcctgcctccgtgtctgggtctccgtggacagtcgatcacatctctgcactggaaccagcagtgattggttgggtagttatacgtcctttgtctcgtagtaccaagtgcctaccaggacaaacgcccccaaactcagtgtatttagtgaggacacgtaacgcggccctgacgggtttcagactcgtcttctacgtcggtctacgaggttaccgtggtacaaccgacccggtcccttaccccgtacggtaaacctaactttcccgttaccggttccggggtacccttaccgacgggtaccgtaacgggtaccggggtaaccggttaagggtcccgtttaagggttaaacctttttaagttttaacggttcgttaaccgttcggtaccgtttaacccgaagtttacgttacgtaaccggttaagggtttaaaccggtttaacctaaagtttttacgcgtttaccgtttaacgggttaaggttcgggggtaacccgtaccgggttacccgtaacccggtttccgtaacgggttaccctaccggtaaccccggaaccggtacccccgaacccgttacccgg

SEQ ID NO: 184925 - DNA, 687 bp, Homo sapiens
  misc_feature: GYAE6OF02F6E6X.43.34.D01.1.454.CMB.1.raw
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
  modified_base (309)..(309): a, c, t, g, unknown or other
  misc_feature (309)..(309): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacagggtcctgggcccagtctgccctgactcagcctgcctccgtgtcgtggtctcctggacagtcgatcacatctccngcactcggaaccngctagtagatggtggtattatacgtcttgtctccgtaggtaccaagtcgcacccgaggaccaaacgccccaaatcagtgtattagngaggcagtacgccgtcctagtacgggttctagtactacgtcttcgtcgtacggctacgtaagtcgtacggtaccaacgtacccggacccttacccgtacgtaaacctaacgttcgtacccggtcgggtacccttaccgaacgggtaccgttaacggaaccggggaacgttacggtaccgttagttaagttttaacgtttacgtttacgggcccttagttaccgttacctaagttactaccgggtagttaacggtttaaccgtttacgttaaacgtttgttacggttacgtttacgggaaggtttaccggggaacgtaacccggtacgttccgttaaccgtcggtaaccgtaccaccccggtacggtacccctaacccg

SEQ ID NO: 184926 - DNA, 702 bp, Homo sapiens
  misc_feature: GYAE6OF02IDSFO.43.34.D01.1.454.CMB.1.raw
  modified_base (339)..(339): a, c, t, g, unknown or other
  misc_feature (339)..(339): n is a, c, g, or t
  modified_base (439)..(439): a, c, t, g, unknown or other
  misc_feature (439)..(439): n is a, c, g, or t
  modified_base (529)..(529): a, c, t, g, unknown or other
  misc_feature (529)..(529): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgacctcagcctgcctccgtgtcgtgggtctccgtggacagtcgactcaccatctcctgccactaggaaccagacagtgagtggttagggagtttatacgtcgttcgtctccgtacgtaccgaagtcgaccgacccgaggaccaaaccgacccccaaactctagttagtactttagnggacgggaccaacgtaacggccgtaccgttcggtagggtttctagtactcgtcttcgtcgtcgtcgtacgacgtcgtacgcaaccgccggtcctcccganaaccgtaactccgttccggtcggtacctaccggtacgtccggtacgggacgggaacgtacggtacgttagttactttaagtttcgttacnccgttcgtaccgttaacttagttacgtcgtacggttaagttacttaacgttacttttagtacgtttaccggttaacgggttacgttaacggggaaccgttaccggttccccgtaaccgtaccgtttacggaccgacccgtacccggaaacccgtaccccgtaaccccgttccg

SEQ ID NO: 184927 - DNA, 779 bp, Homo sapiens
  misc_feature: GYAE6OF02HMV2M.43.34.D01.1.454.CMB.1.raw
  modified_base (201)..(201): a, c, t, g, unknown or other
  misc_feature (201)..(201): n is a, c, g, or t
  modified_base (252)..(252): a, c, t, g, unknown or other
  misc_feature (252)..(252): n is a, c, g, or t
tcagtgtgagtagtcacgaccggtgctcgatttagatcgtctgtgttgggtttggggggggtcgacaagaggcagcgctctcgggacgtctccaccatggcctgggctctgctgctcctcactctcctcgctcaggacacagggtcctcgggcccagtctgccctgactcagcctgcctccgtgtctgggtcctctcgganacggtcaactcaaccattctcctagccacgtacggaaaccaggcttaaggngtaagttgggttagggtacgttagtacgtccgtttgtcgtccgttacggtaacctaagtcgacccaccgacggaccaaaccgacccccaactaccgatacgtattactaggaacggtcaacgtaacggcccggtaccttacggtaagggttccttacggacgttccggtccttacgtccgttcggcccttaaccgtaaacggttccacggggtaaaccaaccggtacccggtacccgtacccgttacgaaaccttacgttccggtacggttaccggccgttaccggaccgtacggtcggacgggaacggtacgggccttaagttaacgttaatttacgttcgtaccgtagtccgttaacttacgtacgttacgtacggtaaggtttacctaacgttaactttacgttacggttacgttacgggttaacggtaccggggtaaccgtacggggttccgtaaacccggttccggttaacggtcccgtaaaccggacccccgggttaaccgaccccgtaaacccgttccgg

SEQ ID NO: 184928 - DNA, 687 bp, Homo sapiens
  misc_feature: GYAE6OF02H8YNL.43.34.D01.1.454.CMB.1.raw
  modified_base (552)..(552): a, c, t, g, unknown or other
  misc_feature (552)..(552): n is a, c, g, or t
  modified_base (560)..(560): a, c, t, g, unknown or other
  misc_feature (560)..(560): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacgagggtcctgggccccagtctcggcccctgacctcagcctgccctccgtgtctgggtctcctggacagtcgatccaccatccttcctgctacgtaggaaccagcagtgattgggttagggtagtttacgtacgtccttcgtccttccgtaggtaaccgtaagtcgaccaacccgaacggaacaaaccccgtaaaccccctaaatacctaagtacgttattttacgacgggtaacgggacctaacgtaacggcccggtacccgtcgggtaacgggttttcacgtacgttccgtcttcgtaccgtcgaccgtacgtacgtcgtacggaccaaccgtccggtcccttaccgtagtaaccttaccgttccgtcggtacggtctacgacggtactggaacggtacgtggtctagtacttagtnttcgcgtntactacagtgtctaacgtagttacggttaacttacgttagttcgttacgttaggtcggtacggtacccggtcgttaaccaccggttcgaacgtccgaaccggacccggtacccctaccgtaaccccg

SEQ ID NO: 184929 - DNA, 751 bp, Homo sapiens
  misc_feature: GYAE6OF02FZOTX.43.34.D01.1.454.CMB.1.raw
  modified_base (226)..(226): a, c, t, g, unknown or other
  misc_feature (226)..(226): n is a, c, g, or t
  modified_base (243)..(243): a, c, t, g, unknown or other
  misc_feature (243)..(243): n is a, c, g, or t
  modified_base (302)..(302): a, c, t, g, unknown or other
  misc_feature (302)..(302): n is a, c, g, or t
  modified_base (341)..(341): a, c, t, g, unknown or other
  misc_feature (341)..(341): n is a, c, g, or t
tcagtgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctcgtgtctgggtctccgtggacagtcgatcaccatctctgcactggaaccngcagtgatgtggattangtccttgtctcgtgtacagtcgcaccgaggacaaacgaccccaaactcatgtatttagnggacggactacaaggcccggtaccttcgtaggggtttcngtacgtccgtctttccgtcgtcggtacctaccgtaagtccgtacggaccctaacgtaccggtccctcccgtacgtaacctaacgttcccgttaccgggttcgggtcccttacccggagggttaccggtacggaacgggtaccggttacggtaccgttaggttaacttttaacgttacgttacgggtccttacggtccttaccggtaagttacggttacggtaaccgttaacggggtttaacctttaaccgttaacgttttacgttacgtttaccggtttaacggggttaacggtttaacgggggtaacccgttaccgggttaaccccgttacccggtttacccggttacgggttacccgaaaccccggttaccccgaaacccgggttaaccccccgaacccctttaccgg

SEQ ID NO: 184930 - DNA, 684 bp, Homo sapiens
  misc_feature: GYAE6OF02FOS12.43.34.D01.1.454.CMB.1.raw
  modified_base (245)..(245): a, c, t, g, unknown or other
  misc_feature (245)..(245): n is a, c, g, or t
  modified_base (301)..(301): a, c, t, g, unknown or other
  misc_feature (301)..(301): n is a, c, g, or t
  modified_base (328)..(328): a, c, t, g, unknown or other
  misc_feature (328)..(328): n is a, c, g, or t
  modified_base (406)..(406): a, c, t, g, unknown or other
  misc_feature (406)..(406): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctcgtgtctgggtctcctggacagtcgatcacatctctgcactggaaccagcagtgattgttgggattanagccttgtctcctggtaccaagtgcaccaggacaaacgccccaaatcatgattagngaggcactaagccgcctgagggtttcngactcgtctttctcgtcgcctaccagtctcggacaacgacggccctcctagaactaactccgtcgtcgggctacccgngtacgtggaacggacgtacggtcttaagttaacttttagttaactttcggtacccgttagtcccgttaacaaagtttacgtaggtaccgttaaagggtttaacgtttaaaccgtaaccgtttttaacggttacgtttacccggtttaacgggttaaacgggttttaaccggggaaaccggttaccgggttaaccctaccccgggtttaaccgttaacgggttcccgtaaaccgggaacccccggtaaaccggtacccccctaaacccccgttacccgg

SEQ ID NO: 184931 - DNA, 692 bp, Homo sapiens
  misc_feature: GYAE6OF02J22KO.43.34.D01.1.454.CMB.1.raw
  modified_base (401)..(401): a, c, t, g, unknown or other
  misc_feature (401)..(401): n is a, c, g, or t
tcagtgtgagtagtcacgaccggtgctcgatttagatcgtctgtgttggggtttggggggggtcacaagaggcagcgctctcgggacgtctccaccatggcctgggctctgctgctcctcactctcctcgctcaggacacagggtcctcgggcccagtctcgccctgactcacgcctcgcctccgtgtcgtgggtctccgtggacagtcgactcaccatcctccgtgcctacgtacggaaccgagcgtaagtgtacgttggttagggtattacgtacgtccgttcgtccgtccgtaaggtaaccgtaagcgtaccaccgaaggaccaaacccgtaccccaaatctaactgtacttaggacggacggactaacgacggcccgtaccgtacggttacgggttnacgtacgtcctacgttctcgtcggtcctacgtacgtcgtacgtaccaccgtcccgtacctccgtacgtactcgtaccgtcgcggtacgtccgtaggtactagggaccggacgtaggttcgttaacgtttaacgtttctacgttcgtacttcgtcttacgtaagtcgtacgtaacggtttacgttaacgttacgtaacgtttacgtcgttacggtacgggtacggtacgggaccgtacgtaacgtccgtacggtacgtacgaacccgtacgaacccggtaccctaccgtacg

SEQ ID NO: 184932 - DNA, 349 bp, Homo sapiens
  misc_feature: GYAE6OF02JAOOY.43.34.D01.1.454.CMB.1.raw
  modified_base (322)..(322): a, c, t, g, unknown or other
  misc_feature (322)..(322): n is a, c, g, or t
  modified_base (325)..(349): a, c, t, g, unknown or other
  misc_feature (325)..(349): n is a, c, g, or t
tcagtgtgagtagtcacgaccggtgctcgatttagatcgtctgtgttgggtttgggtcaggggtttctgatcgcttctctggctccaagtctggcaacacggcctccctgacaatctctgggctccaggctggaggacgaggctgattattattgctgctcatatgcagggttacgttacacttatgtcttacgggaattgggacgacggtcaccgtccgtaggtcacgtcccaacggacccaaaccccactgtacctacttcctcgttccccgccctcctcacctactcactacgtgacgcgggctggaccgagcgactanagnnnnnnnnnnnnnnnnnnnnnnnnn

SEQ ID NO: 184933 - DNA, 624 bp, Homo sapiens
  misc_feature: GYAE6OF02FICZR.43.34.D01.1.454.CMB.1.raw
  modified_base (232)..(232): a, c, t, g, unknown or other
  misc_feature (232)..(232): n is a, c, g, or t
  modified_base (390)..(390): a, c, t, g, unknown or other
  misc_feature (390)..(390): n is a, c, g, or t
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
  modified_base (462)..(462): a, c, t, g, unknown or other
  misc_feature (462)..(462): n is a, c, g, or t
tcagtgtgagtagtcacgaccggtgctcgatttagatcgtctgtgttggggtttgggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcatcaccatcctctgccacgtcggaaccngcagtgagttggttgggtattagtacgtccttgtcctaccgtggttaaccaagtcgaccgtacccgacgggaccaaaccggaccccctaaactcagttagtaagtttacgtaggacgggactaacgttaacggccggttaccctcgtaggggttttcngtactcgtcttctcgtcgctacgagtctcgacacncgtcctacnactactctcgtcggactccgaggtacgnggacggacgacggtcagttattattcgtcgtactcgtctactatcgtagacgttaagttactactagtttacgcgtttcgttacgtaggttacgggacgtaccggtaccgtacccgttacgtagtcccgaacggaccccgaaccgtacccggacccctacgg

SEQ ID NO: 184934 - DNA, 683 bp, Homo sapiens
  misc_feature: GYAE6OF02G8YSN.43.34.D01.1.454.CMB.1.raw
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacgagggtcctgggcccagtctgccctgactcagcctgccctcgtgtcgtgggtctccgtggacagtcgatcacctatctcctgcactaggaaccagcagtgaagttggttgggattatagtcttgtcctcgtgtaacagtcaccaccgagaccaaaccgacccctaaatcagttagtaactttagacggtacgggactaacgtaacggccggtaccctaggtagggtttcagtacgtcgttctctcgtcgtacctacgtacgtcgtacgacctaaaccgtccgtccctacgtacgtaacctaacgtccgtcgtaccgggtacctaccggacggtaccgagggtaacggacggacggttaacttagttaattttacgttacgttcgtacgttctacgttactagttaacgtcgtaacgtaaggttaccttaacgtgttaacgttcggttacgttacggtaacggttccggggaaccgttacggtacccgttaccgtaccggttcgtaaccgaccctaacccggtaaccgacccgtacccttaccgg

SEQ ID NO: 184935 - DNA, 772 bp, Homo sapiens
  misc_feature: GYAE6OF02JZ5V2.43.34.D01.1.454.CMB.1.raw
tcagtgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgccactggaaccagcagtgatgttgggattatagccttgtactcgtggtaccaagtcgcaccaggacaaacgcccccgaaatccagtacgaacttttagacgtaacgggacctaacgttaacggccggtaccccttcggtaacggggtttctacggacttccgtcctttccgtcgttcgggacctacccgtaaggtccgtagggacctaaaccgacccggtccctacccgtagaacccgtaattcccgtacgtcggggtaccttacccggagggtccgttacgggtaacgggaccggtaacggtcttacggttaacttttacgttaaggtttcgccgtttaaggccctttagtaaacgtttcgttacggtaccggttaacgggtttaaacgttaaccgttaaaccgttttagttaccgtttacggtttaaccgggttaaacggttccggggtaaccggttaacccgggttacccgtacccgggtttaaccgttaccggggttaccaaacccgggaaccccgttaacccgggtaacccccttaaccccttaacccggg

SEQ ID NO: 184936 - DNA, 888 bp, Homo sapiens
  misc_feature: GYAE6OF02IBEMG.43.34.D01.1.454.CMB.1.raw
  modified_base (275)..(275): a, c, t, g, unknown or other
  misc_feature (275)..(275): n is a, c, g, or t
tcagtgtgagtagtcacgaccggtgctcgatttagatcgtctgtgttgggctgggtcacaagaggcagcgctcgtcgggacgtctccaccatggcctgggctctgctgcctcctcactctcctcgctcgaacggacacgacggggtcccgtggggccctagttcctcgccctagtacctcacgtcctgcccttccggtgtcgtcgggttcctccgtaggacctacggtccgtactaccacctattccctccgtcgacctacggtacggaaacccngtactagggttgtaaggttggggtttacgggagttttaacgtcggttccctttcggttcccttaccggtacgggttaacctaaacgtacggtcccgaacccgtaccgggaaacccgaaaccccgtaacccccgtaaccctactaacgttacgtttaacgtttcgtacgggaaccggtaccgtaacgttaccggtaacccggtccccggtttaggttaaccggggtttcgttaacgtaccggttcttaccccgtttcgttaccggtacggttaccctaaccgttaacgggttaccgttcccggaaaccgtacccggtaccggttaccccctacgttaacgtacctaaccgtttcccggttcgggtacccgggtcccgttaccggacgggaacgggtttaccggggaacggggttaaacccgggtacggtttacgttaacgtttacgtttaaagttttcgtccgttacgtccgttacttaccgtacgttacctacgggttaagttaacgttaacgttacgttactttcggtacgtttacgtacgggttaggtaccggtcgtccggttaactccgtaaggtccgtaaccgcccgtaaccgaccccggtctaacccg

SEQ ID NO: 184937 - DNA, 635 bp, Homo sapiens
  misc_feature: GYAE6OF02HCBD7.43.34.D01.1.454.CMB.1.raw
  modified_base (147)..(147): a, c, t, g, unknown or other
  misc_feature (147)..(147): n is a, c, g, or t
  modified_base (501)..(501): a, c, t, g, unknown or other
  misc_feature (501)..(501): n is a, c, g, or t
  modified_base (621)..(621): a, c, t, g, unknown or other
  misc_feature (621)..(621): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtccngggcccagtctgccctgactcagcctgcctcgtgtctgggtctcgtggacagtcatcacatctcctgcacgtcggaaccagctagtcgagttggttgggattagtacgtccttgtctccgtaggtaccagtcgaccaccgaggaccaaaccgacccctaactcactacgtatttagcggtagggactaacgacgcccggtccttcggtaggggtttctggtacttcgtctttctcgtacgtcctacgtacgtctcgaccaaccgccgccctacgtacgactacgtctcggtcggcctccgagtcgtacggacggacgtcggactttgtaactttattacgtcgtgtcgtcctanccgttagtcgtacttaagggtttctacgttaaccgtttgttggtttacctagggtttacgtacgggtaccggtaaccggtccgttcccgggtacgtacgtaccggaccgacccggtaacnccccgtaccttacg

SEQ ID NO: 184938 - DNA, 763 bp, Homo sapiens
  misc_feature: GYAE6OF02IZ39Q.43.34.D01.1.454.CMB.1.raw
  modified_base (130)..(130): a, c, t, g, unknown or other
  misc_feature (130)..(130): n is a, c, g, or t
  modified_base (678)..(678): a, c, t, g, unknown or other
  misc_feature (678)..(678): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgntcaggacacgagggtcctgggacccagttctgccctgactcacgcctcgcctccggtgtcgtgggtctcctggacagtcgatcaccagttctacctgcactcggaaccagtcaagttgtaactgggttaggtagtttaagtacgtcctttgttaccgttcccgtacgggttaaccctaaggtccggtacccgaaccccggaaccggaacgtaaaacccggtaacccccccaaaacttcgtaagttcgtaaatttacgtacggacgggtacctaaccgtaaacggtccggacccgttacggtacgggttttaccacggtaccgttacgtacccttttcgtaccgttccgggtaccttaaccgtaaacggttcctaaccggggtaacctaaaccggtacccgtccccgtaacccttagaacccgtaactttcccgtaggtccggtcctaccggtaggcgttaaggacgggtaaccgacgttagtaacgttattacgttgttaacgtcgtacgcttagtacgtagtcgttagaagttaacgtattaacgtnttgtaccgttagtacgggttcgaacggttcggtaccgtccttaccggtacgtaccgtaaccgtacccgacgttaacccaccttac

SEQ ID NO: 184939 - DNA, 666 bp, Homo sapiens
  misc_feature: GYAE6OF02GXQRL.43.34.D01.1.454.CMB.1.raw
  modified_base (319)..(319): a, c, t, g, unknown or other
  misc_feature (319)..(319): n is a, c, g, or t
  modified_base (357)..(357): a, c, t, g, unknown or other
  misc_feature (357)..(357): n is a, c, g, or t
tcagtgtgagtagtcacgaccggtgctcgatttagatcgtctgtgttgggtttgggggggggtcacaagaggcagcgctctcgggacgtctccaccatggcctgggctctgctgctcctcactctcctcgctcaggacacagggtcctgggcccagtctgccctgactcagcctgcctccgtgtctgggtctccgtggacagtcgatcaccatctctgcactggaaccagcagtgatggttaggagttatagtccttgtctccgtgtaccaagtcgacaccgaggaccaaaccgacccccaaactcatcgtatttacgnggacggcaacgtaacgccggtacctcggtagggtttcngtactcgtctttctcgtggtcctacgtaagttcgtagaccaaccgtacccggtccctccgtacgaacaacgtttcctcggttcgggccctaccgacggtacgtacgggtaacgggacggacggtcgttagttaactttagttagttcgtaccgttgtccttacgtagttacgtcgtacgttaggttaacctttactaacgtttagtcgtttcggttacggttaacggttacggggaccgttaccgggtacctacccggttacgttacggtacctacccggtacccgaaccggtaccccgtaaccccgtc

SEQ ID NO: 184940 - DNA, 722 bp, Homo sapiens
  misc_feature: GYAE6OF02IM5LI.43.34.D01.1.454.CMB.1.raw
  modified_base (222)..(222): a, c, t, g, unknown or other
  misc_feature (222)..(222): n is a, c, g, or t
  modified_base (550)..(550): a, c, t, g, unknown or other
  misc_feature (550)..(550): n is a, c, g, or t
tcagtgtgagtagtcacgaccggtgctcgatttagatcgtctgtgttggggtttggggggggtcacaagaggcagcgctctcgggacgtctccaccatggcctgggctctgctgctcctcactctcctcgctcaggacacgagggtccgtcgggcccagtctcgccctgactcacgcctcgcctcgtgtcgtggtctccgtggacagtcgatcaccatctcngacacgtggaaccagcgtagtgtagttggttacgggagttagtcgtcttgttctacgtcggtaactacgtcgaccaccgacggacaaaaccgacccctaaactcaagtacgttactttaaggacggaacggtacctaacgtaaccgccggtacccgttacggttacgggttcgttcgtaccgttcgtcgttacgtcgtcgtactaccgtaacgttcgaccgtacaaacggtccggtaccctccgtacgaacctacgtcgtcgtcgggtcctacgcggacggtacgggacggaacgtcggtacgttacgttaagtttacgttacgttcnccgttcgtacgttcgtaaagtcgtacgtacggttaacggttacgttaaacttcgttaacgttcgttaccgggttaacggttacggtaccgggtaacttcccgggtaccttaacccggtcgtaaccggttaccgaccgttaacccggaacccgttaccccgaacctaaccggg

SEQ ID NO: 184941 - DNA, 630 bp, Homo sapiens
  misc_feature: GYAE6OF02IUTSO.43.34.D01.1.454.CMB.1.raw
  modified_base (484)..(484): a, c, t, g, unknown or other
  misc_feature (484)..(484): n is a, c, g, or t
  modified_base (517)..(517): a, c, t, g, unknown or other
  misc_feature (517)..(517): n is a, c, g, or t
  modified_base (522)..(522): a, c, t, g, unknown or other
  misc_feature (522)..(522): n is a, c, g, or t
tcagtgtgagtagtcacgaccggtgctcgatttagatcgtctgtgttgggtttgggggggggtcacaagaggcagcgctctcgggacgtctccaccatggcctgggctctgctgctcctcactctcctcgctcaggacacgagggtcctgggcccagtctgccctgactcagcctgcctccgtgtctgggtctccgtggacagtcgatcaccatcctcctgcacgtacggaaccagcgtagtgagttggttagggattatacgtcctttgtccttaccgtacggtaacaagtcgacccaaccgaggaccaaacccgaccccaaatcaattgttaatttagacggacggtacctaacggtaacggcccggttacccgttagggttacggggtttcagtactccgtctttcgtcgtcggtcctacgtagtcgtcgaccaccgccgtccctacgtagactacttcgtacgcggtcctcggagtacgngggacggcgtagtcttagtaactttgttagtcncgtancttatatacgtgacgtagttactacgttgttagtcgttcggtaggtacgtcgggaccgtacgttccgacggttcgacgtaccgacccggaccgacccgtacccactcg

SEQ ID NO: 184942 - DNA, 367 bp, Homo sapiens
  misc_feature: GYAE6OF02HIC4G.43.34.D01.1.454.CMB.1.raw
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (302)..(306): a, c, t, g, unknown or other
  misc_feature (302)..(306): n is a, c, g, or t
  modified_base (308)..(308): a, c, t, g, unknown or other
  misc_feature (308)..(308): n is a, c, g, or t
  modified_base (315)..(315): a, c, t, g, unknown or other
  misc_feature (315)..(315): n is a, c, g, or t
  modified_base (318)..(367): a, c, t, g, unknown or other
  misc_feature (318)..(367): n is a, c, g, or t
tcagtgtgagtagtcacgaccggtgctcgatttagatcgtctgtgttggggtttgggtcaggggtttctgatcgcttctctggctccaagtctggcaacacggcctccctgacaatctctggctccaggctgaggacgaggctgattattatgctgctcatatgcaggtagttacacttatgtcttacggaattcgggacgcggtcaccgtctaggtcagcccaaggccccaaccccatgaccactctcgttccccacctctcactcnacactgacgccggtntggcaaggccnaatgtacnnnnnangctacgnagnnnnnnnnnnnnnnnnnnnnnnnnnnnnnnnnnnnnnnnnnnnnnnnnnn

SEQ ID NO: 184943 - DNA, 712 bp, Homo sapiens
  misc_feature: GYAE6OF02JNXYP.43.34.D01.1.454.CMB.1.raw
  modified_base (252)..(252): a, c, t, g, unknown or other
  misc_feature (252)..(252): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctggcccagtctgccctgactcagcctgccctccgtgtcgtgggtctccgtggacagtcgatcacctatctcctgcactaggaaccagcagtgatggttggagttanagtccttgtcctcgtgtaaccaagtcgcaccaggacaaaccgaccccaaatccaagtcgtatttacgcggagggaccaactaacggccggtccccgtaggtaacggggttttctcggtaacttccggtcctttctaccgttaggacccttacgaaagttccgtacgggacccaaaccggaccggtccccttaaccgtacgtaactaacgtcccgtacgttccggggtaccctaccggaacgggtctaacgggaaccggaaccggtaggttaccgtagtttaaacgttttaacgttcgtttacgcgttaccgtaccgtttactaacttacggttcgtaacgttaacgtttcgttaaccttacgtttaacgtgttcgttaaccggttaggtaacgggtaaccgtacggtaccgttaccgtacgtaacgtccgaacggtaccccaacggtcccaaacccgtcg

SEQ ID NO: 184944 - DNA, 701 bp, Homo sapiens
  misc_feature: GYAE6OF02JMGEP.43.34.D01.1.454.CMB.1.raw
  modified_base (212)..(212): a, c, t, g, unknown or other
  misc_feature (212)..(212): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcacatcncctgctactggaaccagcagtgatcgtagggattatagtccttgtcttccgtaggtaccaagtcgaccaccgaggaccaaaacgaccccctaaaactcgaatcgtaactttatcggaacggctaacgtaacggacggcccttcgtaacggggtttcacggtatccgtctttacgtcgtcggtctaccgtaacgtcgtacggacctaaccgaccggtccctaccgtcgaactaactcctcgtcgggcccttacgacggtcgtggaacgacggtcgtcgtagttacgttaattcgttacgcgttacgaccttactaacgtaccgttcgaaccgtttaaggttaaaccggtttactaaaccgttttgttaacgttaccggttttacgggtaaacggttcgggaaccggttacgggtaaccccgtaccggttttacgtaaccggttccgaaaccggttaccccgaaccggtacccctaaacccccgttaacgg

SEQ ID NO: 184945 - DNA, 773 bp, Homo sapiens
  misc_feature: GYAE6OF02HI1AL.43.34.D01.1.454.CMB.1.raw
  modified_base (239)..(239): a, c, t, g, unknown or other
  misc_feature (239)..(239): n is a, c, g, or t
  modified_base (308)..(308): a, c, t, g, unknown or other
  misc_feature (308)..(308): n is a, c, g, or t
  modified_base (335)..(335): a, c, t, g, unknown or other
  misc_feature (335)..(335): n is a, c, g, or t
tcagtgtgagtagtcacgaccggtgctcgatttagatcgtctgtgttggggtttggggggggtcacaagaggcagcgctcgtcgggacgtctccaccatggcctgggctctgctgctcctcactctcctcgctcaggacacgacgggtcctcgggcccagttcctcggccctgactcgacgcctcggccctccggttgtccgtgggtcctccgtaggactagtcgatccacctattccncctgccacgtacggaacctgctagtgtattgggtaggtattacacgtcttgtctcgtacgtacgagtcnccaccgagaccaaaccgccccaaatcngtacgtatttacgacggaacggacctacgtaacggccggtacccgttacgggtacgggtttctagtacgtcggttcttccgttcgtcggtaacccgttaccgaacggttcgaccggtaacccaccggttacccgtcccgtacccggttagaaaccgttcgtaccgttacggtccggtacctacggtacggtacgtagggacggtacgtacggtacgttagttacgtttaacgttacgttcgtaccttcggtacttaaacttgtacttacgggtaacgttaacgtaaccggttaaactttaccggtttagttaccggttacgggttcggttaaacgggtcccggggtaaccggttacccggttaacccggttaaccggttacccgttaccggtaacccgaccggtaacccccggtaacggtaccccccttaacggtccg

SEQ ID NO: 184946 - DNA, 770 bp, Homo sapiens
  misc_feature: GYAE6OF02H6JFF.43.34.D01.1.454.CMB.1.raw
  modified_base (155)..(155): a, c, t, g, unknown or other
  misc_feature (155)..(155): n is a, c, g, or t
  modified_base (255)..(255): a, c, t, g, unknown or other
  misc_feature (255)..(255): n is a, c, g, or t
  modified_base (417)..(417): a, c, t, g, unknown or other
  misc_feature (417)..(417): n is a, c, g, or t
  modified_base (494)..(494): a, c, t, g, unknown or other
  misc_feature (494)..(494): n is a, c, g, or t
tcagtgtgagtagtcacgaccggtgctcgatttagatcgtctgtgttgggtttggggggggtcacaagaggcagcgctctcgggactctccaccatggcctgggctctgctgctcctcactctcctcgctcaggacacgagggtcctgggacccngtctcgccctgactcgacgtcctcgcctcgtcgtcgtgggtctccgtggacgtacgtcgactccactacttcctacctgactacgtacggaaccagtacngtagtagtcggttagggattagtacctccgttagtccgtaccgtacggtaacctagtcgaaccaccgacgaaccaacccgaaccccaatcgtaagttagttacttaggtacgggaacgtaccgaacgttaccgggaccgtccgtaggggttacgggtttacncggttacctccggttacttccggttaccgttcggaccctacggtagttccggacgtacacccgtcgtcccttacganacctacgttcgtcgtcgtaccgacgtcggtacgacggacggacggtagtacgtttaagtctttaagttcgttaccgtgtaacgtaccttagtaacgtcgtaacggtacgttaacggtttacttaaacgtaccgttttaacggtcgtttacgggtaaccgggtttacggtaaccgggttaaccgttacccgggttaaccgtaacccgggtttaccggttcggtaaccccggaacccgttaacccgggtaaccccgaaccccgttacgttaacccggg

SEQ ID NO: 184947 - DNA, 542 bp, Homo sapiens
  misc_feature: GYAE6OF02GIZHL.43.34.D01.1.454.CMB.1.raw
  modified_base (303)..(303): a, c, t, g, unknown or other
  misc_feature (303)..(303): n is a, c, g, or t
  modified_base (338)..(338): a, c, t, g, unknown or other
  misc_feature (338)..(338): n is a, c, g, or t
  modified_base (366)..(366): a, c, t, g, unknown or other
  misc_feature (366)..(366): n is a, c, g, or t
  modified_base (409)..(409): a, c, t, g, unknown or other
  misc_feature (409)..(409): n is a, c, g, or t
  modified_base (460)..(460): a, c, t, g, unknown or other
  misc_feature (460)..(460): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggattatagccttgtctcctggtaccaagtgcaccaggcaaacgcccccaaatcatgatttanggaggcacgtaacgccggcccttcgaggggtttcngactcgcttctctggctcagtctgcacncgcctcctagacactctcgtggctccgagctggaggacgcggntgtattattgttgcgttgctatatactgtacgtaagttacttactacgttntgttacgttacggtagttcgggaagtaccggtacctaccgttccgacggtcaccggacccgacggtaccccaacccgtaccg

SEQ ID NO: 184948 - DNA, 762 bp, Homo sapiens
  misc_feature: GYAE6OF02FNTHZ.43.34.D01.1.454.CMB.1.raw
  modified_base (204)..(204): a, c, t, g, unknown or other
  misc_feature (204)..(204): n is a, c, g, or t
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgccctcgtgtctgggtcctccgtgacagtcntacaccatcctcctgctactggaaccagacagtgattgggtttaggagttactaggccttggtctcctacggtaccaaggtcgactaacccgaggacctaaacggaccccccaaaagtccgtaatcgtaattttacgacggtacgggactaaccgttaaacgggccggtaccccgttacggtacgggtttccgtggtaacgtcccgtctttacgttcgtcggtacccttaacgacgtaccggtacgtaccgaaacccgaccggtcccttacccgtacgaacctagtcccgttacgccgggtacctccgacgggtcgtacgggtaacggaccggtaacgggtccgtaaggttacttaacgttttcgtacgtccggttagaccgttaccgtaagttagtcgtaacgtaacgggttaactttaacgttaacgtttagttacggtttacgttacggtaacgggttacgggaaccggtcccgggtttaaccgaacccggtttaccgaaccgggtttcaccccggttaaaccggaccggttaacccccgtaaccctaacccggg

SEQ ID NO: 184949 - DNA, 750 bp, Homo sapiens
  misc_feature: GYAE6OF02H7ZPD.43.34.D01.1.454.CMB.1.raw
  modified_base (118)..(118): a, c, t, g, unknown or other
  misc_feature (118)..(118): n is a, c, g, or t
  modified_base (330)..(330): a, c, t, g, unknown or other
  misc_feature (330)..(330): n is a, c, g, or t
tcagtgtgagtagtcacgaccggtgctcgatttagatcgtctgtgttgggtttgggggggtcacaagaggcagcgctctcgggacgtctccaccatggcctgggctctgctgctcctnactctcctcgctcaggacacaggggtcctgggcccagtctgccctgactcagcctgcctccgtgtctggtctccgtggacagtcgactcaccatctcctgcactggaaccagctagtgatcggttagggattatacgtccttgtccttccgtcggtacaagtcgaccaccgaggaaccaaacgccccccaaaactcctagtcgtaattttancggagggaccaacgtaacggccggtacccgtaggtaacggggtttctacgtaacgtccggttctttcggtcgttcggaccttaccgaacgttccgtacgtaaccgaaccgtacccggtcccttacccgtgtaacctaacgttacccgttcggtacgggtacccttaccgggtaggtacccgttagggaacgggtacggtaacggttacctttaaggttaaacgtttacgtttaagtcgtaaccgtttcgtaccttacgtacgtaacgtcggttacgttaacgggtttaaccttaacgtagttttaacgtccggtttacgtttacggggttaaggtcgggtaacccggttacggtaacccgtttacccgtacgttaccgtaccgaccggtaacccgtaaccggaccccctaacttacccgg

SEQ ID NO: 184950 - DNA, 660 bp, Homo sapiens
  misc_feature: GYAE6OF02HVLJE.43.34.D01.1.454.CMB.1.raw
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctccgtggacagtcatcaaccatctcctgccactcggaaccagcaggtgagtggttgggaagttatacgtctttgtctcgtagtaaccaagtcgaccaacccgaggaccaaaaccgacccccctaaaatctaacttagtaattttagtacggacgggacctaacgtaaacggccggtacccgttacggttacgggggttttcaggtactcgttcctttctcgtcggctaccgtaagtcgtgaccaacgccgtcctcctagactactcgtcgtcggacctcgacggcgtaggacggacgacgtcgttagtaatttagttattggactcgtaccgtatactacgtcgtacgtaagggttacttaacacgtttacgtcgttaccggttaggtacggttcgggaaccgttacggtcctaaccggttccgtacggttaccaaccggtaccccggaaacgtcccccgtaacctaacg

SEQ ID NO: 184951 - DNA, 784 bp, Homo sapiens
  misc_feature: GYAE6OF02G8XZ6.43.34.D01.1.454.CMB.1.raw
tcagtgtgagtagtcacgaccggtgctcgatttagatcgtctgtgttgggtttggggggggtcacaagaggcagcgctctcgggacgtctccaccatggcctgggctctgctgctcctcactctcctcgctcaggacacgagggtcctgggcccagtctcgccctgactcagcctgcctcgtgtctggtctctaggacagtcgatcactatctctgcacgtcggaacagcagtgtagttggttaggattatacgtcttcgtctcgtagtacagtcaccaccgagactaaaccgcccctaaatcatacgtattacgaggacgtcaacgtacgccgtaccgtggtacgggttcagtaccgtcgtctttcgtcgtcgtcctaactacgtcgtacggaacctaaccggcccggtccctaccgtagtaacctaaccgttcgtaccggtcggtaccgtaccgacgggtacgtacgggaaccgggtaccggtagttacgttaagttaacgttttaagttcgttaccgtcgttaccgttacgttaacccgtagtttaaccggttccgtaacggttaaaacggggtttttaacccgtttaaaccgtttacgtttaaccgttttccgggtttaaccggtttttaacggggtttaaaccggttaacggggggttaacccggttaaacccggtttccccggttaaacccccggtttacgggtaaaccgttaccccggaaaacccggttaacccccgggtaaaacccccgttaccccgtaaaaccccggtttcccgg

SEQ ID NO: 184952 - DNA, 624 bp, Homo sapiens
  misc_feature: GYAE6OF02JBT8E.43.34.D01.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (229)..(229): a, c, t, g, unknown or other
  misc_feature (229)..(229): n is a, c, g, or t
  modified_base (333)..(333): a, c, t, g, unknown or other
  misc_feature (333)..(333): n is a, c, g, or t
  modified_base (375)..(375): a, c, t, g, unknown or other
  misc_feature (375)..(375): n is a, c, g, or t
  modified_base (489)..(489): a, c, t, g, unknown or other
  misc_feature (489)..(489): n is a, c, g, or t
  modified_base (501)..(501): a, c, t, g, unknown or other
  misc_feature (501)..(501): n is a, c, g, or t
  modified_base (518)..(518): a, c, t, g, unknown or other
  misc_feature (518)..(518): n is a, c, g, or t
tcagtgtgagtagtcacgaccggtgctcgatttagatcgtctgtgttggggtttgggggggtcacaagaggcagcgctctcgggacgtctccaccatggcctgggctctgctgctcctcactctcctcgctcaggacacgagggtcctgggcccagtctgccctgactcacgcctggcctcgtgtctcggtctccgtggacngtcgatcacntcnctgcactggaaccngcgagtgatggttcggaagttatacgtccttcgtctccgtggtaccaagtcgccgaaccgtagggaccaaaaccgtcccccaaactctagttcgtaattttagngggacggtctaacgtaacgccggtacctggttacgggtttcnggtactcgtcttcgtaccgtggcctacgaggtctcgtacaaccggtccgcccttcgacgaactacgttcgcgtacgggtcctacggtcggcgtaaggcgaacgtggtctagttnttagttacgtcncttcgcttaacattcgngacgttaacgttacgttacttattacgtgttacgttacggtagttacgggaccgtcggttccaccggttacgtcgtagacccgtaccgacgtaccccgacgtaccg

SEQ ID NO: 184953 - DNA, 321 bp, Homo sapiens
  misc_feature: GYAE6OF02IH70K.43.34.D01.1.454.CMB.1.raw
  modified_base (109)..(109): a, c, t, g, unknown or other
  misc_feature (109)..(109): n is a, c, g, or t
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
  modified_base (297)..(321): a, c, t, g, unknown or other
  misc_feature (297)..(321): n is a, c, g, or t
tcagtgtgagtagtcacgaccggtgctcgatttagatcgtctgtgttgggtttgggtcaggggtttctgatcgcttctctggctccaagtctggcaacacggcctcccngacaatctctgggctccaggctgaggacgaggctgattattattgctgctcatatgcaggtagttacacttatgtcttacggattgggacgacggtcaccgtctagcagccaacggccaaccccatgtacactctcgtacccacctcctcactactcacactgacgcgggacnggacaggcncatagnnnnnnnnnnnnnnnnnnnnnnnnn

SEQ ID NO: 184954 - DNA, 824 bp, Homo sapiens
  misc_feature: GYAE6OF02I8X7D.43.34.D01.1.454.CMB.1.raw
  modified_base (281)..(281): a, c, t, g, unknown or other
  misc_feature (281)..(281): n is a, c, g, or t
  modified_base (363)..(363): a, c, t, g, unknown or other
  misc_feature (363)..(363): n is a, c, g, or t
  modified_base (811)..(811): a, c, t, g, unknown or other
  misc_feature (811)..(811): n is a, c, g, or t
tcagtgtgagtagtcacgaccggtgctcgatttagatcgtctgtgttggggtttgggggggggtcacaagaggcagcgctctcgggacgtctccaccatggcctgggctctgctgctcctcactctcctcgctcaggacacgagggtcctcgggcccagtctcgccctagactcacgcctcgcctcgtgtcgtgggtctccgtgactacgtcgaactccacctatcctcctcgccacgtacggaaccagcagtcgtagtggttcggagttatacgtccttntccgttaccgtcggtaacagtccgaccaaccggacggaaccaaaaccccgtacccctaaacgtctacgttgtaagtttacgnggggaaccgacctaaccggaaccggtccccgggtaccgttaccgggttacggggtttctacggtaccttccggtttccctacggtcccggtttacggtcccttaacccggtaacgtccgtaccggtaaaccgaacccgttacccggcccctttaccggaacgtaaccgttaccgttccgttacggttcccggacccgtacggtagtccgtaggggaccggaacgtcggttacgtttagttaacgtttacgttagttcgaccgttacggtcttaaccgtcgtttaagtacggtacggttaaagtttaaccttacgttaacgtttacgtaccggtttacggtaagggtttaaccgggttaccgggtaaccgggttaccggtaccggttacccggtttaccggttacgggttaccgacccgggttaacccccgaaccccgggttaaccccncccgggtttaacc

SEQ ID NO: 184955 - DNA, 709 bp, Homo sapiens
  misc_feature: GYAE6OF02J03XP.43.34.D01.1.454.CMB.1.raw
  modified_base (153)..(153): a, c, t, g, unknown or other
  misc_feature (153)..(153): n is a, c, g, or t
  modified_base (196)..(196): a, c, t, g, unknown or other
  misc_feature (196)..(196): n is a, c, g, or t
  modified_base (226)..(226): a, c, t, g, unknown or other
  misc_feature (226)..(226): n is a, c, g, or t
  modified_base (242)..(242): a, c, t, g, unknown or other
  misc_feature (242)..(242): n is a, c, g, or t
  modified_base (270)..(270): a, c, t, g, unknown or other
  misc_feature (270)..(270): n is a, c, g, or t
tcagtgtgagtagtcacgaccggtgctcgatttagatcgtctgtgttgggctggggtcacaagaggcagcgctctcgggactctccacatggcctgggctctgctgctcctcactctcctcgctcgaggacacgagggtcctgggcccagtcncgaccctgactcagcctgcctccgtgtcgtggtctccgtgacngtcgactcaccatctcctgcacgtgaaccngctagtgatgtaggtntatcgtcttcgtctcgtcggtacacgtnactaccgagacctaaccgacccctaatccgtatactagtttagcggacgctacgtacggccgtccctaggttacgggttcacgttacgtcgttccgttactcgtacggtccttacgtaacgtcgtaaccgactaaaccgtccggtcccttaccgtcgaactactttccgcggtacggtcctaccggagtacccgtaggaacggtacgtacgtcttaggtttacttaacgttggttaccgacttcgtaccgtagtaagttcgtacgtaaaccgttacggtttaaacttaccggttaaactttcgttacccgttaggtttaaccggggtaacggttttaccccggggaaccggttaacccgtttaccgggtaaccccgtttacggtaccgggttaaccccggaacggtaaacccccggtacccggtaaccccctaacccgg

SEQ ID NO: 184956 - DNA, 782 bp, Homo sapiens
  misc_feature: GYAE6OF02HVAUG.43.34.D01.1.454.CMB.1.raw
  modified_base (173)..(173): a, c, t, g, unknown or other
  misc_feature (173)..(173): n is a, c, g, or t
  modified_base (220)..(220): a, c, t, g, unknown or other
  misc_feature (220)..(220): n is a, c, g, or t
tcagtgtgagtagtcacgaccggtgctcgatttagatcgtctgtgttggggtttggggggggtcacaagaggcagcgctctcgggacgtctccaccatggcctgggctctgctgctcctcactctcctcgactcaggacacgagggtcctgggccagtctcgccctgactcancctgcctcgtgtcgtgggtcctctggacagtcgatcacctatcctcncgacactacgggaaccagcgagtgtacgttggttgggtaacttagtaccgttcctttcgtaccttccgttacgggtacctaacgtcgccgaacccgaggaaccctaaaccgacccccctaaatcacgttagttactttacgagggacgggactaaaccggtcggcccggttacccttacggggttacgggtttctacggtacttccggttactttccggtggtccggtaccttacggtaacggttccgtacggtacccgtaaacccgtcccggttaccccttacgtaacgtaaccttacgtttcccggttccggtaccgggtccgttaaccgaggggttacgtaagggacgggtaccgtacgggttactttagttacggttttaactcgttacgtccgttcgtaagtaccgtattacgtccggtaattacgggttaaccttaaacgttcgttagttacgtttacggttacgggttacccgtggggtaacccggttacctaccgggtaaccgttcggtaacggtccgtaacccggacccggtaacgtacccctacccgttacg

SEQ ID NO: 184957 - DNA, 753 bp, Homo sapiens
  misc_feature: GYAE6OF02GOA23.43.34.D01.1.454.CMB.1.raw
  modified_base (228)..(228): a, c, t, g, unknown or other
  misc_feature (228)..(228): n is a, c, g, or t
  modified_base (269)..(269): a, c, t, g, unknown or other
  misc_feature (269)..(269): n is a, c, g, or t
  modified_base (318)..(318): a, c, t, g, unknown or other
  misc_feature (318)..(318): n is a, c, g, or t
  modified_base (324)..(324): a, c, t, g, unknown or other
  misc_feature (324)..(324): n is a, c, g, or t
tcagtgtgagtagtcacgaccggtgctcgatttagatcgtctgtgttggggtttggggggggtcacaagaggcagcgctctcgggacgtctccaccatggcctgggctctgctgctcctcactctcctcgctcaggacacgacgggtcctcgggcccagtcctcgccctgactcacgcctcgcctcgtgtcgtcggtctcgtcggacagtacgatccaacactcctcncgactaacgtacggaaccacgcagtgtagtggtaggattanagtcctgtctccgtagtaccagctaccaccgagacaaaccgaccctaanctaatntaagttagcggaagtcaacgtacggccgttaccgtacggtaggtttcaggtccgtacctcgttcgtcggtacgtaccctaacgtaggttcctacggtacccaaacggtcccgtcccgtacccgttagaacttacgtccgtcgtcgggtacctaccgagggtactaacgggaaacggtaccggtaagtacgttaaaggtttaaactttcgggtacttacggaccgtttcgtaacctacgttaacggtaacttcggggaactttaaacgggttacctttaaaccgttcgttttaacggttccgtttaacccgggttaaggtaaccgggtttaacggggaaccgttaaccggggtaacccctaacggggtttaacctacccgggtaacgtaaccccggtaccaaacccggtaacccctaaccggttaacccg

SEQ ID NO: 184958 - DNA, 622 bp, Homo sapiens
  misc_feature: GYAE6OF02F9L3K.43.34.D01.1.454.CMB.1.raw
  modified_base (213)..(213): a, c, t, g, unknown or other
  misc_feature (213)..(213): n is a, c, g, or t
  modified_base (315)..(315): a, c, t, g, unknown or other
  misc_feature (315)..(315): n is a, c, g, or t
  modified_base (350)..(350): a, c, t, g, unknown or other
  misc_feature (350)..(350): n is a, c, g, or t
  modified_base (353)..(353): a, c, t, g, unknown or other
  misc_feature (353)..(353): n is a, c, g, or t
  modified_base (376)..(376): a, c, t, g, unknown or other
  misc_feature (376)..(376): n is a, c, g, or t
tcagtgtgagtagtcacgaccggtgctcgatttagatcgtctgtgttgggctggggtcacaagaggcagcgctctcgggacgtctccaccatggcctgggctctgctgctcctcactctcctcgctcaggacacagggtcctgggcccagtctgcccttgactcagcctgcctccgtgtctgggtctcctggactagtcgatcaccatctccngcacgtaggaaccagcagtgatggttagggattatacgtcttcgtctcctacggtacagtgaccaccgaggacaaaccgacccccaaatcattgtaattagnggacggctaacgtacggccgtacctggtaggttcngtntcgtctctgtcgctacgtagtcncggacaccgaccggtcctactagtaccccccctagtcgtcgtcggtccgtaccgtacggtcgtacgggacggtaccggacggtacgttacgttaactttagttacgttcgtctacgtacttactacgttagtacgtacgtaacgttaacgttaacttacgttagttacgttacgtacggtacggtacggtacgtaccgtacgtaccgtacgtacgaccgtaccgaacccgtaccgaccctaacccg

SEQ ID NO: 184959 - DNA, 748 bp, Homo sapiens
  misc_feature: GYAE6OF02JVE3N.43.34.D01.1.454.CMB.1.raw
  modified_base (182)..(182): a, c, t, g, unknown or other
  misc_feature (182)..(182): n is a, c, g, or t
tcagtgtgagtagtcacgaccggtgctcgatttagatcgtctgtgttgggtttgggggggtcacaagaggtcagcgctctcgggacgtctccaccatggcctggctctgctgctcctcgactcctcctcgctcaaggctacgtcgggtcctgggccctaggtctcgaccctgactcagtccngtcctcgtgtcgtgggtcctccgtaggaactgtacgtactaccgactctcgtccctgacctagtacggaacctgcgtaagttgacgttgggtgtacgtactacgtccttgtccgtacgtcggtacctagtcgaccgtaccgaggaccaaccggaccccaaagtacgtacgtacgtaagttacgtacggaacgtacctaacggtaaccggccggttacccgtaggttacgggttactacggtaccgttcgtcccgttaacgttccgtccggtaacccgtaccggttataccgtcgacggtaacccgtccgtacctcgttacgccgttaacgtccgttcgtaccgggtctacgtaggtaccgtaggaaaccgtcgtaaacgttcgtattaacggtttaccttggtcgtaccgttctaccggttaactcggttactaccggtaacgtttacggttacttaccgtaacgttcgtttcggtacgttacggttacgtacggtccggttaaaccggcctttaaccggtcgtaccggtaccgacccgtaaccggtcctaacccggtacctacgg

SEQ ID NO: 184960 - DNA, 298 bp, Homo sapiens
  misc_feature: GYAE6OF01AIVLA.15.50.E06.1.454.CMB.1.raw
  modified_base (295)..(298): a, c, t, g, unknown or other
  misc_feature (295)..(298): n is a, c, g, or t
tcagtctacgtagccacgaccggtgctcgatttagatctactgacaacacacaaggggacgggatccctgatcgcttctcaggctccagttctggggctgagcgcaccctcgtcatctccagcctccagtctgaggatgagggtgactattattgtcagacgtggggcagtggcgttcaggcattcggcggagggaccaagctgactgtcctcggtcagcccaaggctgccccctggtcactctgttcccgccctcctcgctacgtagactgagcgggctggcaaggcgcatagnnnn

SEQ ID NO: 184961 - DNA, 302 bp, Homo sapiens
  misc_feature: GYAE6OF01BC1UM.15.50.E06.1.454.CMB.1.raw
  modified_base (296)..(302): a, c, t, g, unknown or other
  misc_feature (296)..(302): n is a, c, g, or t
tcagtctacgtagccacgaccggtgctcgatttagatctactgacaacacacaagggggacgggatccctgatcgcttctcaggctccagttctggggctgagcgcaccctcgtcatctccagcctccagtctgaggatgagggtgactattattgtcagacgtggggcagtggcgttcaggcattcggcggagggaccaagctgactgtcctcggtcagcccaaggctgccccctcggtcactctgttcccgcctcctcgctacgtagactgagcgggctggcaaggcgcatagnnnnnnn

SEQ ID NO: 184962 - DNA, 299 bp, Homo sapiens
  misc_feature: GYAE6OF01A9HY1.15.50.E06.1.454.CMB.1.raw
  modified_base (294)..(299): a, c, t, g, unknown or other
  misc_feature (294)..(299): n is a, c, g, or t
tcagtctacgtagccacgaccggtgctcgatttagatctactgacaacacacaaggggacgggatccctgatcgcttctcaggctccagttctggggctgagcgcaccctcgtcatctccagcctccagtctgaggatgagggtgactattattgtcagacgtggggcagtggcgttcaggcattcggcggagggaccaagctgactgtcctcggtcagcccaaggctgccccctggtcactctgttcccaccctcctcgctacgtagactgagcggctggcaaggcgcatagnnnnnn

SEQ ID NO: 184963 - DNA, 295 bp, Homo sapiens
  misc_feature: GYAE6OF01B3YNP.15.50.E06.1.454.CMB.1.raw
  modified_base (290)..(295): a, c, t, g, unknown or other
  misc_feature (290)..(295): n is a, c, g, or t
tcagtctacgtagccacgaccggtgctcgatttagatctactgacaacacacaaggggacgggatccctgatcgcttctcaggctccagttctgggctgagcgcaccctcgtcatctccagcctccagtctgaggatgaggtgactattattgtcagacgtggggcagtggcgttcaggcattcggcggagggaccaagctgactgtcctcggtcagcccaaggctgcccctggtcactctgttcccacctcctcgctacgtagactgagcggctggcaaggcgcatagnnnnnn

SEQ ID NO: 184964 - DNA, 177 bp, Homo sapiens
  misc_feature: GYAE6OF01CUHRL.15.50.E06.1.454.CMB.1.raw
  modified_base (177)..(177): a, c, t, g, unknown or other
  misc_feature (177)..(177): n is a, c, g, or t
tcagtctacgtagccacgaccggtgctcgatttagatctactgacaacacacaagggcccatcggtcttcccctggcaccctcctccaagagcacctctggggcacagcggccctgggctgcctggtcaaggactacttccgctacgtagactgagcgggctggcaaggcgcatagn

SEQ ID NO: 184965 - DNA, 299 bp, Homo sapiens
  misc_feature: GYAE6OF01BVHIY.15.50.E06.1.454.CMB.1.raw
  modified_base (296)..(299): a, c, t, g, unknown or other
  misc_feature (296)..(299): n is a, c, g, or t
tcagtctacgtagccacgaccggtgctcgatttagatctactgacaacacacaagggggacgggatccctgatcgcttctcaggctccagttctggggctgagcgcaccctcgtcatctccagcctccagtctgaggatgagggtgactattattgtcagacgtggggcagtggcgttcaggcattcggcggagggaccaagctgactgtcctcggtcagcccaaggctgccccctcggtcactctgttcccgcctcctcgctacgtagactgagcgggctggcaaggcgcatagnnnn

SEQ ID NO: 184966 - DNA, 302 bp, Homo sapiens
  misc_feature: GYAE6OF01DC0GH.15.50.E06.1.454.CMB.1.raw
  modified_base (298)..(302): a, c, t, g, unknown or other
  misc_feature (298)..(302): n is a, c, g, or t
tcagtctacgtagccacgaccggtgctcgatttagatctactgacaacacacaagggggacgggatccctgatcgcttctcaggctccagttctggggctgagcgcaccctcgtcatctccagcctccagtctgaggatgagggtgactattattgtcagacgtggggcagtggcgttcaggcattcggcggagggaccaagctgactgtcctcggtcagcccaaggctgccccctcggtcactcctgttccccgccctcctcgctacgtagactgagcgggctggcaggcgcatagnnnnn

SEQ ID NO: 184967 - DNA, 306 bp, Homo sapiens
  misc_feature: GYAE6OF01BWLHF.15.50.E06.1.454.CMB.1.raw
  modified_base (299)..(306): a, c, t, g, unknown or other
  misc_feature (299)..(306): n is a, c, g, or t
tcagtctacgtagccacgaccggtgctcgatttagatctactgacaacacacaagggggacgggatccctgatcgcttctcaggctccagttctggggctgagcgcaccctcgtcatctccagcctccagtctgaggatgagggtgactattattgtcagacgtggggcagtggcgttcaggcattcggcggagggaccaagctgactgtcctcggtcagcccaaggctcgccccctcggtcactctcgttcccaccctcctcgctacgtagactgacgcggctggcaaggcgcatagnnnnnnnn

SEQ ID NO: 184968 - DNA, 302 bp, Homo sapiens
  misc_feature: GYAE6OF01EVCYQ.15.50.E06.1.454.CMB.1.raw
  modified_base (297)..(302): a, c, t, g, unknown or other
  misc_feature (297)..(302): n is a, c, g, or t
tcagtctacgtagccacgaccggtgctcgatttagatctactgacaacacacaagggggacgggatccctgatcgcttctcaggctccagttctggggctgagcgcaccctcgtcatctccagcctccagtctgaggatgagggtgactattattgtcagacgtggggcagtggcgttcaggcattcggcggagggaccaagctgactgtcctcggtcagcccaaggctgccccctcggtcactctgttcccaccctcctcgctacgtagactgagcgggctggcaaggcgcatagnnnnnn

SEQ ID NO: 184969 - DNA, 302 bp, Homo sapiens
  misc_feature: GYAE6OF01DEO1A.15.50.E06.1.454.CMB.1.raw
  modified_base (297)..(302): a, c, t, g, unknown or other
  misc_feature (297)..(302): n is a, c, g, or t
tcagtctacgtagccacgaccggtgctcgatttagatctactgacaacacacaagggggacgggatccctgatcgcttctcaggctccagttctggggctgagcgcaccctcgtcatctccagcctccagtctgaggatgagggtgactattattgtcagacgtggggcagtggcgttcaggcattcggcggagggaccaagctgactgtcctcggtcagcccaaggctgccccctggtccactctgttcccaccctcctcgctacgtagactgagcgggctggcaaggcgcatagnnnnnn

SEQ ID NO: 184970 - DNA, 302 bp, Homo sapiens
  misc_feature: GYAE6OF01DSUPZ.15.50.E06.1.454.CMB.1.raw
  modified_base (297)..(302): a, c, t, g, unknown or other
  misc_feature (297)..(302): n is a, c, g, or t
tcagtctacgtagccacgaccggtgctcgatttagatctactgacaacacacaagggggacgggatccctgatcgcttctcaggctccagttctggggctgagcgcaccctcgtcatctccagcctccagtctgaggatgagggtgactattattgtcagacgtggggcagtggcgttcaggcattcggcggagggaccaagctgactgtcctcggtcagcccaaggcctgccccctcggtcactctgttcccacctcctcgctacgtagactgagcgggctggcaaggcgcatagnnnnnn

SEQ ID NO: 184971 - DNA, 298 bp, Homo sapiens
  misc_feature: GYAE6OF01BPYIU.15.50.E06.1.454.CMB.1.raw
  modified_base (293)..(298): a, c, t, g, unknown or other
  misc_feature (293)..(298): n is a, c, g, or t
tcagtctacgtagccacgaccggtgctcgatttagatctactgacaacacacaagggggacgggatccctgatcgcttctcaggctccagttctggggctgagcgcaccctcgtcatctccagcctccagtctgaggatgaggtgactattattgtcagacgtgggcagtggcgttcaggcattcggcggagggaccaagctgactgtcctcggtcagcccaaggctgccccctggtcactctgttcccgcctcctcgctacgtagacctgagcggctggcaaggcgcatagnnnnnn

SEQ ID NO: 184972 - DNA, 297 bp, Homo sapiens
  misc_feature: GYAE6OF01ET2CP.15.50.E06.1.454.CMB.1.raw
  modified_base (294)..(297): a, c, t, g, unknown or other
  misc_feature (294)..(297): n is a, c, g, or t
tcagtctacgtagccacgaccggtgctcgatttagatctactgacaacacacaagggggacgggatccctgatcgcttctcaggctccagttctggggctgagcgcaccctcgtcatctccagcctccagtctgaggatgagggtgactattattgtcagacgtggggcagtggcgttcaggcattcggcggagggaccaagctgactgtcctcggtcagcccaaggctgccccctggtcactctgttcccaccctctcgctacgtagactgagcggctggcaaggcgcatagnnnn

SEQ ID NO: 184973 - DNA, 298 bp, Homo sapiens
  misc_feature: GYAE6OF01DVG9V.15.50.E06.1.454.CMB.1.raw
  modified_base (296)..(298): a, c, t, g, unknown or other
  misc_feature (296)..(298): n is a, c, g, or t
tcagtctacgtagccacgaccggtgctcgatttagatctactgacaacacacaagggggacgggatccctgatcgcttctcaggctccagttctggggctgagcgcaccctcgtcatctccagcctccagtctgaggatgagggtgactattattgtcagacgtggggcagtggcgttcaggcattcggcggagggaccaagctgactgtcctcggtcagcccaaggcctgccccctcggtcactctgttcccacctcctcgctacgtagactgagcggctggcaaggcgcatagnnn

SEQ ID NO: 184974 - DNA, 304 bp, Homo sapiens
  misc_feature: GYAE6OF01B45K2.15.50.E06.1.454.CMB.1.raw
  modified_base (268)..(268): a, c, t, g, unknown or other
  misc_feature (268)..(268): n is a, c, g, or t
  modified_base (294)..(304): a, c, t, g, unknown or other
  misc_feature (294)..(304): n is a, c, g, or t
tcagtctacgtagccacgaccggtgctcgatttagatctactgacaacacacaagggggacgggatccctgatcgcttctcaggctccagttctggggctgagcgcaccctcgtcatctccagcctccagtctgaggatgagggtgactattattgtcagacgtggggcagtggcgttcaggcattcggcggagggaccaagctgactgtcctcggtcagcccaagctcgcccctcggtcactctcgtcccgcctcctcgctacgtanactgagcggctggcaaggcgcatagnnnnnnnnnnn

SEQ ID NO: 184975 - DNA, 400 bp, Homo sapiens
  misc_feature: GYAE6OF01CQFX0.15.50.E06.1.454.CMB.1.raw
  modified_base (147)..(147): a, c, t, g, unknown or other
  misc_feature (147)..(147): n is a, c, g, or t
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (299)..(299): a, c, t, g, unknown or other
  misc_feature (299)..(299): n is a, c, g, or t
  modified_base (314)..(314): a, c, t, g, unknown or other
  misc_feature (314)..(314): n is a, c, g, or t
  modified_base (326)..(327): a, c, t, g, unknown or other
  misc_feature (326)..(327): n is a, c, g, or t
  modified_base (331)..(400): a, c, t, g, unknown or other
  misc_feature (331)..(400): n is a, c, g, or t
tcagtctacgtagccacgaccggtgctcgatttagatctactgacaacacacaaggggggacgggatccctgatcgcttctcaggctccagttctggggctgagcgcaccctgtcatctccagcctccagtctgaggatggagggtnacttattattgcaggacggtggggcagtggcgttcgaggctagttcggnggaaaaacggtcaagctgactgtccncggtcacgcccgaaggcctccgccccgtggtcacgtctcgttccccacctctcggactacgagacctgacgcggtcnggacaaggctacganagcagcagtacnntacnnnnnnnnnnnnnnnnnnnnnnnnnnnnnnnnnnnnnnnnnnnnnnnnnnnnnnnnnnnnnnnnnnnnnn

SEQ ID NO: 184976 - DNA, 306 bp, Homo sapiens
  misc_feature: GYAE6OF01CNORM.15.50.E06.1.454.CMB.1.raw
  modified_base (298)..(306): a, c, t, g, unknown or other
  misc_feature (298)..(306): n is a, c, g, or t
tcagtctacgtagccacgaccggtgctcgatttagatctactgacaacacacaagggggacgggatccctgatcgcttctcaggctccagttctggggctgagcgcaccctcgtcatctccagcctccagtctgaggatgagggtgactattattgtcagacgtggggcagtggcgttcaggcagttcggcggagggaccaagctgactgtcctcggtcagcccaaggctcgccccctggtcactctcgttcccacctcctcgctacgtagactgagcgggctggcaaggcgcatagnnnnnnnnn

SEQ ID NO: 184977 - DNA, 354 bp, Homo sapiens
  misc_feature: GYAE6OF01DUUIZ.15.50.E06.1.454.CMB.1.raw
  modified_base (274)..(274): a, c, t, g, unknown or other
  misc_feature (274)..(274): n is a, c, g, or t
  modified_base (323)..(354): a, c, t, g, unknown or other
  misc_feature (323)..(354): n is a, c, g, or t
tcagtctacgtagccacgaccggtgctcgatttagatctactgacaacacacaaggggggacgggatccctgatcgcttctcaggctccagttctggggctgagcgcaccctcgtcatctccagcctccagtctgaggatggaggtgtacttattattgtcaggacggtggggcaggtggtcgttcgaggctagttcgggcgggacgggaaccaaggctgtactgtcctcggtcacgaccgaggcctcgcccccgtcggtcactctcgtacccncctcctcgctacgtagactgcggcggcgaggcgaacggcgacagtaggnnnnnnnnnnnnnnnnnnnnnnnnnnnnnnnn

SEQ ID NO: 184978 - DNA, 338 bp, Homo sapiens
  misc_feature: GYAE6OF01EDKDA.15.50.E06.1.454.CMB.1.raw
  modified_base (249)..(249): a, c, t, g, unknown or other
  misc_feature (249)..(249): n is a, c, g, or t
  modified_base (316)..(338): a, c, t, g, unknown or other
  misc_feature (316)..(338): n is a, c, g, or t
tcagtctacgtagccacgaccggtgctcgatttagatctactgacaacacacaaggggggacgggatccctgatcgcttctcaggctccagttctggggctgagcgcaccctcgtcatttccagcctccagtctgaggatggagggtgactattattgtcagacggtggggcagtggcgttcaggcagttcggcggaggggaccaagctgactgtccgtcggtcagcccaaggcctcgccccctcgtcnctctcgttccccgccctctccgctacgtacgactggacggcggcgtggacgaacggcgacaagtagnnnnnnnnnnnnnnnnnnnnnnn

SEQ ID NO: 184979 - DNA, 298 bp, Homo sapiens
  misc_feature: GYAE6OF02G8U8D.15.50.E06.1.454.CMB.1.raw
  modified_base (294)..(298): a, c, t, g, unknown or other
  misc_feature (294)..(298): n is a, c, g, or t
tcagtctacgtagccacgaccggtgctcgatttagatctactgacaacacacaaggggacgggatccctgatcgcttctcaggctccagttctgggctgagcgcaccctcgtcatctccagcctccagtctgaggatgagggtgactattattgtcagacgtggggcagtggcgttcaggcattcggcggagggaccaagctgactgtcctcggtcagcccaaggctgcccctcggtcactctgttcccaccctcctcgctacgtagactgagcgggctggcaaggcgcatagnnnnn

SEQ ID NO: 184980 - DNA, 300 bp, Homo sapiens
  misc_feature: GYAE6OF02GIN6L.15.50.E06.1.454.CMB.1.raw
  modified_base (294)..(300): a, c, t, g, unknown or other
  misc_feature (294)..(300): n is a, c, g, or t
tcagtctacgtagccacgaccggtgctcgatttagatctactgacaacacacaaggggacgggatccctgatcgcttctcaggctccagttctgggctgagcgcaccctcgtcatctccagcctccagtctgaggatgagggtgactattattgtcagacgtggggcagtggcgttcaggcattcggcggagggaccaagctgactgtcctcggtcagcccaaggctgccccctcggtcactctgttcccgcctcctcgctacgtagactgagcgggctggcaaggcgcatagnnnnnnn

SEQ ID NO: 184981 - DNA, 302 bp, Homo sapiens
  misc_feature: GYAE6OF02IRIC0.15.50.E06.1.454.CMB.1.raw
  modified_base (297)..(302): a, c, t, g, unknown or other
  misc_feature (297)..(302): n is a, c, g, or t
tcagtctacgtagccacgaccggtgctcgatttagatctactgacaacacacaagggggacgggatccctgatcgcttctcaggctccagttctggggctgagcgcaccctcgtcatctccagcctccagtctgaggatgagggtgactattattgtcagacgtgggcagtggcgttcaggcattcggcggagggaccaagctgactgtcctcggtcagcccaaggctgccccctcggtcactctgttccccaccctcctcgctacgtagactgagcgggctggcaaggcgcatagnnnnnn

SEQ ID NO: 184982 - DNA, 306 bp, Homo sapiens
  misc_feature: GYAE6OF02IE22K.15.50.E06.1.454.CMB.1.raw
  modified_base (294)..(306): a, c, t, g, unknown or other
  misc_feature (294)..(306): n is a, c, g, or t
tcagtctacgtagccacgaccggtgctcgatttagatctactgacaacacacaaggggacgggatccctgatcgcttctcaggctccagttctggggctgagcgcaccctcgtcatctccagcctccagtctgaggatgagggtgactattattgtcagacgtggggcagtggcgttcaggcattcggcggagggaccaagctgactgtcctcggtcagcccaaggctgccccctggtcactctgttcccgcctcctcgctacgtagactgagcgggctggcaaggcgcatagnnnnnnnnnnnnn

SEQ ID NO: 184983 - DNA, 299 bp, Homo sapiens
  misc_feature: GYAE6OF02IG9BT.15.50.E06.1.454.CMB.1.raw
  modified_base (295)..(299): a, c, t, g, unknown or other
  misc_feature (295)..(299): n is a, c, g, or t
tcagtctacgtagccacgaccggtgctcgatttagatctactgacaacacacaaggggacgggatccctgatcgcttctcaggctccagttctggggctgagcgcaccctcgtcatctccagcctccagtctgaggatgagggtgactattattgtcagacgtggggcagtggcgttcaggcattcggcggagggaccaagctgactgtcctcggtcagcccaaggctgccccctggtcactctgttcccaccctcctcgctacgtagactgagcgggctggcaaggcgcatagnnnnn

SEQ ID NO: 184984 - DNA, 298 bp, Homo sapiens
  misc_feature: GYAE6OF02G46PG.15.50.E06.1.454.CMB.1.raw
  modified_base (294)..(298): a, c, t, g, unknown or other
  misc_feature (294)..(298): n is a, c, g, or t
tcagtctacgtagccacgaccggtgctcgatttagatctactgacaacacacaaggggacgggatccctgatcgcttctcaggctccagttctggggctgagcgcaccctcgtcatctccagcctccagtctgaggatgagggtgactattattgtcagacgtggggcagtggcgttcaggcattcggcggagggaccaagctgactgtcctcggtcagcccaaggctgccccctcggtcactctgttcccacctcctcgctacgtagactgagcggctggcaaggcgcatagnnnnn

SEQ ID NO: 184985 - DNA, 302 bp, Homo sapiens
  misc_feature: GYAE6OF02FLI2H.15.50.E06.1.454.CMB.1.raw
  modified_base (298)..(302): a, c, t, g, unknown or other
  misc_feature (298)..(302): n is a, c, g, or t
tcagtctacgtagccacgaccggtgctcgatttagatctactgacaacacacaagggggacgggatccctgatcgcttctcaggctccagttctggggctgagcgcaccctcgtcatctccagcctccagtctgaggatgagggtgactattattgtcagacgtggggcagtggcgttcaggcattcggcggagggaccaagctgactgtcctcggtcagcccaaggctgccccctcggtcactctgttccccgccctcctcgctacgtagactgagcgggctggcaaggcgcatagnnnnn

SEQ ID NO: 184986 - DNA, 298 bp, Homo sapiens
  misc_feature: GYAE6OF02FLA5V.15.50.E06.1.454.CMB.1.raw
  modified_base (297)..(298): a, c, t, g, unknown or other
  misc_feature (297)..(298): n is a, c, g, or t
tcagtctacgtagccacgaccggtgctcgatttagatctactgacaacacacaagggggacgggatccctgatcgcttctcaggctccagttctggggctgagcgcaccctcgtcatctccagcctccagtctgaggatgagggtgactattattgtcagacgtggggcagtggcgttcaggcattcggcggagggaccaagctgactgtcctcggtcagcccaaggctgccccctcggtcactctgttcccaccctcctcgctacgtagactgagcgggctggcaaggcgcatagnn

SEQ ID NO: 184987 - DNA, 305 bp, Homo sapiens
  misc_feature: GYAE6OF02IBXAS.15.50.E06.1.454.CMB.1.raw
  modified_base (295)..(305): a, c, t, g, unknown or other
  misc_feature (295)..(305): n is a, c, g, or t
tcagtctacgtagccacgaccggtgctcgatttagatctactgacaacacacaaggggacgggatccctgatcgcttctcaggctccagttctggggctgagcgcaccctcgtcatctccagcctccagtctgaggatgagggtgactattattgtcagacgtgggcagtggcgttcaggcattcggcggagggaccaagctgactgtcctcggtcagcccaaggctgccccctggtcactctcgttcccgccctcctcgctacgtagactgagcgggctggcaaggcgcatagnnnnnnnnnnn

SEQ ID NO: 184988 - DNA, 189 bp, Homo sapiens
  misc_feature: GYAE6OF02I345W.15.50.E06.1.454.CMB.1.raw
  modified_base (178)..(189): a, c, t, g, unknown or other
  misc_feature (178)..(189): n is a, c, g, or t
tcagtctacgtagccacgaccggtgctcgatttagatctactgacaacacacaagggcccatcggtcttccccctggcaccctcctccaagagcacctctgggggcacagcggccctgggctgcctggtcaaggctacttccgctacgtagactgagcgggctggcaaggcgcatagnnnnnnnnnnnn

SEQ ID NO: 184989 - DNA, 401 bp, Homo sapiens
  misc_feature: GYAE6OF02F6XWP.15.50.E06.1.454.CMB.1.raw
  modified_base (309)..(310): a, c, t, g, unknown or other
  misc_feature (309)..(310): n is a, c, g, or t
  modified_base (312)..(317): a, c, t, g, unknown or other
  misc_feature (312)..(317): n is a, c, g, or t
  modified_base (320)..(320): a, c, t, g, unknown or other
  misc_feature (320)..(320): n is a, c, g, or t
  modified_base (323)..(324): a, c, t, g, unknown or other
  misc_feature (323)..(324): n is a, c, g, or t
  modified_base (328)..(328): a, c, t, g, unknown or other
  misc_feature (328)..(328): n is a, c, g, or t
  modified_base (330)..(330): a, c, t, g, unknown or other
  misc_feature (330)..(330): n is a, c, g, or t
  modified_base (332)..(332): a, c, t, g, unknown or other
  misc_feature (332)..(332): n is a, c, g, or t
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
  modified_base (340)..(341): a, c, t, g, unknown or other
  misc_feature (340)..(341): n is a, c, g, or t
  modified_base (343)..(401): a, c, t, g, unknown or other
  misc_feature (343)..(401): n is a, c, g, or t
tcagtctacgtagccacgaccggtgctcgatttagatctactgacaacacacaagggggacgggatccctgatcgcttctcaggctccagttctggggctgagcgcaccctcgtcatctccagcctccagtctgagatgagggtgactattattgtcagacgtggggcagtggcgttcaggcagttcggcggagggaccaagctgactgtcctcggtcagcccaaaggcctcgccccctggtcactctcgttccccacctcctcgctaacgtagactgacgcgggctgggacaagggcgactaataggnnannnnnnacngtnnagtncngntnangacnnannnnnnnnnnnnnnnnnnnnnnnnnnnnnnnnnnnnnnnnnnnnnnnnnnnnnnnnnnn

SEQ ID NO: 184990 - DNA, 368 bp, Homo sapiens
  misc_feature: GYAE6OF02I93IP.15.50.E06.1.454.CMB.1.raw
  modified_base (283)..(283): a, c, t, g, unknown or other
  misc_feature (283)..(283): n is a, c, g, or t
  modified_base (319)..(319): a, c, t, g, unknown or other
  misc_feature (319)..(319): n is a, c, g, or t
  modified_base (323)..(323): a, c, t, g, unknown or other
  misc_feature (323)..(323): n is a, c, g, or t
  modified_base (325)..(368): a, c, t, g, unknown or other
  misc_feature (325)..(368): n is a, c, g, or t
tcagtctacgtagccacgaccggtgctcgatttagatctactgacaacacacaaggggggacgggatccctgatcgcttctcaggctccagttctggggctgagcgcaccctcgtcatctccagcctccagtctgaggatggagggtgactattatgtcagacgtggggcagtggcgttcaggcagttcgggcgggagggacccaaggctgactcgtcctcggtcacgcccgaagctcgcccccgtcggtcactctcgttccccaccctcctcgctaccgtanacctgacggcgggctggcgaaaggccgacagtacgnagtncnnnnnnnnnnnnnnnnnnnnnnnnnnnnnnnnnnnnnnnnnnnn

SEQ ID NO: 184991 - DNA, 518 bp, Homo sapiens
  misc_feature: GYAE6OF01CFIBB.17.27.C05.1.454.CMB.1.raw
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcgaggcggaagatgagctgactattactgtaactcccgggacagcagtgctgaccaggtggtagttcggcggacggacccaccgtgacccgtcgttacggtcagccccaaggcctcgccccctggtcctaccg

SEQ ID NO: 184992 - DNA, 560 bp, Homo sapiens
  misc_feature: GYAE6OF01BK675.17.27.C05.1.454.CMB.1.raw
  modified_base (444)..(444): a, c, t, g, unknown or other
  misc_feature (444)..(444): n is a, c, g, or t
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtctatttatggtaaagaataacccggccctcgagggatcccagaccgattctctcggctccgactcaaggaaagacagccttcccagaccatccacgtggggcctcgaggcggaagatgaggtctagacttattactacgtaacgtcccggganacgacgagtgccgtagaccgtagggtcggtacgtccgggacgggacgggaccctaccgtcggtacccgttcgttacggccacggccctaaggccctccgccccctggtcctacccg

SEQ ID NO: 184993 - DNA, 571 bp, Homo sapiens
  misc_feature: GYAE6OF01ECEDZ.17.27.C05.1.454.CMB.1.raw
  modified_base (466)..(466): a, c, t, g, unknown or other
  misc_feature (466)..(466): n is a, c, g, or t
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgacaagttggtaccagcagaagccaggacacggcccctgtacttgtctatttagtaggtaagaactaacccggcctacgagggactcccagaccgtattctcgtggctccgactacaaggaaacgacacgtccttccctacgacctacgtccgacgtggggactacggaggacggaagagtgacggtctagacttacttacgtcgtaaccgtccgggangacagtcgactgaccgtaggtcgtacgtccgggacggtacggacccacgtcggaccgttcgttacggccacgacccgtaggcctaccggcccctggtcctacccg

SEQ ID NO: 184994 - DNA, 545 bp, Homo sapiens
  misc_feature: GYAE6OF01BU3WY.17.27.C05.1.454.CMB.1.raw
  modified_base (372)..(372): a, c, t, g, unknown or other
  misc_feature (372)..(372): n is a, c, g, or t
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagcaggacaggcccctgtacttgtcatttatggtaagaataaccggccctacgagggactcccagaccgattctctggctccgactcaaggaaacacagcttcccngaccatcactggggctcgaggcgaagatggagctagactagttactgtaacctcccgggacagcagtgctacgaccgtagggtggtaacgttcgggccggacgggaccccacgtcggacccgttcgttacggccaacggcccaagggcctaccggccccctcggtcctacccg

SEQ ID NO: 184995 - DNA, 864 bp, Homo sapiens
  misc_feature: GYAE6OF01DBXBS.17.27.C05.1.454.CMB.1.raw
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagtctattatgacaagttggtaccagcagaacgccgaggacacggcccctgttacttgtacatttactaggtaagaaactaaccggccctcgaacgggtactcccaagaccgtacttccgttcgtcggccttaccgacttaccgaaacgggtaaacgtaacctaacggtccctttaccccgtacgtaacccgaacttacccgaaccggttacggggggaccttaccgggaaacggggtaaccgggtaaaagggtaacggttacgggtacggggtaccgttaacgggtaaacccttaaacgtttttaacccgtttaacgggtttaaaccccgtttaccccgggggaacctaacgggtacccgtaaaggttccgggtaccgttaccgggaaaccggttacgggggtttaccgggttaacgggtttaccccggggggtaaacccggggtaacccgggggtaaacccccccttaaccccggggtaaccgggttaccccccgggtttaacccgggtttttaaaccggggttacccccgggaaaccggacccccgggttaaacccgggtaaccccggttcccccggtttaccccccccggttacccggggttaccccgtttaaccccccggg

SEQ ID NO: 184996 - DNA, 667 bp, Homo sapiens
  misc_feature: GYAE6OF01DV5ZQ.17.27.C05.1.454.CMB.1.raw
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgttggtttcttctgagctgactcaggatcctgctgtgtctgtggccttgggacagacagtcaggatcacatcgccgaggacacacgcctcgaagaagtctaattatgactaaggttcggtaaccagacaagaacgccgaggacacggtcccctagttacttagtcttaatttagtaggtaaagaacgtacccgcctagaggacacccgagacgtacttctcgtcggtctccgacgtacgaaggaaacgctacgtccttaccgtacgaaccactaccgacgggtcggggtaccgtaccggaacgggtacggaagtacgttacggacgtacttacgtaaccgtttaacgttaaccgttaaccggtaaaccggttaccccgggaagtaccggacgtaacggtcgtaccgtacggtaccgtagggttacggtacggtccgggacggaccggtaccccgtacgtcggtaccgttacgttcggaccgccgtaccgacgtccgtacccgtcccgtgtccttacccg

SEQ ID NO: 184997 - DNA, 758 bp, Homo sapiens
  misc_feature: GYAE6OF01EZ6GC.17.27.C05.1.454.CMB.1.raw
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (423)..(423): a, c, t, g, unknown or other
  misc_feature (423)..(423): n is a, c, g, or t
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgtggtttcttctgagctgactcgaggatcctgctgtgtctggtggccgttgggacagacagtcaggatcacatcggaccgaggacgacncgcctanaagaagtctaattactgacgtaaggttcggaaccagcgaaggaacgaccgaaggaccgaccggccccttagttaccgttcgtacttaagttttaagtaggtaaacgaacgtaacccgggcctacggaagggacctaccgagaccgtacttcgtcgtcgctccgactacgaacggaaacncgtacgtccgttcctacgacctacgtacgacggtcggggcctacgggacggacggtaaagtggtacggacggtactacggtaaccgttttaaacgttaaccggtaccggttaaacccgggtcccgggaacgacggtaggaccggttcgtaccgttacgggaacccgggttaggggttacgggttaaccggtacccgggggacggggtaaacccggtaccccgttacccgggtaccggttaaccggttaccggtttaccggacccgaacccgggtaccccgtaaccgggccccgttacccccggtccccccggtttaacggtccccgttaaccccg

SEQ ID NO: 184998 - DNA, 729 bp, Homo sapiens
  misc_feature: GYAE6OF01D8KUF.17.27.C05.1.454.CMB.1.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (331)..(331): a, c, t, g, unknown or other
  misc_feature (331)..(331): n is a, c, g, or t
tcagcgtagactagcacgaccggtgctcgatttagacgcgatcgaagggtttgggatgagaacctatgaacattctgtaggggccactgtctccaccatggcctggacccctctctgctcactctcctcactctttgcattaggttctgtggtttcttctgagctgactcaggatcctgctgtgtctgtggccttagggacagacagtcaggactcanatgccgaggagacngcctacagtagctattatgactaaggttcgtaaccagacgaagaacgcgaaggaccgaacggccccttagttactttggtactattttagtagggtaanaacgtaacccgtcctacgtaagggactacccgacgtaaccgtattctcgtgtcccacgactacgaacggaacacctaggtcccttaccgtacacctaacgtaccgtaaccgttcggggacttaccggaacgggaccgtaaagagttaacggacggtaactttaggaaacctttaacggttacctaacggtttaaccccggtccgggaaaccgtagtaccggtaacggttaccgtacgtaaccggtacggttaacgggttcgggttaacggttcccggggaaccggaacccgggtaacccgttaccggaccgttacccggttaacgtttaccggacccgtacggaacccccgttaaggtccccgtccccggtaccccccgttgggtacccttaacccgg

SEQ ID NO: 184999 - DNA, 635 bp, Homo sapiens
  misc_feature: GYAE6OF01DIA05.17.27.C05.1.454.CMB.1.raw
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagcttattatcgactaaggttcggtaccagcaagaacgcgaggacacggcccctgtacttgtctatttataggtaagaactaccggtccctacgaggactaccagacctattctcgtcggcctccgtactacgaaggaacgacacgtccttacccgacgaccagtaccgacggttcggggacctacggacgggtacggaaagagtaggacggctaggtaaccttacttaaccgtacgtaaccgtcccggggaacacggcgtagtcgtaccgtcggaaccgtagggttacggttagtaccgggacgggaccgggtaacccaccggttacggacccgttacgttacggaccgtaccgacccgtacggtacccctccggtccccccgtggtccctacccg

SEQ ID NO: 185000 - DNA, 714 bp, Homo sapiens
  misc_feature: GYAE6OF01AR37R.17.27.C05.1.454.CMB.1.raw
  modified_base (112)..(112): a, c, t, g, unknown or other
  misc_feature (112)..(112): n is a, c, g, or t
  modified_base (230)..(230): a, c, t, g, unknown or other
  misc_feature (230)..(230): n is a, c, g, or t
  modified_base (247)..(247): a, c, t, g, unknown or other
  misc_feature (247)..(247): n is a, c, g, or t
  modified_base (262)..(262): a, c, t, g, unknown or other
  misc_feature (262)..(262): n is a, c, g, or t
  modified_base (277)..(277): a, c, t, g, unknown or other
  misc_feature (277)..(277): n is a, c, g, or t
  modified_base (295)..(295): a, c, t, g, unknown or other
  misc_feature (295)..(295): n is a, c, g, or t
  modified_base (380)..(380): a, c, t, g, unknown or other
  misc_feature (380)..(380): n is a, c, g, or t
  modified_base (395)..(395): a, c, t, g, unknown or other
  misc_feature (395)..(395): n is a, c, g, or t
  modified_base (585)..(585): a, c, t, g, unknown or other
  misc_feature (585)..(585): n is a, c, g, or t
  modified_base (637)..(637): a, c, t, g, unknown or other
  misc_feature (637)..(637): n is a, c, g, or t
tcagcgtagactagcacgaccggtgctcgatttagacgcgatcgaagggtttgggatgagaacctatgaacattctgtagggccactgtctccaccatggcctggacccctntctgctcactccgtctccactctttgactataggttctggttggttttccttctgagtcctagaccgtcaggacttcctggcttggtcgtcgtgtcggtccgttaggggaccaggacngttcgaggtactcaacngtggacccggaaggntaccaggtaccctanaggtaactcctaagttgngtaacgaagttcgaaccaggactaaggaccgccgaaggtccgccggtcccctagttacgttgacgttattaaggcggtaaaaacncgttaaacccccggnttaccggtaaggcccctaaccggtagtaaccgttcttccgttcggagtaacccgtcccctaaagacgacggaaacaccgttggtcccctctaacggcacgttcgaacgggttcgacgttaggaacgacgtaagaccgttaggaacgtcgtaccgttaagtaccgtttacgaacgttccgaaaccccgggntaaccgggtctacggtaccgtagttaccggaacgttgggtacgttaaccggnggtaacggacccgtcgtaaccgtcgtaccgtcgtacggctaacccgacgtacgtcgtacccgtcgccgtaactcccg

SEQ ID NO: 185001 - DNA, 826 bp, Homo sapiens
  misc_feature: GYAE6OF01AY9DT.17.27.C05.1.454.CMB.1.raw
  modified_base (628)..(628): a, c, t, g, unknown or other
  misc_feature (628)..(628): n is a, c, g, or t
tcagcgtagactagcacgaccggtgctcgatttagacgcgatcgaagggtttgggatgagaacctatgaacattctgtaggggccactgtctccaccatggcctggacccctctctggctcactctcctcactcttgcataggttctgttggtttcttctgagctgactcgaggatcctgctgtcgtctgtgccgtggacagacagtcaggatcactagtcgccgaggacacacgtcctacgaagacgtcttaagttagtcgtacgttaagggttcgtaaccaacgacgaaaggaccgtaccgaacggacccgaccgggttaccccttaggttactttacgtaacgttacgttttaaacggtaagggtaaaaccgtaaaccgtaccccgtaccgttaacggaccggtacctaacccgaacgtaccttacgttaccgtcggtccgtacctacccggacgtaaccgggaaaggtaaaccgaccgttacgtcccctttacccgacgtacctaccgtccgtacgggtccggtaccgtacgggaacgggtaacggtaacgtacggtacggacgggttacttaacgtaaaccgtttaccgtaaccggttaaccggtaacccggtaccggtaacncgtacgtacggtcgaccgttaccgggtacggttacggtacgggttaccgggaccggtaacccgggtacccggacccggtttaaccggtaccgggttaaccggtttacccggtaaccggtacccggtaacccggtacccggttaacccgggtcccgtttaacccccgggtccctaaacccgggtttccctaacccccgg

SEQ ID NO: 185002 - DNA, 583 bp, Homo sapiens
  misc_feature: GYAE6OF01A10AS.17.27.C05.1.454.CMB.1.raw
  modified_base (479)..(479): a, c, t, g, unknown or other
  misc_feature (479)..(479): n is a, c, g, or t
  modified_base (527)..(527): a, c, t, g, unknown or other
  misc_feature (527)..(527): n is a, c, g, or t
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgtggtttcttctgagctgactcaggatcctgctgtgtctgtggccttgggacagacagtcaggatcacatcgccgaggagacagcctcaagaagcttattatgactaaggttggtaccagcaagacgccaggacacggccctgtacttgtctatttagaggtaacgaacgtaacccggcctacgacggactaccgagaccgtattcgtcgtcggcctaccggactacgaacggaaagaccgacgtaccttcccgtacgacctatccgacgtgggctcgaggacgaagtatggacgctagtacgtaattaccgtacgttaaccgcccggtanacgacgtagtcgactcgacgtaggtcgtagtcgggacggaccggaccncgtcgaccgtcgtacgcgaccgacccgaacggtcccaccgtccccgtgtctacccg

SEQ ID NO: 185003 - DNA, 179 bp, Homo sapiens
  misc_feature: GYAE6OF01BJR64.17.27.C05.1.454.CMB.1.raw
  modified_base (174)..(179): a, c, t, g, unknown or other
  misc_feature (174)..(179): n is a, c, g, or t
tcagcgtagactagcacgaccggtgctcgatttagacgcgatcgaagggtttggggggaagaggaagactgacggtccccccaggagttcaggtgctgggcacagcggccctgggctgcctggtcaaggactacttccctagtctacgctgagcgggctggcaaggcgcatagnnnnnn

SEQ ID NO: 185004 - DNA, 841 bp, Homo sapiens
  misc_feature: GYAE6OF01BUZQQ.17.27.C05.1.454.CMB.1.raw
tcagcgtagactagcacgaccggtgctcgatttagacgcgatcgaagggtttgggatgagaacctatgaacattctgtaggggccactgtctccaccatggcctggacccctctctggctcactctcctcacttctttgctataggttctgttggtttccttctgagtctgactcgaggtactccgtgtctggttcgttctggtcggtccgttagggacacgacgtgtcgaggtactcaacgtagtcggaccgagggacgaccacgcctagaagaagtccttaagttatacggtaccgtaaggtttccggaaccaacggacgaaggaaccggaccgaacggacccgtaccggtccccgttagttacgtttcgttacttaagtttaacggtaaggtaaacgtaaccgtacccggacctacggacgggtacctacccggtaacgtcccgtattccgtcgtaccggtcctacccgtacgacgaacgggaactacgtcctaccttcccgataccacgttacgtccgggtacgggaccgtaacggggcgggaacgggttaaagcggttgggtaccgttcgttaaacggtaccttttaaccggtttaacccgtaaccggttaccccgggaaccggaccgtttaacgggccggttaacgccgggttaccgtaccggggttacgggttacggggttagtttacccgggggacggggtaccccgggtaaaccccgtaacccggtccgggttaacccgtcggtttacccgggtaacggtcccgaacccggggtacccgtacccgggtccccctaacccccgggtcccgtttacccgggtaccttccccggg

SEQ ID NO: 185005 - DNA, 801 bp, Homo sapiens
  misc_feature: GYAE6OF01B4FTH.17.27.C05.1.454.CMB.1.raw
  modified_base (121)..(121): a, c, t, g, unknown or other
  misc_feature (121)..(121): n is a, c, g, or t
  modified_base (314)..(314): a, c, t, g, unknown or other
  misc_feature (314)..(314): n is a, c, g, or t
  modified_base (518)..(518): a, c, t, g, unknown or other
  misc_feature (518)..(518): n is a, c, g, or t
  modified_base (524)..(524): a, c, t, g, unknown or other
  misc_feature (524)..(524): n is a, c, g, or t
tcagcgtagactagcacgaccggtgctcgatttagacgcgatcgaagggtttgggatgagaacctatgaacattctgtaggggccactgtctccaccatggcctggaccccctctgcgtcnctctcctcactcttgtcatagttcgttgttggtttcgtttcttgtagcgtgtacgtctacgtacgtcctcgtcgtgttcgttcgttcggtcggtccgttcgggtacgacgaccgacggtacgtacggagtacctacaacgtcggaccggacggtaacggaccacgtccgtacgacgtaacgactttagttacncggttaccggaacgtttacgggtaccacggaacctaggaaaccgtcgaacgggtaaccgacccgggtccccgtttcggtttaactttacggttcttaaacggttttaggtaaccgggtaaacggtaaaaccgtaccccgttccgacggacgggtaccttacccgagtacgtacttcgtactcggactccgagtaacaggtaacnccgtcnccgttaccacgtactacgtcgaccggtcggtaccgtcgtaacggacggacgttaggacgtacgtacggttacgtaacgtttaacctacgttaaccggtaccccggtaacgggtaccgaacgttccgtaaggtaccgtacgggttaccgacggttaacggttcgggttacgtacgggtacccggtacggtaccccgttacggccgttaaccgggttacgtacggtaccgtaccgtacggacggtacccgtccgtacccgtcgtaaccgtccgtacccg

SEQ ID NO: 185006 - DNA, 515 bp, Homo sapiens
  misc_feature: GYAE6OF02HO30B.17.27.C05.1.454.CMB.1.raw
  modified_base (394)..(394): a, c, t, g, unknown or other
  misc_feature (394)..(394): n is a, c, g, or t
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggcctcagggatcccagaccgattctctggctccgactcagaaagacagcttccctgaccatcactggggctcgaggcgaagntgagctgactattactgtaactcccgggacagcagtgctgaccaggtgtagttcggcggacgggacccaccgtgaccgtcgttacggtcagcccaaggcctcggccccctcggtcctaccg

SEQ ID NO: 185007 - DNA, 541 bp, Homo sapiens
  misc_feature: GYAE6OF02JVK20.17.27.C05.1.454.CMB.1.raw
  modified_base (298)..(298): a, c, t, g, unknown or other
  misc_feature (298)..(298): n is a, c, g, or t
  modified_base (356)..(356): a, c, t, g, unknown or other
  misc_feature (356)..(356): n is a, c, g, or t
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttanggtaagaataaccggcctcagggactccagaccgatctactgctccgactcgaagaanacagcttccctgaccatccacgtgggcctcgaggcggaagatgagctgactattactagtaacgtccggacagcagcgcgtgaccgtaggtaggtacgtcgggacggtacgggaccctacgtcggtaccgttcgttaacggccgtaacgacccgaaggtccctacggccccctggtacctacccg

SEQ ID NO: 185008 - DNA, 615 bp, Homo sapiens
  misc_feature: GYAE6OF02HPY11.17.27.C05.1.454.CMB.1.raw
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacacggcccctgtacttgtcatttanggtaanaactaacccggcctagaggactcccagaccgtattctctggctaccgactcgaaggaaacgacacgtccttacccgtgaacccatcacgtcggggctcggaggacggaagagtaggacgcgtagtacttaattaccgtacggtaaccgtacccgggacacggaccgtaggtcgtaccgtacgtaacgtagggtacggtacgttcggggacgggaccgggacccgtaccggtacggtacccgttacggttacggtaccgacggtacccgtaacggtcccgttacccggtccccgtccggtaccttacccgg

SEQ ID NO: 185009 - DNA, 561 bp, Homo sapiens
  misc_feature: GYAE6OF02H5LLC.17.27.C05.1.454.CMB.1.raw
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (337)..(337): a, c, t, g, unknown or other
  misc_feature (337)..(337): n is a, c, g, or t
  modified_base (445)..(445): a, c, t, g, unknown or other
  misc_feature (445)..(445): n is a, c, g, or t
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgacaagttggaccagcaagaagccaggacacggccctgtacttgcatttanggtaanataaccgcctcaggactaccagaccgattctcnggtctccgactacgtaggaaacacacgtccttaccgtacgaacctatacacgtcgggctacgaggacgaacgagtgaggctagactattactacgtacgtacccgganacgacgagtcgcgtacgaccgtggtaggtagttacggacggacgggaccctacggtcgtaccggttcgtacggactacggcccgaacgccgttaccggccccgtcggtcctacccg

SEQ ID NO: 185010 - DNA, 620 bp, Homo sapiens
  misc_feature: GYAE6OF02IXYOW.17.27.C05.1.454.CMB.1.raw
  modified_base (311)..(311): a, c, t, g, unknown or other
  misc_feature (311)..(311): n is a, c, g, or t
  modified_base (355)..(355): a, c, t, g, unknown or other
  misc_feature (355)..(355): n is a, c, g, or t
  modified_base (384)..(384): a, c, t, g, unknown or other
  misc_feature (384)..(384): n is a, c, g, or t
  modified_base (402)..(402): a, c, t, g, unknown or other
  misc_feature (402)..(402): n is a, c, g, or t
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagcttattatgactaaggttcggtaccagacaagaacgccgaaggacacggcccctgtacgttgtctatttanaggtaagaactaaccggccctagaacggtactaccgagaccgtnttactcgtcgctacgactacgaaggaaanacacgtccttacccgtanacctactaccgtacgtcgggctacgaggacggaaagtgacggtacgtaccgtagtaacttaacgttacgtaacgtaaccggtacccggagacgacgtacgtcgtacgtacggtaccgtagggtcgttacgttcgggacggtaccggaccgtaccgtaggtaccgttcgttaacggccgacggaccgtacggccgtccgtaccccgttcgtccctaccg

SEQ ID NO: 185011 - DNA, 786 bp, Homo sapiens
  misc_feature: GYAE6OF02IKLW8.17.27.C05.1.454.CMB.1.raw
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgtggtttcttctgagctgactcaggatcctgctgtgtctggtggccttgggacagacaggtcaggatcacatgccgaggagacagcctcagaagctaattatgacaagttggtaccagcagaagccaggtaccagcccctggttaccttgtacctaagttttactagggtaaacgtaacgtaaaacccggccccttacgaacggggaacttaccccgaaaggaacccggttaatttacccgtaccgttacggggtcccctttaccccgggaacctttaccgaaaacgggggaaaaaacgtaccgtaaaaccggtccccggtttttacccccgaacggtaaacccctaacgttaccctaaaaccgggtttacccgggggccgttaaccgaaccggggtaaccgggaaaacgggtaacgttaacgggaaccgggtacgttacggtaaaccgtttacgtttaaaccgttacggtaaaccgtacccgggtaacgaacgtaccgaacggtcgtaccgtacgtaaccgaacgggttcggtaacggttacgggaccgggtaccgggacccgtacccgtacggtaccgttaccggtaacgtacgaccgtacgaacggtccgtacggcccccgttaggtccctaccg

SEQ ID NO: 185012 - DNA, 598 bp, Homo sapiens
  misc_feature: GYAE6OF02GF448.17.27.C05.1.454.CMB.1.raw
  modified_base (236)..(236): a, c, t, g, unknown or other
  misc_feature (236)..(236): n is a, c, g, or t
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgtggttttcttctgagctgactcaggatcctgctgtgtctgtggccttgggacagacagtcaggatcacatgccgaggagacagcctnagaagctattatgcaagttggtaccagcagaagccaggacaggcccctgtacttgtcatttatggtaagaataaccggccctcgagggactcccgagaccgtattctctcggcttccgactcgaaggaaagacacgtcttccctagaccatcaacgtggggctcgaggcgaagagtgaggctagacttagttactgtaaccgtcccgggacacgacgagtcgcgtacgaccgaggtacggttagttaccgggaccgggtacgggaccccaccggttcggaacccggtttacgttacgggttaccgaccggtaccccgaacgggtccgttcccggaccccccgttacgggtacccgttacccg

SEQ ID NO: 185013 - DNA, 399 bp, Homo sapiens
  misc_feature: GYAE6OF02HNNK1.17.27.C05.1.454.CMB.1.raw
  modified_base (390)..(399): a, c, t, g, unknown or other
  misc_feature (390)..(399): n is a, c, g, or t
tcagcgtagactagcacgaccggtgctcgatttagacgcgatcgaagggtttggggtacgatttgatgttacctgatgcttagaggcttttcctggaagcagggcatttgttgcttcagcaccgtagtgcctcgtcatcacgcctcagccttgatttttccggatttgcctggaaaaccagcctacacgcttaaaccgggacaaccgtcgcccggccaacatagccttctccgtccccccttcgcagtaacaccaagtacaggaatattaacctgttcccatcgactacgcctttcggcctcgccttaggggtcgactcaccctgccccgattaacgttggacaggaacccttggtccttccggcgaggcgggctggcaaggcgcatagnnnnnnnnnn

SEQ ID NO: 185014 - DNA, 756 bp, Homo sapiens
  misc_feature: GYAE6OF02IF8GQ.17.27.C05.1.454.CMB.1.raw
  modified_base (202)..(202): a, c, t, g, unknown or other
  misc_feature (202)..(202): n is a, c, g, or t
  modified_base (218)..(218): a, c, t, g, unknown or other
  misc_feature (218)..(218): n is a, c, g, or t
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgtggtttcttctgagctgactcaggactcctgctgtgtctgtggccttgggacngacagtcaggatcacngtgccgaggagacagcctcaagaagctaattatgactaaggtttggaccagacaaggaaacgccgaaggaccgacgggacccccttaggttaccgtttagtacctagttttaaagtcgggttaaaaacgtaaaccggtaaaccccggtccccgttaacggaaccggggtaactaccccccgaaaggacccggtaacttttccgtaccgtacgggtccctttacccggaacctaaccgggaagggaaaaacgacgtacgtcccctttaccctacgaccctaagttccgacggttcggggactcggagggtaacggaagtacgtggagtccgtaagtaaccttaagttaaccgttaaccgtaacccggtacccgggaacaacggcgtaacgtcgaccgtacggtaaccgaaggggttcggtacgttaccggggaccggacccgggaaccccgtccggttaaggtaccccggtttaggtaacccgttccggacgtacccgaacgggtccctacccggtccccgttaccggccttaacccgg

SEQ ID NO: 185015 - DNA, 713 bp, Homo sapiens
  misc_feature: GYAE6OF02IDG8X.17.27.C05.1.454.CMB.1.raw
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgtggtttcttctgagctgactcaggatcctgctgtgtctgtggccttgggacagacagtcaggatcacatgccgaggagacagcctcaagaagctattatgacaagttggtaccagcagaagccaggacacggcccctgtacttgtactatttagtggtaaagaataaacccggcctacgagggactacccgaagaccgtattctctcggcctaccgactacgaagggaaaacgacgacgtccttccctagaacccaatccaacgttcggggcctacgaacgggtacggaaagaacgtaggacggtaccgttacgtaacttaacgtttaacgttacgtaaacccggtaccccgggaacgtaacggaccgtaacggttcgaccgtacggaacccgtaaggggttacggttaaaccggtttaccggggaccggggtaaccggggtaacccctaaccggttaccgggtaaccccggttaccggtttaacgggttaacccgaacgggtaccccggtaacgggtccccgttaccccggtacccccccggttcggtaacccgttaccccgg

SEQ ID NO: 185016 - DNA, 665 bp, Homo sapiens
  misc_feature: GYAE6OF02HNXK9.17.27.C05.1.454.CMB.1.raw
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagcagacacggcccctgtactgtctatttagtaggtaaagaacgtaacccggccctacgacgggactaccccgaagaccgtacttctcgtggtcctaccgactacgaacgggtaaaagacgtagtaccttaccctgacctactcctacggtcggggcctacgagggacggaaagtagtagggacggacttaggacttaagtttaaccgtacgttaaacccggtacccgggaacgtaacgaccgtaggtcgtacctacggtaccgtaacgggttcggtaacgttacggggcccgggtaacgggacccctaaccggttccgtacccggttagttaaccggtaccgaccggtacccgtaaagggcccgttacccggtaccccccgttcggtacccttacccg

SEQ ID NO: 185017 - DNA, 722 bp, Homo sapiens
  misc_feature: GYAE6OF02HNQX4.17.27.C05.1.454.CMB.1.raw
  modified_base (236)..(236): a, c, t, g, unknown or other
  misc_feature (236)..(236): n is a, c, g, or t
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgtggtttcttctgagctgactcaggatcctgctgtgtctgtggccttgggacagacagtcaggatcacatgccgaggacgacagcctnagagctattatgactaagttgtaccagcagaagcgaaggacacggccccgtgttacttgtcctatttacgtggtaaacgtaactaacccggccctacgaggactcccgagaccgtattctcgtcggcctccgtacgtcgaagaaacgactacggtccttacccgtcgtaaccctacgtaccgtaccggttcggggtacctcggaacgggacggaaaggtaacgtcgggaacgtcgttaacggtaaccttacgttaaccgtacgttaacccgtacccggggtaacacggtacgtacggtacggtcctacgggtaacccgttacgggtttacggtaccgtttaccgggggacgggtacccggggtaacccgtaccccggttcggtaaccccggttacggttttaacgggacccgtaacccggaccccggttaacggtacccccggttacccgggtcccccccgttaccgggttaccccttaaccccgg

SEQ ID NO: 185018 - DNA, 712 bp, Homo sapiens
  misc_feature: GYAE6OF02IDK1E.17.27.C05.1.454.CMB.1.raw
  modified_base (175)..(175): a, c, t, g, unknown or other
  misc_feature (175)..(175): n is a, c, g, or t
  modified_base (208)..(208): a, c, t, g, unknown or other
  misc_feature (208)..(208): n is a, c, g, or t
  modified_base (391)..(391): a, c, t, g, unknown or other
  misc_feature (391)..(391): n is a, c, g, or t
  modified_base (565)..(565): a, c, t, g, unknown or other
  misc_feature (565)..(565): n is a, c, g, or t
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgtggttttcttctgagctgactcaggntcctgctgtgtctgtggtccttgggacaggacngtcgaggatcacatgccggaggacgacagcctcgaagaagtctaattagtgacgtaaggttggaaccagacaaggaacggccaagggaccgtacggtccccgttattaccgttgtacttagtttagtacgggtaaaactaacgtaacccggccctacgaacggtactacccgagtaaccggtnttcgtcgtcggccttaccgtacgtacggaacggaaaacgtacgtacgtcccttacccgtacggtaaaccacgttacccgaacggtcggggtcctaccggacgggtaccggaaaagtggtacggaaggtccgttaagtaaccgttagttaaccgtacgtaaccgtaccccggganacggtactacggtacgtacggtacgacggttacggttacggtaccggttcgggacgggaccgggacccttaccgtacggtaacccgttcgtacggtacgaaccggtaccgaacggtcccgtcccgtaccccggtacgtcctacccgg

SEQ ID NO: 185019 - DNA, 867 bp, Homo sapiens
  misc_feature: GYAE6OF02J0VXN.17.27.C05.1.454.CMB.1.raw
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgtggtttcttctgagctgactcaggactcctgctgtgtctggtcggtccttgggacagacagtcaggatcacagtcgaccggaggacgacacgcctagaagaagtccttaattatcgactaaggttggacctagacgaaggaacgccgaaggaccgacggtaccccgttagttaccgttacgtaccgttaagttttagtaacggggttaaaacgaacggttaaccccggtccccgtacggtaaggggtacctaccccggaaccggtaaaccgtttacgttacccgttccttacggggtcccgttaaccccgggtaccgttaacgggaaacggtaaaaccggtacctacccggttaacccgtttacccgaccgtaacccgtaacgtacccgtacgggtcgggggttacccgtacggtacggggaacgtaacggtacgtagggaccggtacgttacgttaccgttaacgtttaaccgtaaaccgggttacccgtaacccgggtaacgaccgtacgtacgggtaccgtacggtaaccggtaccgggtttacggtaccgggttaacgggttaccggggtaaccgggacccgggttaaaccccgccgggttaacccggttaacccgggtttacgttaaccggggtacccgtacccgggttaacccgtaaccgggtcccggtacccccgggtacccccggtttaccggtaccgtttaacccccgg

SEQ ID NO: 185020 - DNA, 650 bp, Homo sapiens
  misc_feature: GYAE6OF02H50VN.17.27.C05.1.454.CMB.1.raw
  modified_base (237)..(237): a, c, t, g, unknown or other
  misc_feature (237)..(237): n is a, c, g, or t
tcagcgtagactagcacgaccggtgctcgatttagacgcgatcgaagggtttgggatgagaacctatgaacattctgtaggggccactgtctccaccatggcctggacccctctctggctcactctcctcactctttgcataggttctgttggttttcttctgagctgactcaggatcctgctgtgtctgtggccttgggacagacagtcaggatcacatgccgaggagacagcctnagaagcttattatgacaaggttggtaccagacagaacgccaggacacggcccctgtacttgtactatttagtaggtaacgaacgtaacccggccctacgagggtactacccacgaccgtacttctctcggcctaccgactacgaaggaaacgacacgtaccttccctacgacctatccgtacggtcggggcctacggaacgggcggaaggacgtcggaggtccttaggtacttacggtttaacctacggttaaccggtacccgggacacgtacgtagttcgcgttacgaaccgttagggtacggttacgtccgggaccgggtaccggacccgtaccgtcggtacccgttacgttacggaccgtaccggacccgtaacggcccgttcccggacccccggttcggtacctacccg

SEQ ID NO: 185021 - DNA, 734 bp, Homo sapiens
  misc_feature: GYAE6OF02IZ5AQ.17.27.C05.1.454.CMB.1.raw
  modified_base (168)..(168): a, c, t, g, unknown or other
  misc_feature (168)..(168): n is a, c, g, or t
  modified_base (251)..(251): a, c, t, g, unknown or other
  misc_feature (251)..(251): n is a, c, g, or t
tcagcgtagactagcacgaccggtgctcgatttagacgcgatcgaagggtttgggatgagaacctatgaacattctgtaggggccactgtcctccaccatggcctggacccctctctggcctcactcctcctcacttcttgcattaggttctgttggtttcttgtagngctgactcaggctcctgctgtcgtctggtcgtcgtaggacagacagtacgagtactcaactagtcgaccggaaggacgtaacncgcctagaagaacgtcttaagttacgcggtacgtaaggtttccggaaccagaacgtacgaacgaccggaaggaccgaccggtcccttaggttactcgtacgttattaacggtaggtaaaacacgtaaccccgccgtagaacggtacctaccgaagtacctacgtcctacgtcggtaccctcgaccgtacgaaaggacgaaccgcccgtttccgttaacccgcgttaacccacgtaccgtaggtaccggcgtacgacggtacgaagtacgagacgtagtacgttacttaacgttacgtaccgtaaccgtaccggtaacacggtaacgtcgtacgaccgtaccggtaccgtaggtaccggtacgggttaccggaccgggacccgtaccgttaacccggcggttacccgttaccggttacggtacccgtaccggacccggtaccggtccgttaccccggtacccccggttcggacccgttaccccg

SEQ ID NO: 185022 - DNA, 834 bp, Homo sapiens
  misc_feature: GYAE6OF02I32IE.17.27.C05.1.454.CMB.1.raw
  modified_base (113)..(113): a, c, t, g, unknown or other
  misc_feature (113)..(113): n is a, c, g, or t
tcagcgtagactagcacgaccggtgctcgatttagacgcgatcgaagggtttgggatgagaacctatgaacattctgtaggggccactgtctccaccatggcctggacccctntctgctcactctcctcactctttgcataggttctgttggtttcttctgagtctgactcaggtatcctggtcttgtcgtctggtcggtccgttgggacaggacctaggtcgaacggtactacgacctagttacggaccggaaacggggtacgtaacacggtaccctacgacgtaacgtcttaattataggactaaggtttacggtaaccgaacgtcaaacgggaacggaccggtaacggtaccgaaccgggtaccccttagggttaaccgttagttaccgttaagttttaacgttaacgggttaaaacgaaaccgttaaaccccgggtccccgttaacgggtaaccgggggtaacctaccccggtaaaggtaccccgtacgtttaccgttacggtccgggttacccttaacccgtaccgttaaccgaaaacgggtaaacgtaacggtacgtccgttttaccccgacggtacctaacggtaccgttaccgggtacgggtaccgtacggaacgggaacgggtaaagacggttacggacggtacgttaacgtacgtttaacgtttcgtaaccgtaacccgtcccggaagtacccggtagtacgtggtacctacggaacggttacggtaggtaccgttagggaccggtaccgcccgtaaccggtcgttaaccgtacgttacgacgacgtaccggacgtacccgtcgtaccccgtcggtacctccgg

SEQ ID NO: 185023 - DNA, 765 bp, Homo sapiens
  misc_feature: GYAE6OF02HRJF5.17.27.C05.1.454.CMB.1.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (291)..(291): a, c, t, g, unknown or other
  misc_feature (291)..(291): n is a, c, g, or t
tcagcgtagactagcacgaccggtgctcgatttagacgcgatcgaagggtttgggatgagaacctatgaacattctgtagggccactgtctccaccatggcctggacccctctctggctcactctcctcactctttgcataggttctgtggtttcttctgagctgactcgaggatcctgctgtgtctgtaggccttgggacngacagtcaggatcacatggaccgaagganacaggtccccttagaaggtaacgtcttaatttaagtcgaaccgtaaggttcggtaacccnggacctaaaacggaagaccccgaaggaccgaccgggtcccccgttacgttacgtttcgacttagttttaagtacggggttaaataaaccgttaaaccccggcccgttacgaacggggtacctaacccgtacggtaccgtaatttcccgtcgtacgggccctacggtacccttacggaaggtaaacgtaccggtaacgcccgtttaaccgacgtaccctacgttacccgaacgtccggggtaacctcgggtaacgggtaccggtaaggtacttagggacggtaccgttacgttaacgttccgtttaaaccgttaggtaaacccggttaccccggaagtaccggaactcggaccgcgtacgggtaacctggggttaagttaccggttcgggcggacccgtaacccgccgtaccggtaccgttacgtacggtccaaccgtaccgacggtccgtacccgtccccgttcgaccctcccg

SEQ ID NO: 185024 - DNA, 131 bp, Homo sapiens
  misc_feature: GYAE6OF01CCQI4.14.23.C01.1.454.CMB.1.raw
  modified_base (130)..(131): a, c, t, g, unknown or other
  misc_feature (130)..(131): n is a, c, g, or t
tcagcgtctagtaccacgaccggtgctcgatttagtacacgtgattagggattgggcacagcggccctgggctgcctggtcaaggactacttccgtactagacgctgagcgggctggcaaggcgcatagnn

SEQ ID NO: 185025 - DNA, 516 bp, Homo sapiens
  misc_feature: GYAE6OF01CBLFG.14.23.C01.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccaggggaaanagccaccctctcctgcagggccagtcagagtgttagaagcaacttagcctggtaccagcagaaacctggccaggctcccaggctcctcatctatggtncatccaccagggccactggtgtcccagccaggttcagtggcaggtgggtctggggacaggagttcactctcaccatcagcagcctgcagtctgaagtattttgctagtttattattgtcagcagtataataactggcctcgtaggacgttcggacgaacgggacaaggtaggaaatacgaaacgaactgtcgctgacaccatctcgtcttctac

SEQ ID NO: 185026 - DNA, 499 bp, Homo sapiens
  misc_feature: GYAE6OF01CP4XV.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagtattttgctagtttattattgtcagcagtataataactggcctcgtggacgttcggcaagggccaaggtgaatacgaaacgatggtgctgcacatctgtctctac

SEQ ID NO: 185027 - DNA, 515 bp, Homo sapiens
  misc_feature: GYAE6OF01DD74Z.14.23.C01.1.454.CMB.1.raw
  modified_base (206)..(206): a, c, t, g, unknown or other
  misc_feature (206)..(206): n is a, c, g, or t
  modified_base (303)..(303): a, c, t, g, unknown or other
  misc_feature (303)..(303): n is a, c, g, or t
  modified_base (407)..(407): a, c, t, g, unknown or other
  misc_feature (407)..(407): n is a, c, g, or t
  modified_base (499)..(499): a, c, t, g, unknown or other
  misc_feature (499)..(499): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaagggggaaanagccacactctcctgcagggccagtcagagtgttagaagcaacttgcctggtaccagcagaaacctggccaggctcccaggctcctcatctatggtncatccacagggccacgtggtcgtcccagcccaggttccaggtggcaggtgggtctgggacaggtagttcacttctcaccatcagcagcctgcagtctagaagtntttgactagtttattattgtcagactagtataatacgtggtcctcggtggacgttcggacaagggacaaggtagaaatcgaaagactgcggntcgcacatctgtcttc

SEQ ID NO: 185028 - DNA, 508 bp, Homo sapiens
  misc_feature: GYAE6OF01DS7C2.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctccaggcctcctcatctatggtgcatccaccagggccactggtctcccagccaggttcagtggcagtgggtctgggacagagttcactctcaccatcagcagcctgcagtctgaagtattttgctagtttattattgtcagcagtataataactggtcctcgtggacgttcggccaagggaccaaggtaggaaatacgaaacgaactggtggctgcacatctgtctctac

SEQ ID NO: 185029 - DNA, 508 bp, Homo sapiens
  misc_feature: GYAE6OF01AZSFV.14.23.C01.1.454.CMB.1.raw
  modified_base (203)..(203): a, c, t, g, unknown or other
  misc_feature (203)..(203): n is a, c, g, or t
  modified_base (498)..(498): a, c, t, g, unknown or other
  misc_feature (498)..(498): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctccaggctcctcatctatggtgcatccaccagggccactggtcgtcccagccaggttcagtggcaggtgggtctgggacagagttcactctcaccatcagcagcctgcagtctgaagtatttgctagtttattattgtcagctagtataataactggcctcgtggtacgttcggaccaacgggaccaaggtgaaatcgaaacgatgtcggctgacacatntctcttctac

SEQ ID NO: 185030 - DNA, 512 bp, Homo sapiens
  misc_feature: GYAE6OF01BI7IY.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagaagcaacttagcctggtaccagcagaacctggccaggctcccaggctcctcatctatggtgcatcccaccagggcccactggtcgtccccagccaggttcaggtggcaggtgggtctggggacagagttcactctcaccatcagcagcctgcagtctgaagtattttgctagtttattattgtcagtcagtataataactggcctcgtggacgttcggccaagggaccaggtagaaatcgaaacgtatggtgctgacaccatctcgtcttctac

SEQ ID NO: 185031 - DNA, 526 bp, Homo sapiens
  misc_feature: GYAE6OF01DC87P.14.23.C01.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
  modified_base (514)..(514): a, c, t, g, unknown or other
  misc_feature (514)..(514): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaaggggaaanagccaccctctcctgcagggccagtcagagtgttagaancaacttagcctggtaccagcagaaacctggccaggctcccaggctcctcatctatggtgcatccaccagggccaacgtggtcgtcccatccaggttcaggtggcaggtgggtctggggacagagttcactctcaccatcagcagctgcagtctagaagtattttgactagtttaattattgtcagtcagtaataataactggccttccgtggtacgttcggaccgaacggacgaacggtaggaaatacgaaacgaataggtgctgcacatntcgtcttcgtac

SEQ ID NO: 185032 - DNA, 504 bp, Homo sapiens
  misc_feature: GYAE6OF01BXR2B.14.23.C01.1.454.CMB.1.raw
  modified_base (501)..(501): a, c, t, g, unknown or other
  misc_feature (501)..(501): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctccaggctcctcatctatggtgcatcccaccagggccactggtgtcccagccaggttcagtggcagtgggtctgggacagagttcactctcaccatcagcagcctgcagtctgaatatttgctagtttattattgtcagctagtataataactggccttcgtggacgttcggacaagggaccaaggtgaaagtcgaaacgatggtggctgcaccatctgtctntac

SEQ ID NO: 185033 - DNA, 506 bp, Homo sapiens
  misc_feature: GYAE6OF01BCGQD.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaacctggccaggctcccaggctcctcatctatggtgcatccaccagggccactggtgtcccagccaggttcagtggcagtgggtctgggacagagttcactctcaccatcagcagcctgcagtctgaagtatttgctagtttattattgtcagctagtaataataactggtcctccggtgtacgttcggaccaagggaccaagggtgaaatacgaaacgatgtgctgcacatctgtctctac

SEQ ID NO: 185034 - DNA, 547 bp, Homo sapiens
  misc_feature: GYAE6OF01BUJKR.14.23.C01.1.454.CMB.1.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (390)..(390): a, c, t, g, unknown or other
  misc_feature (390)..(390): n is a, c, g, or t
  modified_base (406)..(406): a, c, t, g, unknown or other
  misc_feature (406)..(406): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagaagcaacttagcctggtaccagcagaaacctggccaggctcccaggctcctnatctatggtgcatccaccgagggccacgtggtcgtcccagcctaggttcaggtggcaggtgggtcgtgggacagtagttcactctcaccatcagcacgcngctagtctagaagttntttgacgttagttttatagtttgactagtactaagttaataacttacgtcggtcctcggtaggtaccggttcggacgaacggacgaaggtagaaactacgaaacgtactggtcgactgacctacactctcgttctctaccg

SEQ ID NO: 185035 - DNA, 511 bp, Homo sapiens
  misc_feature: GYAE6OF01AL2XC.14.23.C01.1.454.CMB.1.raw
  modified_base (396)..(396): a, c, t, g, unknown or other
  misc_feature (396)..(396): n is a, c, g, or t
  modified_base (503)..(503): a, c, t, g, unknown or other
  misc_feature (503)..(503): n is a, c, g, or t
  modified_base (508)..(508): a, c, t, g, unknown or other
  misc_feature (508)..(508): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctgaccaggctcccaggctcctcatctatggtgcatccaccagggccactggtgtcccagccaggttcagtggcagtgggtctgggacagagttcactctcaccatcagcagcctgcagtctgaagtnttttgctagtttattattgtcagtctagtataataactggccttcgtgtacgttcggaccaagggaccaaggtaggaaatacgaaacgtatgtggctgactacatcngtctntac

SEQ ID NO: 185036 - DNA, 491 bp, Homo sapiens
  misc_feature: GYAE6OF01BY01R.14.23.C01.1.454.CMB.1.raw
  modified_base (203)..(203): a, c, t, g, unknown or other
  misc_feature (203)..(203): n is a, c, g, or t
  modified_base (488)..(488): a, c, t, g, unknown or other
  misc_feature (488)..(488): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctccaggctcctcatctatggtgcatccaccagggccactggtgtcccagccaggttcagtggcagtgggtctgggacagagttcactctcaccatcagcagcctgcagtctgaagtattttgctagtttattattgtcagcagtataataactgcctcgtgacgtcgcaggacaggtgaatcgaacgatgtggctgcaccatctgtcttntac

SEQ ID NO: 185037 - DNA, 495 bp, Homo sapiens
  misc_feature: GYAE6OF01BZVP1.14.23.C01.1.454.CMB.1.raw
  modified_base (203)..(203): a, c, t, g, unknown or other
  misc_feature (203)..(203): n is a, c, g, or t
  modified_base (492)..(492): a, c, t, g, unknown or other
  misc_feature (492)..(492): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctccaggctcctcatctatggtgcatcccaccagggccactggtgtcccagccaggttcagtggcagtgggtctgggacagagttcactctcaccatcagcagcctgcagtctgaagtattttgctagtttattattgtcagcagtataataactggcctcgtgacgttcgcaaggccaggtgaaatcgaaacgatgtggctgcacatctgtctntac

SEQ ID NO: 185038 - DNA, 501 bp, Homo sapiens
  misc_feature: GYAE6OF01EG82T.14.23.C01.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
  modified_base (480)..(480): a, c, t, g, unknown or other
  misc_feature (480)..(480): n is a, c, g, or t
  modified_base (492)..(492): a, c, t, g, unknown or other
  misc_feature (492)..(492): n is a, c, g, or t
  modified_base (498)..(498): a, c, t, g, unknown or other
  misc_feature (498)..(498): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagaagcaacttagcctggtaccagcagaaacctggccaggctccaggctcctcatctatggtncatccaccagggcccactggtcgtccccagcctaggttcaggtcggcagtgggtctgggacagagttcactctcaccatcagcagcctgcagtctgaagtatttgctagtttattattgtcagtctagtataatactggcctcgtgacgttcggacaaggcaggtagaaatcgaaacgtangtgctgcacatntgtctntac

SEQ ID NO: 185039 - DNA, 614 bp, Homo sapiens
  misc_feature: GYAE6OF01DO6QT.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagagcaacttagcctggtaccagcaagaaacctggccaggctcccaggcctcctcatctatggtgcatccaccagggccactggtcgtcccatccaggttcagtggcagtgggtctgggacagagttcactctcaccatcagcagcctgcagtctagaagtattttgctagttttattagtttgtcagtctaagttataaacgttaactcggtacccttccggttagggtaaccggtttacgggacccgtaaacgggggaacccgtaaagggtaacgggtaaaacgttaccgaaaaaaccggtaaaccgttagggttacgggaccgttacgggaccctaacccgtaatttcccgttacggtttccgtttcctaaccg

SEQ ID NO: 185040 - DNA, 512 bp, Homo sapiens
  misc_feature: GYAE6OF01ARSTX.14.23.C01.1.454.CMB.1.raw
  modified_base (203)..(203): a, c, t, g, unknown or other
  misc_feature (203)..(203): n is a, c, g, or t
  modified_base (505)..(505): a, c, t, g, unknown or other
  misc_feature (505)..(505): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtgcatcccacagggccactggtcgtcccagccaggttcaggtggcagtgggtctgggacagagttcactctcaccatcagcagcctgcagtctagaagtattttgctagtttattattgtcagtcagtataataactggcctcgtggtacgttcggaccgaagggaccaaggtgaaatacgaaacgtatggtcgctgctacatctntctctac

SEQ ID NO: 185041 - DNA, 530 bp, Homo sapiens
  misc_feature: GYAE6OF01BT9WD.14.23.C01.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
  modified_base (523)..(523): a, c, t, g, unknown or other
  misc_feature (523)..(523): n is a, c, g, or t
  modified_base (527)..(527): a, c, t, g, unknown or other
  misc_feature (527)..(527): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagaagcaacttagcctggtaccagcagaaacctggccaggctccaggctcctcatctatggtncatcccaccgagggcccacgtgggtcgtccccaggccctaggttccaggtggcaggtgggtctggggacagagttcactctcaccatcagcagcctgcagtctagaagtattttgcttagttttattattgtcagctagtataagtaacgtggtccttcggtggtacgttcggaccgaagggacctaaggtgaaatacgaaacgtatggtgctgactacatctntctntac

SEQ ID NO: 185042 - DNA, 562 bp, Homo sapiens
  misc_feature: GYAE6OF01C20BF.14.23.C01.1.454.CMB.1.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (558)..(558): a, c, t, g, unknown or other
  misc_feature (558)..(558): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaacctggccaggcctccaggcctcctnatctatggtgcatcccaccgagggccacgtggtcgtccccatccaggtttcaggtggctaggtggggtctggggacaggagtttcactctcaccatcagcagcctgctagtctagaagtattttgctagttttattattgtcagtctagtataataacttggccttcgtggaacgttcggaccgtaaacgggaccgtaagggtacggtaaaataccgaaacgaacgtggtacggcgtagaccgtaacctagttaccttgttccgttntacc

SEQ ID NO: 185043 - DNA, 596 bp, Homo sapiens
  misc_feature: GYAE6OF01BXTGF.14.23.C01.1.454.CMB.1.raw
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
  modified_base (362)..(362): a, c, t, g, unknown or other
  misc_feature (362)..(362): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcaggggccagtcagagtgtagaagcaacttagcctggtaccagcagaacctggccaggctcccaggctcctcatctatggtncatccacagggccagtggtcgtcccagccaggttcaggtggcaggtgggtctgggacaggngttcactctacaccatcagcagcctgcagtctagaagtattttgcttagttttattagttgtacagtctagttaataataacgttcggacccttccggtacgggtaccgtttccggaccgtaaacggggtaaccgtaagggttacggaaacgttaaccgaaaaccggtaacgttagggtacggtaccgtaggaaccctacccgtaattccgttacgttccgtttaccgtaaccg

SEQ ID NO: 185044 - DNA, 512 bp, Homo sapiens
  misc_feature: GYAE6OF01EO2U9.14.23.C01.1.454.CMB.1.raw
  modified_base (321)..(321): a, c, t, g, unknown or other
  misc_feature (321)..(321): n is a, c, g, or t
  modified_base (486)..(486): a, c, t, g, unknown or other
  misc_feature (486)..(486): n is a, c, g, or t
  modified_base (501)..(501): a, c, t, g, unknown or other
  misc_feature (501)..(501): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctccaggctcctcatctatggtgcatccaccagggcccatggtntcccagccaggttcagtggcaggtgggtctgggacaggagttcactctcaccatcagcagcctgcagtctagaagtattttgctagttttattattgtcagtcagtataataactgcctcgtggacgttcggaccaagggaccaaggtgaaatcgaaacgtaacngtggctgacaccatntcgtctcgtac

SEQ ID NO: 185045 - DNA, 498 bp, Homo sapiens
  misc_feature: GYAE6OF01C8T6C.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccacctctcctgcagggccagtcagagtgttagaagcaacttagcctggtaccagcagaaacctggccaggctcccaggctcctcatctatggtgcatccaccagggccactggtcgtcccagccaggttcagtggcagtgggtctggggacaggagttcactctcacatcagcagcctgcagtctgaagtatttgctagtttattatgtcagcagtataatactggcctcgtgacgttcggcaagggaccaaggtgaaatcgaaacgatgtggctgcacatctgtcttctac

SEQ ID NO: 185046 - DNA, 530 bp, Homo sapiens
  misc_feature: GYAE6OF01BMTMJ.14.23.C01.1.454.CMB.1.raw
  modified_base (203)..(203): a, c, t, g, unknown or other
  misc_feature (203)..(203): n is a, c, g, or t
  modified_base (422)..(422): a, c, t, g, unknown or other
  misc_feature (422)..(422): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagagcaacttagcctggtaccagcagaacctggccaggctccaggctcctcatctatggtgcatccaccagggccacgtggtctcccagccaggttcaggtggcaggtgggtctggggacagtagttcacgtctcaccatcagcagcctgcagtctagaagtattttgctagttttattattgtnagcagtataataactggccttcggtggtacgttcggacgaagggaccgaaggtggaagttacgaaacgtattggtcggctaggacacctattctcgttcgttctaccg

SEQ ID NO: 185047 - DNA, 621 bp, Homo sapiens
  misc_feature: GYAE6OF01BUHEB.14.23.C01.1.454.CMB.1.raw
  modified_base (152)..(152): a, c, t, g, unknown or other
  misc_feature (152)..(152): n is a, c, g, or t
  modified_base (205)..(205): a, c, t, g, unknown or other
  misc_feature (205)..(205): n is a, c, g, or t
  modified_base (298)..(298): a, c, t, g, unknown or other
  misc_feature (298)..(298): n is a, c, g, or t
  modified_base (309)..(309): a, c, t, g, unknown or other
  misc_feature (309)..(309): n is a, c, g, or t
tcagcgtctagtaccacgaccggtgctcgatttagtacacgtgattagggattgggggagggaactgctcagttaggacccagacggaaccatggaagccccagcgcagcttctcttcctcctgctactctggctcccagataccactgganaatagtgatgacgcagtctccagccaccctgtctgtgtcctccgaggggaaancgccacctctcctgcagggccagtcagagtgtagaagcaacttagcctaggtaccagtcaagaacctggaccaggcctacccaggcctcctanatctagtggtncatccacgtagggcctaacgttcgggtctccccaaggtcctagggtttcaggttcggctagggttcggggtcctagggggaccagggtagtttccactcgtacacctatcgaagcagcctgcagtctagaagtattttgacgttagttttattagtttgtactagtactaagttattaactaacgttcggtacccgttacgggttaggtacccggtttacggaccgaaacggggtaccgtaagggtaacggtaaacgtaccgaaaggtacgtaggtcgacgtcgactaccgtatcgtacgttcgttctaccg

SEQ ID NO: 185048 - DNA, 608 bp, Homo sapiens
  misc_feature: GYAE6OF01AI7NR.14.23.C01.1.454.CMB.1.raw
  modified_base (205)..(205): a, c, t, g, unknown or other
  misc_feature (205)..(205): n is a, c, g, or t
  modified_base (306)..(306): a, c, t, g, unknown or other
  misc_feature (306)..(306): n is a, c, g, or t
  modified_base (422)..(422): a, c, t, g, unknown or other
  misc_feature (422)..(422): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanagcccaccctctcctgcagggccagtcagagtgttagaagcaacttgcctggtaccagcaagaaacctggccaggcctcccaggcctcctcatctatggtncatcccaccgagggcccacgtggtctccccgagccctaggttcaggtcggctaggtgggtcgtgggacaggtagttcacgtctaccacatccgagcacgcctgcagtctagaagtnttttgacttagttttattattgtacagtactaagttaattaataaccgttcggtcccgttcggtacgggtaccggttcggaccgtaaacggggtaccgtaaagggtacggtaaactacgtaaaccggtaacgttaggtcggaccgtagacctaacccgtacgttaccgttcgtcctttccgtaccg

SEQ ID NO: 185049 - DNA, 544 bp, Homo sapiens
  misc_feature: GYAE6OF01AV4ZV.14.23.C01.1.454.CMB.1.raw
  modified_base (302)..(302): a, c, t, g, unknown or other
  misc_feature (302)..(302): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagcgccaccctctcctgcaggggccagtcagagtgttagaagcaacttagcctggtaccagcagaacctggccaggcctccaggctcctcatctatggtncactcccaccgagggccacgtggtcgtccccagccgtaggttcagtcggcaggtgggtctggggacaggtagttcactctcaccatcagcacgcctgctagtctagaagtattttgacttagtttattagttgtcagcagttataactaacgtggtacctcggtggtacgttccggaccgtaagggacgtaagggtaggaaagtacgaaacggtatggtggctgacacatctcgttctctac

SEQ ID NO: 185050 - DNA, 548 bp, Homo sapiens
  misc_feature: GYAE6OF01B9KPG.14.23.C01.1.454.CMB.1.raw
  modified_base (206)..(206): a, c, t, g, unknown or other
  misc_feature (206)..(206): n is a, c, g, or t
  modified_base (307)..(307): a, c, t, g, unknown or other
  misc_feature (307)..(307): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaaggggaaanagcccaccctctcctgcagggccagtcagagtgtagaagcaacttagcctggtaccagcaagaaacctggccaggcctcccaggcctcctcatctatggtncatcccacgagggccactggtctcccagccaggttcaggtggcaggtgggtctgggacaggagttcactctcacatcagcagcctgcagtctagaagtattttgactagttttatattgtacagtctaagtaataataactcggaccttccggtggtacgttcggacgaacgggtaccgaaggtaggaaatacgaaacgtaagtggtcggacgtagaccacctattacgttgtcttctacc

SEQ ID NO: 185051 - DNA, 532 bp, Homo sapiens
  misc_feature: GYAE6OF01BFIWA.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagaagcaacttagcctggtaccagcagaaacctggccaggctccaggctcctcatctatggtgcatccaccagggcccacgtggtcgtcccagccaggttcaggtggcagtggggtctggggacaggagttcacgtctcaccatcagcagcctgcagtctgaagtatttgctagttttattattgtcagtctagtaataagtaactggtccttcggtggtaccgttcgggaccgaagggaccaagggtaggaaactacgaaacgtatggtggactgactacctatctgtcttctac

SEQ ID NO: 185052 - DNA, 560 bp, Homo sapiens
  misc_feature: GYAE6OF01EA9H2.14.23.C01.1.454.CMB.1.raw
  modified_base (204)..(204): a, c, t, g, unknown or other
  misc_feature (204)..(204): n is a, c, g, or t
  modified_base (305)..(305): a, c, t, g, unknown or other
  misc_feature (305)..(305): n is a, c, g, or t
  modified_base (421)..(421): a, c, t, g, unknown or other
  misc_feature (421)..(421): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagaagcaacttagcctggtaccagcaagaaacctggccaggcctcccaggcctcctcattctatggtncactccaccgagggccacgtggtctcccagcccgtaggttcaggtggcgtaggtggggtctggggacaggtacgttcacttctacacctatcagcacgcctgctagtctagaattntttgacttagttttattattgtacagtctaagtataaatacgtcggccgttcggtaggtaccgttcggaccgaagggtaccgaaggtacggaaactacgaaacggtatggtggactgacctactatcctgttctcgtac

SEQ ID NO: 185053 - DNA, 627 bp, Homo sapiens
  misc_feature: GYAE6OF01EYHDH.14.23.C01.1.454.CMB.1.raw
  modified_base (203)..(203): a, c, t, g, unknown or other
  misc_feature (203)..(203): n is a, c, g, or t
  modified_base (290)..(291): a, c, t, g, unknown or other
  misc_feature (290)..(291): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagaagcaacttgcctggtaccagcagaaacctggccaggctccaggctcctcannctatgtgacactccaccgacggaccacgtggtcgtccgacgaccgtacggtacgtacggtcggcgtagggtcgggtcggtcgggacgaggtacgttactacttctaccacctactacacgacgacgccgtcgacgtacgtacgtagtaagttagtttagtacgttaagtttatttagtttacgtacgtacgtacgtagtaataacttaacgtacggtaccgttccggttacggtacggttaccggaccggtaacggaaccggtaaacgggtaacggaaacgtaacgtaaacgtaacgtacggtacggtacgtacgaccacactcgttcgttcgttc

SEQ ID NO: 185054 - DNA, 506 bp, Homo sapiens
  misc_feature: GYAE6OF01D4GY5.14.23.C01.1.454.CMB.1.raw
  modified_base (203)..(203): a, c, t, g, unknown or other
  misc_feature (203)..(203): n is a, c, g, or t
  modified_base (397)..(397): a, c, t, g, unknown or other
  misc_feature (397)..(397): n is a, c, g, or t
  modified_base (415)..(415): a, c, t, g, unknown or other
  misc_feature (415)..(415): n is a, c, g, or t
  modified_base (479)..(479): a, c, t, g, unknown or other
  misc_feature (479)..(479): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagaagcaacttagcctggtaccagcaagaaacctggccaggcctccaggctcctcatctatggtgcatccacagggccacgtgtcgtccagccaggttcaggtgctagtgggtctgggacagagttcactctcaccatcagcagcctgcagtctagaagtntttgctagtttattattntcagtcagtataataactgctcgtgtacgttcgacaacgggacaggtagaaatacgaaacgtanggtggctagcctacatntcgtntctac

SEQ ID NO: 185055 - DNA, 589 bp, Homo sapiens
  misc_feature: GYAE6OF01CNHE0.14.23.C01.1.454.CMB.1.raw
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgtagaagcaacttagcctggtaccagcaagaaacctggccaggcctccaggcctcctcatctagtggtncactcccaccgagggccacgtggtcgtcccagccaggttcaggtggcaggtgggtctggggacaggagttccacgtctcaacctatcagcacgcctgctagtctagaagttattttcgacttagttttattattcgtactagactagttaataacgttaacgtcggtaccgttccggtaggtaccgttcgggaccgaaacgggtaccgtaaagggtacgtaaataccgaaaacgtacgttaggtcggtactacgacctacctattccttacgttccttactaccg

SEQ ID NO: 185056 - DNA, 645 bp, Homo sapiens
  misc_feature: GYAE6OF01BVM9B.14.23.C01.1.454.CMB.1.raw
  modified_base (204)..(204): a, c, t, g, unknown or other
  misc_feature (204)..(204): n is a, c, g, or t
  modified_base (428)..(428): a, c, t, g, unknown or other
  misc_feature (428)..(428): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgttaagagctaacttagcctggtaccagcaagaaacctggccaggcctcccgaggcctcctcatctagtggtcgctactcccaaccgacgggccacgttggtcgtcccgagccaggttcaggtggcaggtcgggtctggggacaggtagttccacgtctacacctatcacgcacgctgctagtctagaagttnttttgacttaagttttattagttgtacgtagtacgtaagttaataagttaaccgtcggtacccgtttccgggtaggttaccggtttccgggaacccgtaaaggggtaacccgtaaaggggttacggtaaaaaccgtaccgaaaaaccggtacgttacgggtacggtaccgttacggaaccctaaccgttattaccgttcgttccgtttcctaacccg

SEQ ID NO: 185057 - DNA, 533 bp, Homo sapiens
  misc_feature: GYAE6OF01CT0UJ.14.23.C01.1.454.CMB.1.raw
  modified_base (204)..(204): a, c, t, g, unknown or other
  misc_feature (204)..(204): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcaggggccagtcagagtgttagaagcaacttagcctggtaccagcagaaacctggccaggcctccaggctcctcatctatggtgcactccaccgagggccacgtggtcgtcccagccgaggttcagtggcaggtggggtctgggacaggagttcactctcaccatcagcagcctgcagtctagaagtatttgctagtttattattgtcagctagtataatacgtcggtcctcgtaggtacgttcggacgtaacgggaccgaagggtacgtaaatacgaaacgtacgtggtcgctagctacgatctcgtcttctcg

SEQ ID NO: 185058 - DNA, 771 bp, Homo sapiens
  misc_feature: GYAE6OF01C2Q6Y.14.23.C01.1.454.CMB.1.raw
  modified_base (205)..(205): a, c, t, g, unknown or other
  misc_feature (205)..(205): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanacgccaccctctcctgcagggccagtcagagtgttagaagcaacttagcctggtaccagcaagaacctggccaggcctcccaggcctcctcatctagtggtgccactcccgaccgagggccacgtggtcgtcccgagccgtaggttcaggtggcgtagggtgggtctggggactaggtacgtttccacgttctaccgaactagtccgacgtcgacgtcccttagccgtaacggttccgttaaggtaaaacggtttcgttttttacggaccgttttaaggtttttttaacgttttacgttttacggttaaccgttaacggtacctttaaagggtttaaactttaaaacgtttaaaccggttccggggtttaccccgtttacccggggttacgggttaacccgggtttacccggggacccggtaaaaacgggggtaaccccgtaaaagggggttaacggtaaaaaccgtaaccggtaaaaaccggttaacggttacgggtacgggtacccttacgggaccctaacccgttacgtttaccggtttccgttcccgtttaccgttaacccg

SEQ ID NO: 185059 - DNA, 515 bp, Homo sapiens
  misc_feature: GYAE6OF01ACHW6.14.23.C01.1.454.CMB.1.raw
  modified_base (203)..(203): a, c, t, g, unknown or other
  misc_feature (203)..(203): n is a, c, g, or t
  modified_base (298)..(298): a, c, t, g, unknown or other
  misc_feature (298)..(298): n is a, c, g, or t
  modified_base (371)..(371): a, c, t, g, unknown or other
  misc_feature (371)..(371): n is a, c, g, or t
  modified_base (512)..(512): a, c, t, g, unknown or other
  misc_feature (512)..(512): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagaagcaacttagcctggtaccagcagaacctggccaggctccaggctcctcatctatggtncatccaccagggccactggtgtcccagccaggttcagtggcaggtgggtctgggacagagttcactctcaccntcagcagcctgcagtctgaagtattttgctagtttattattgtcagtctagtataataactggccttcgtggtacgttcggacgaacgggaccgaaggtaggtaatacgaaacgtaatgtcggctgacaccatctgtcttntac

SEQ ID NO: 185060 - DNA, 569 bp, Homo sapiens
  misc_feature: GYAE6OF01EAQU2.14.23.C01.1.454.CMB.1.raw
  modified_base (204)..(204): a, c, t, g, unknown or other
  misc_feature (204)..(204): n is a, c, g, or t
tcagcgtctagtaccacgaccggtgctcgatttagtacacgtgattagggattgggggaggaactgctcagttaggacccagacggaaccatggaagcccccagcgcagcttctcttcctcctgctactctggctcccagataccactggagaaatagtgatgacgcagtctccagccaccctgtctgtgtctccaggggaaangccaccctctcctgcagggccagtcagagtgttagagcaacttagcctggtaccagcagaaacctggccaggcctccaggcctcctcatctatggtgcactcccaccgagggcccacgtcggtcgtccccagcccgtaggttcaggtcgcgtaggtgggtctgggacagtagttcactctacaccatcagcagcctgcagtctagaactagttttgacttagttttattagttagtcagtctaagttaataacgtaacgtcggtaccttcggtacggtaccggttccggaccgaacgggactaagggtagaaacgtacgaaacgtataggtggtcctagacctactattacgtcttcttctaccg

SEQ ID NO: 185061 - DNA, 570 bp, Homo sapiens
  misc_feature: GYAE6OF01EPXK1.14.23.C01.1.454.CMB.1.raw
  modified_base (204)..(204): a, c, t, g, unknown or other
  misc_feature (204)..(204): n is a, c, g, or t
  modified_base (370)..(370): a, c, t, g, unknown or other
  misc_feature (370)..(370): n is a, c, g, or t
  modified_base (406)..(406): a, c, t, g, unknown or other
  misc_feature (406)..(406): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagaagcaacttagcctggtaccagcagaacctggccaggcctccaggcctcctcatctagtggtgcactcccaccgagggcccacgtggtcgtcccagcccaggttcagtggcaggtgggtctgggacaggnttcactctcacatcagcagcctgcagtctagaagtnttttgacttagttttattattgtcagctaagtactaataacgtcggtccttccggttggtacggtttccggaccgtaagggtaccgtaaggttacgtaaaagtaccgtaaaaccggtagttaggtcggacttggacctaccgtacttcgtcgttcttcgtaccg

SEQ ID NO: 185062 - DNA, 714 bp, Homo sapiens
  misc_feature: GYAE6OF01C1HA2.14.23.C01.1.454.CMB.1.raw
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
  modified_base (302)..(302): a, c, t, g, unknown or other
  misc_feature (302)..(302): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagngtgtagaagcaacttagcctggtaccagcaagaaacctggccaggcctccaggcctcctcatctatggtncatcccaccgagggccacgtggtcgtcccagccgtaggttcaggtcggctaggtcggggtctggggacaggtacgtttccacttcctaccaaccctatccgagccacggtcccttggacctacggttcctaggtaaagtttatttttcggacctttaaggtttttaactttagtttacgtaccgtaaggtacctaaaggtttaacttaaacgtttaaccggttccgggtaccccgtttaccgggttacgggtaacccgggttttaccggggacccgtaaaacggggggtacccctaaaagggggttaccggtaaaaacgttaccggaaaaaaccggttagttcgggtacgggtaccgttaacggaccctaaacccgttacttaccgtttacggttaccttttccgtaacccg

SEQ ID NO: 185063 - DNA, 529 bp, Homo sapiens
  misc_feature: GYAE6OF01EY54D.14.23.C01.1.454.CMB.1.raw
  modified_base (203)..(203): a, c, t, g, unknown or other
  misc_feature (203)..(203): n is a, c, g, or t
  modified_base (375)..(375): a, c, t, g, unknown or other
  misc_feature (375)..(375): n is a, c, g, or t
  modified_base (524)..(524): a, c, t, g, unknown or other
  misc_feature (524)..(524): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccaacagaaacctggccaggcctcccaggctcctcatctatggtgcatccaccgagggccacgtggtctcccagcccaggttcaggtggcaggtgggtctgggacagtagttcactcncacatcagcagcctgcagtctgaagtatttgctagtttattattgtctagcaagtataataactggcctcgtggacgttcggaccgaagggaccgaagggtacgaaagtacgaaacgtacgtgtcggctagctacgatctgttcttcgnttccg

SEQ ID NO: 185064 - DNA, 618 bp, Homo sapiens
  misc_feature: GYAE6OF01EEFFN.14.23.C01.1.454.CMB.1.raw
  modified_base (203)..(203): a, c, t, g, unknown or other
  misc_feature (203)..(203): n is a, c, g, or t
  modified_base (431)..(431): a, c, t, g, unknown or other
  misc_feature (431)..(431): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagaagcaacttagcctggtaccagcagaaacctggccaggctccaggcctcctcatctatggtgcatccaccgagggccactggtgtcccagccaggttcaggtcggcaggtgggtctggggacaggtagttcacgtctacaccatcagcagcctgctagtctaggaatagttttgctaagttttattatttgtntagtctaagttaattaaataaccgtggtacccgttccggttacgggtaacggtttccgggacccgtaaacggggtacccgtaaaggggtacgggtaaaacttaccggaaaaaccggtaacgttgggtacgggtaccgttaggaccctaacccgtaacgttccgtttacggtttcccttacgtaaccg

SEQ ID NO: 185065 - DNA, 552 bp, Homo sapiens
  misc_feature: GYAE6OF01D1M9N.14.23.C01.1.454.CMB.1.raw
  modified_base (204)..(204): a, c, t, g, unknown or other
  misc_feature (204)..(204): n is a, c, g, or t
  modified_base (300)..(300): a, c, t, g, unknown or other
  misc_feature (300)..(300): n is a, c, g, or t
  modified_base (402)..(402): a, c, t, g, unknown or other
  misc_feature (402)..(402): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgtagaagcaacttgcctggtaccagcaagaaacctggccaggctccaggcctctcatctatggtncatccacgagggcctacgtggtctcccagcctaggttcagtggcaggtgggtctgggacagtcgttcactctcacatcagcagcctgctagtctagaagttnttttcgcttagttttattagttcgtcagtctaagttaataactacgtcggtccttcggtcggtacgttcggacggtaagggaccgtaagggtacgaaatacgaaaacgtacgtaggtcggactacgactaccacttcgtgttctctaccg

SEQ ID NO: 185066 - DNA, 598 bp, Homo sapiens
  misc_feature: GYAE6OF01APGEN.14.23.C01.1.454.CMB.1.raw
  modified_base (203)..(203): a, c, t, g, unknown or other
  misc_feature (203)..(203): n is a, c, g, or t
  modified_base (364)..(364): a, c, t, g, unknown or other
  misc_feature (364)..(364): n is a, c, g, or t
  modified_base (397)..(397): a, c, t, g, unknown or other
  misc_feature (397)..(397): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggtcctcctcatctagtggtcgcactcccacgacggccacgtggtctcccgagccgtaggtcaggtcgcgtaggtggtcgngggacaggtcgtcactctcacatcagcacgtcngtcagtcgtagaagttattttgacttagtttattagttgtcgagtctaagttaattaacgtaacgtccggtccttaccgggttacggtaccggttaccgggaccgaaacgggtaccgtaagggttaacgtaaacgtaacgaaaacggtacgttaggtaggtacgtacgaccgtaacctacgttattcgttccttcgttacc

SEQ ID NO: 185067 - DNA, 572 bp, Homo sapiens
  misc_feature: GYAE6OF01C26KH.14.23.C01.1.454.CMB.1.raw
  modified_base (203)..(203): a, c, t, g, unknown or other
  misc_feature (203)..(203): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
  modified_base (401)..(401): a, c, t, g, unknown or other
  misc_feature (401)..(401): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccacctctcctgcagggccagtcagagtgttagaagcaacttagcctggtaccagcaagaacctggccaggctcccaggcctcctcatctatggtgcatcccacgagggccacgtggtctcccagcccaggttcaggtggctaggtgggtctgggacnggagttcactcncacatcagcagctgcagtctagaagtntttgctagtttattatgtctagactagttaattaactaacgtcggtacccttcggtcgggtacgtttaccggaccgtaacgggtaccgtaagggtacggtaaaacgtacgtaaaacggtaacgttaggtcggactacgacctaaccgtattacttacgttcgttctaaccg

SEQ ID NO: 185068 - DNA, 506 bp, Homo sapiens
  misc_feature: GYAE6OF01BPPHY.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccatccaggttcagtggcagtgggtctggggacagagttcactctcaccatcagcagcctgcagtctgaagtattttgctagtttattattgtcagcagtataataactggcctcgtggacgttcggacaagggaccaaggtggaaatcgaaacgactgtggctgcaccatctgtcttctac

SEQ ID NO: 185069 - DNA, 535 bp, Homo sapiens
  misc_feature: GYAE6OF01C8W4R.14.23.C01.1.454.CMB.1.raw
  modified_base (203)..(203): a, c, t, g, unknown or other
  misc_feature (203)..(203): n is a, c, g, or t
  modified_base (530)..(530): a, c, t, g, unknown or other
  misc_feature (530)..(530): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggaccagcagaaacctggccaggctccaggctcctcatctatggtgcatccaccaggggccacgtggtcgtcccagccaggttcagtggcagtgggtctggggacagagttcactctcaccatcagcagcctgcagtctgaatattttgctagttttattattgtcagctaatataataactggtcctccggtggtacgttcgggccgaaacgggacctaagggtaggtaaactaccgaaaacggtactggtaggcttgaccactatctagtccttntaccg

SEQ ID NO: 185070 - DNA, 618 bp, Homo sapiens
  misc_feature: GYAE6OF01DE038.14.23.C01.1.454.CMB.1.raw
  modified_base (204)..(204): a, c, t, g, unknown or other
  misc_feature (204)..(204): n is a, c, g, or t
  modified_base (318)..(318): a, c, t, g, unknown or other
  misc_feature (318)..(318): n is a, c, g, or t
  modified_base (454)..(454): a, c, t, g, unknown or other
  misc_feature (454)..(454): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcagggccagtcagagtgttagaagctaacttagcctaggtaccagcaagaaaccgtggaccagggcctcccgaggtcctccctcagttctagtggtcnccactcccaccgacgggcccacgtggtcgtcccagcctaggttcaggtcggacagggttggggtctaggggaactaggtagtttccacttcctacaccctatccgaagcacgccctagcgtagttcgtagaagttnttttgacttagttttattattcgtcagactagtaataattaacgtcggtcccgttacggtacgggtaccgttaccggaccggtaaacgggaacgtaagggtaacggtaaactaacccggaaagtacgtggtcggactagaccactacttctcttcgtctaaccg

SEQ ID NO: 185071 - DNA, 566 bp, Homo sapiens
  misc_feature: GYAE6OF01BWZED.14.23.C01.1.454.CMB.1.raw
  modified_base (204)..(204): a, c, t, g, unknown or other
  misc_feature (204)..(204): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagaagcaacttagcctggtaccagcagaaacctggccaggctccaggctcctcatctatggtgcatcccaccgagggccacgtggtcgtccccagccctaggttcaggtggcgaggtgggtctgggacaggagttcactctcaccatcagcagcctgcagtctagaagtatttgactagtttatagttgtctagtctagtaataataacgtcggtaccttcggtaggtaccgttcggaccgtaagggaccgtaagggtacggaaaactacgaaaacggtacgttggtcggactacgacctaacctattaccgtggttccttccgtacg

SEQ ID NO: 185072 - DNA, 571 bp, Homo sapiens
  misc_feature: GYAE6OF01CYJ06.14.23.C01.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
  modified_base (418)..(418): a, c, t, g, unknown or other
  misc_feature (418)..(418): n is a, c, g, or t
  modified_base (555)..(555): a, c, t, g, unknown or other
  misc_feature (555)..(555): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagcccaccctctcctgcagggccagtcagagtgtagagcaacttgcctggaccagcaagaacctggccaggcctccaggcctcctcatctatggtncatcccaccgaggggccacgtcgggtctccccagcccgtaggttccaggtggactaggtgggtctggggacaggtacgttcacttctcaccatcagcagcctgcagtctagtaaagttnttttagtatttattattgctagtctaagttaataagtaacgtggtcccttacggtggtaccgttcggacgtaggggaacctaagggtacgaaaactacgaaaacggtactggtaggtctcgacctacgtattacgtnttccttctcgttcccg

SEQ ID NO: 185073 - DNA, 540 bp, Homo sapiens
  misc_feature: GYAE6OF01BMTUP.14.23.C01.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
  modified_base (364)..(364): a, c, t, g, unknown or other
  misc_feature (364)..(364): n is a, c, g, or t
tcagcgtctagtaccacgaccggtgctcgatttagtacacgtgattagggatttggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtncatccaccgagggccacgtggtcgtcccagccaggttcaggtggcaggtgggtctgggacagngttcactctcaccatcagcagcctgcagtctgaagtattttgctagtttattattgtcagtctagttaataataactggtcccttccggtcggtacggttcggaccgaacgggacctaagggtaggaaactacgaaacgtaactaggtggactgaccaccatctcgttcttcgtac

SEQ ID NO: 185074 - DNA, 512 bp, Homo sapiens
  misc_feature: GYAE6OF01AV936.14.23.C01.1.454.CMB.1.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (401)..(401): a, c, t, g, unknown or other
  misc_feature (401)..(401): n is a, c, g, or t
  modified_base (415)..(415): a, c, t, g, unknown or other
  misc_feature (415)..(415): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctnatctatggtncatcccacagggccactggtctcccagccctaggttccagtggcaggtgggtctgggacagagttcactctcaccatcagcagcctgcagtctagaagtntttgctagtttatntgtcagctagtataataactcggcctcggtgtacgttcgacgaaggaccaaggtagaaatcgaaacgatgtggactgactaccatctcgtcttctac

SEQ ID NO: 185075 - DNA, 608 bp, Homo sapiens
  misc_feature: GYAE6OF01A7IFO.14.23.C01.1.454.CMB.1.raw
  modified_base (203)..(203): a, c, t, g, unknown or other
  misc_feature (203)..(203): n is a, c, g, or t
  modified_base (306)..(306): a, c, t, g, unknown or other
  misc_feature (306)..(306): n is a, c, g, or t
  modified_base (317)..(317): a, c, t, g, unknown or other
  misc_feature (317)..(317): n is a, c, g, or t
  modified_base (396)..(396): a, c, t, g, unknown or other
  misc_feature (396)..(396): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccacctctcctgcagggccagtcagagtgttaagaagcaacttagcctggtaccagcaagaaacctggcccaggcctcccaggcctcctcatctatggtcncatcccaccgnggccacgtggcgtcccagccaggttcagtggctagtgggtctggacagtacgttcactctacaccgatcgagcagtccngctagtcgtagaacgtattttcgacttagtttacttattcgtcaagtctaagttaataataacgtcggtaccgtacggtggttaccggttcgggacctaacggggtacctaaagggttacggaaaacgttaccgaaaacgggtacttagggtaccggtaccgttacgaacccggtaaccctagtttacccgttaggttacccttaccgtacg

SEQ ID NO: 185076 - DNA, 616 bp, Homo sapiens
  misc_feature: GYAE6OF01C0BZZ.14.23.C01.1.454.CMB.1.raw
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgtagaagcaacttagcctggtaccagcaagaaacctggccaggcctcccaggcctcctcatctagtggtncactccaccgagggccacgtggtcgtcccagccaggttcagtcggctaggtgggtctggggacaggtacgttcactctcacatcagcacgcctgcagtctagaagttatttgcttaagttttattagttgtactagactaagttaattaagtaaccgtcggtacccttccgggttagggtaaccggtttcccgggaccgaaacggggtaacccgtaaaggggtacggtaaaacgtaccgtaaaaaccggtaacgttagggtacggtaccgttaggaccctaaccgtactttacgtcggttccttccgtaccg

SEQ ID NO: 185077 - DNA, 644 bp, Homo sapiens
  misc_feature: GYAE6OF01E58UJ.14.23.C01.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
  modified_base (369)..(369): a, c, t, g, unknown or other
  misc_feature (369)..(369): n is a, c, g, or t
  modified_base (410)..(410): a, c, t, g, unknown or other
  misc_feature (410)..(410): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgcccaccctctcctgcagggccagtcagagtgttagaagcaacttagcctggtaccagcagaaacctggccaggctccaggctcctcatctatggtncactcccaccgagggcccacgtggtcgtcccgagccaggttcaggtcggcgaggtgggtctgggacngtagttcactctcaccatcagcacgcctgcagtctgaagtntttgcttagtttattagtttgtactaggtactagttaattaagtaacgtcggtacccgttcggtacggtacccggtttacgggacccgtaaacggggtaacccgtaaagggtaacgggtaaaacgttaacccgtaaaaaccgggtaacgttacggggttcgggtaccgttaccgggtacccgtaaacccgttaacgtttacccggttcgggtttaccctttccggtttaacccg

SEQ ID NO: 185078 - DNA, 567 bp, Homo sapiens
  misc_feature: GYAE6OF01CC9R3.14.23.C01.1.454.CMB.1.raw
  modified_base (204)..(204): a, c, t, g, unknown or other
  misc_feature (204)..(204): n is a, c, g, or t
  modified_base (310)..(310): a, c, t, g, unknown or other
  misc_feature (310)..(310): n is a, c, g, or t
  modified_base (358)..(358): a, c, t, g, unknown or other
  misc_feature (358)..(358): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccagggggaaanagcccaccctctcctgcagggccagtcagagtgtagaagcaacttagcctggaccagcagaacctggccaggctcccaggctcctcatctatggtgcatcccaacngggccacgtggtcgtcccagccaggttcagtggcagtgggctgggacngagttcactctcaccatcagcagcctgcagtctagaatatttgactagttttattagttgtacagtactaagtaataagtaacttcggaccttaccggtaggtaccggttcggaccgtaaacggggtacccaaagggttacggaaaactaccgaaaacgtacggttaggtcggtcctacgaccacgtactcgttacttccgttctaccg

SEQ ID NO: 185079 - DNA, 587 bp, Homo sapiens
  misc_feature: GYAE6OF01BGFOL.14.23.C01.1.454.CMB.1.raw
  modified_base (205)..(205): a, c, t, g, unknown or other
  misc_feature (205)..(205): n is a, c, g, or t
  modified_base (301)..(301): a, c, t, g, unknown or other
  misc_feature (301)..(301): n is a, c, g, or t
  modified_base (443)..(443): a, c, t, g, unknown or other
  misc_feature (443)..(443): n is a, c, g, or t
tcagcgtctagtaccacgaccggtgctcgatttagtacacgtgattagggattggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccacctctcctgcagggccagtcagagtgtagagcaacttagcctggtaccagcaagaacctggccaggcctccaggctcctcatctatggtcncactccaccgagggccacgtggtcgtccccagcctaggttcaggtggcaggtgggtctggggacaggtagttcactctacaccatcagcacgcctgctagtctaggtaactagttttgacttagttttatagtttgacagtntaagttaataaacgttaacgtcggtacccgttcggttaggtacgttaccggacggtaacgggtaccgtaaagggtagaaacgtacggtaaaacggtacgtaggtacggtcgtacgacctaccgtattccgtcttcgttctaccg

SEQ ID NO: 185080 - DNA, 551 bp, Homo sapiens
  misc_feature: GYAE6OF01DMPK3.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgtagaagcaacttagcctggtaccagcaagaacctggccaggctccaggctcctcatctatggtgcatcccaccagggccacgtggtctcccagccaggttcagtggcaggtgggtctgggacagagttcactctcacatcagcagcctgcagtctgaagtattttgctagtttattagtgtcagtctagttataaatacgtcggtccttccgtagggtacgttacggacgaaacgggtaaccaagggtacggaaacgtaccgaaaacgtaacgtggtacggacgttcgactacctattcttacgtccttcgtaccg

SEQ ID NO: 185081 - DNA, 624 bp, Homo sapiens
  misc_feature: GYAE6OF01B18JW.14.23.C01.1.454.CMB.1.raw
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgtagaagcaacttagcctggtaccagcagaaacctggccaggcctccaggcctcctcatctatggtncatcccaccagggccagtggtcgtcccagcctagggttcaggtcggcgaggtggggtctggggacaggtacgttcactctacaccatcagcagcctgcagtctagaagtattttgcttagtttattattgtactagtactaagttaattaacgtaaccgttcggtacccgttaccggttcgggtaaccggtttccgggacccgtaaacggggtaacccgtaaagggttacgggaaaacgttaccgaaaaccggtaacggttaggtacgggtaccttacggacccgtaacccgtacgttaccgttcggttccttacgttacccg

SEQ ID NO: 185082 - DNA, 541 bp, Homo sapiens
  misc_feature: GYAE6OF01BFASV.14.23.C01.1.454.CMB.1.raw
  modified_base (204)..(204): a, c, t, g, unknown or other
  misc_feature (204)..(204): n is a, c, g, or t
  modified_base (384)..(384): a, c, t, g, unknown or other
  misc_feature (384)..(384): n is a, c, g, or t
  modified_base (410)..(410): a, c, t, g, unknown or other
  misc_feature (410)..(410): n is a, c, g, or t
  modified_base (530)..(530): a, c, t, g, unknown or other
  misc_feature (530)..(530): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgtagagcaacttagcctggtaccagcagaacctggccaggctccaggcctcctcatctatggtgcactccgaccgagggccactgggtctcccagcctaggttccaggtcggcgtaggtgggtctgggacaggtagtcactctcaaccngtcagcacgcctgcagtctagagttntttgcttagtttatattgcagtctagtataactacgtcgccttcggtagtaccgtcggaccgaacggtaccgtaaggtgaaactcgaaaacgtatacggtgctacgacgtactactcgtnttcctctaccg

SEQ ID NO: 185083 - DNA, 550 bp, Homo sapiens
  misc_feature: GYAE6OF01BM792.14.23.C01.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagaagcaacttagcctggtaccagcagaaacctggccaggctccaggctcctcatctatggtncactccacgagggccacgtgggtctcccagccaggttcaggtggcaggtgggtctggggacaggtgttcactctcaccatcagcagcctgctagtctagaagtattttgacttagttttattagttgtcagtctaagtataagtaacgtcggaccttcggtggtacgttcggaccgaacgggtaccgtaagggtaggtaaactacgaaacgtagtaggtcggactagacctacctatctgttcttcgtacg

SEQ ID NO: 185084 - DNA, 537 bp, Homo sapiens
  misc_feature: GYAE6OF01CY9RQ.14.23.C01.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
  modified_base (414)..(414): a, c, t, g, unknown or other
  misc_feature (414)..(414): n is a, c, g, or t
  modified_base (526)..(526): a, c, t, g, unknown or other
  misc_feature (526)..(526): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgcctgtgtctccgaggggaaanagccaccctctcctgcagggccagtcagagtgttagaagcaacttagcctggaccagcaagaaacctggccaggctcccaggctcctcatctatggtncatcccaaccgagggccacgtggtcgtcccagccaggttcagtggcaggtgggtctggggactaggacgtttcactctaccacctatcagcagccctgctagtctagaattntttcgctagttttattatgtacagctaagttataatactggtccttcggtgacgttcggacaacgggaccaaggtagaaactacgaaacgattggtcgcgtagacctacatntcgtcttctac

SEQ ID NO: 185085 - DNA, 575 bp, Homo sapiens
  misc_feature: GYAE6OF01AV41E.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaangccaccctctcctgcagggccagtcagagtgttagaagcaacttagcctggtaccagcagaacctggccaggcctcccaggctcctcatctatggtgcactcccaccgagggcccacgtggtcgtccccagccgtaggttccaggtcggcaggtcgggtctggggacaggtagttccactctcaccatcagcagcctgcagtctagaagtattttgacttagtttattagttgtctagtctagtaattaagtaactcggtcccgttccggtacgggtaccgtttccgggaccgaacgggaccgtaagggtacggtaaactacgaaaccgtaagtggtcggcgtacgctacctatacgtcgttccttcgtacg

SEQ ID NO: 185086 - DNA, 590 bp, Homo sapiens
  misc_feature: GYAE6OF01AJMSK.14.23.C01.1.454.CMB.1.raw
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
  modified_base (370)..(370): a, c, t, g, unknown or other
  misc_feature (370)..(370): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaancgccaccctctcctgcagggccagtcagagtgttagaagcaacttgcctggtaccagcagaacctggccaggcctccaggcctcctcatctagtggtncactcccaccgagggcctacgtggtctcccagccgtaggttcaggtcggcagggtggggtcccgganaggtacgttcactctcaccatcagcagcctgctagtctagtaagttatttgacgttagtttattagttgtactagtactaagttaacttaacgttaacgtcggtacccgttcggtacggtaccggttcggaccgtaagggaccgtaagggtacggaaactacgaaaccgtacgtaggtcggcgtacgaccactactcgttagttccttcgtcgttccccg

SEQ ID NO: 185087 - DNA, 540 bp, Homo sapiens
  misc_feature: GYAE6OF01DIRQI.14.23.C01.1.454.CMB.1.raw
  modified_base (203)..(203): a, c, t, g, unknown or other
  misc_feature (203)..(203): n is a, c, g, or t
  modified_base (373)..(373): a, c, t, g, unknown or other
  misc_feature (373)..(373): n is a, c, g, or t
  modified_base (402)..(402): a, c, t, g, unknown or other
  misc_feature (402)..(402): n is a, c, g, or t
  modified_base (537)..(537): a, c, t, g, unknown or other
  misc_feature (537)..(537): n is a, c, g, or t
tcagcgtctagtaccacgaccggtgctcgatttagtacacgtgattagggatttggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgtagaagcaacttagcctggtaccagcaagaacctggccaggctccaggctctcatctatggtgcatccaccaggggccactggtctcccagcccagggttcaggtggcaggtgggtctggggacaggagttcacttcncaccatccagcagcctgcagtctgaagtntttgactagttttattattgtcagtctagtataaatactggtccctcggtggtacgttcggaccgtaaggggacccaagggtacggaaattaccgaaaacgtactggtcggctggacctacctagttctgtcttntac

SEQ ID NO: 185088 - DNA, 665 bp, Homo sapiens
  misc_feature: GYAE6OF01DP2VM.14.23.C01.1.454.CMB.1.raw
  modified_base (205)..(205): a, c, t, g, unknown or other
  misc_feature (205)..(205): n is a, c, g, or t
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaancgccaccctctcctgcagggccagtcagagtgtagagcaacttgctggaccagcaagaacctggccaggcctccgaggctccncattctagtggtncactcccaccgagggccagtggtctcccagcctaggttcaggtcggctagggtggggtctaggggactaggtacgtttcaccttccgtacaaccctattccaggaccacggtcccttaggacctaggttaccttaagggtaaacgtttactttttcggaaccgttttaaggttttttaacttaacggtttcgtactaaggtacgttaaagttaaacttaaacgttaaccgttcgggacccctttacggggtaacgggttaccggtttaccgggaaccgtaaaggggtaaccctaagggttacggaaaacttacggaaaacggtagtggtcggactacgacacctatcgttcgtaccttctaccg

SEQ ID NO: 185089 - DNA, 542 bp, Homo sapiens
  misc_feature: GYAE6OF01BB66R.14.23.C01.1.454.CMB.1.raw
  modified_base (204)..(204): a, c, t, g, unknown or other
  misc_feature (204)..(204): n is a, c, g, or t
  modified_base (524)..(524): a, c, t, g, unknown or other
  misc_feature (524)..(524): n is a, c, g, or t
  modified_base (535)..(535): a, c, t, g, unknown or other
  misc_feature (535)..(535): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccagggggaaanagccaccctctcctgcagggccagtcagagtgttagaagcaacttagcctggtaccagcagaacctggccaggctcccaggcctcctcatctatggtgcatccaccagggccacgtggtctcccagccaggttcaggtggcaggtggggtctggggacaggtacgttcactctcaccatcagcagcctgcagtctagaagtattttgcttagtttacttacgtgtcagtcgaggcgggactaagttcggccgtctcgtacgttccggggcgggggtactagggtggtacgttacgaaaccggtcgtggtggctagcactntctgttcttcncttcccg

SEQ ID NO: 185090 - DNA, 537 bp, Homo sapiens
  misc_feature: GYAE6OF01EC01U.14.23.C01.1.454.CMB.1.raw
  modified_base (203)..(203): a, c, t, g, unknown or other
  misc_feature (203)..(203): n is a, c, g, or t
  modified_base (362)..(362): a, c, t, g, unknown or other
  misc_feature (362)..(362): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctccaggctcctcatctatggtgcatccaccgagggccactggtctcccagccaggttccagtggcaggtgggtctgggacaggngttcactctcaccatcagcacgcctgcagtctagaagtattttgctagtttattattgtcagtctagtataataactcggccttcgtcggtacgttcggaccgaagggaccaaggtacggaaagtacgaaacgtaacgttggtcggactgacctaccattacctgttcttctacc

SEQ ID NO: 185091 - DNA, 662 bp, Homo sapiens
  misc_feature: GYAE6OF01CZ98L.14.23.C01.1.454.CMB.1.raw
  modified_base (206)..(206): a, c, t, g, unknown or other
  misc_feature (206)..(206): n is a, c, g, or t
  modified_base (304)..(304): a, c, t, g, unknown or other
  misc_feature (304)..(304): n is a, c, g, or t
  modified_base (335)..(335): a, c, t, g, unknown or other
  misc_feature (335)..(335): n is a, c, g, or t
  modified_base (394)..(394): a, c, t, g, unknown or other
  misc_feature (394)..(394): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtctccagcccaccctgtctgtgtctccgaggggaaanacgcccaccctctccgtgcgagggccagtcagtagtgtagagctaacttgccgttggaccagcaacgaaacctggaccaggcctcccgaggcctcctnattcctaagtcggtacgcactcccgaaccgngggcccaagttcgggtcaccccgtagacccgtaggttcaggttcggcaggttgggtccnggggaacctaggagttccactcgtacacaatcgagcacgctgctaagtctagtaaacgttgtttgacttaaggttttctagtttgccgtaagtacttaagtaactaaattaacggttccggacccgtttcggtaacgggtaccggtttaccggaaccggtaaacgggaaaccgttaaaggggaacgtaaaacgtaccgtaaaaacggtaccgttagggtacggtcgtacggtacctaaacgcttacgtacgtttcgtaccttaaccgg

SEQ ID NO: 185092 - DNA, 554 bp, Homo sapiens
  misc_feature: GYAE6OF01DHP55.14.23.C01.1.454.CMB.1.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
  modified_base (403)..(403): a, c, t, g, unknown or other
  misc_feature (403)..(403): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcaagaacctggccaggctccaggctccncatctatggtgcatccaccgagggccacgtggtctcccagcctaggttcaggtggcaggtgggtctgggacaggtattcactctacaccatcagcagcctgcagtctagaagtntttgcttagtttattattgtcagtactagtaataagtaactcggtaccttccgtggtacgttcggacgtaacggggaaccaagggtacggaaataccgaaaacgtaacgttggtacggcttagacctaactattcgttcgtccttctaccg

SEQ ID NO: 185093 - DNA, 599 bp, Homo sapiens
  misc_feature: GYAE6OF01DRU7X.14.23.C01.1.454.CMB.1.raw
  modified_base (204)..(204): a, c, t, g, unknown or other
  misc_feature (204)..(204): n is a, c, g, or t
  modified_base (300)..(300): a, c, t, g, unknown or other
  misc_feature (300)..(300): n is a, c, g, or t
  modified_base (416)..(416): a, c, t, g, unknown or other
  misc_feature (416)..(416): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcagggccagtcagagtgtagaagcaacttagcctggtaccagcaagaacctggccaggctccagctcctcatctatggtncactcccaccgagggccacgtggtctcccagcctaggttcaggtggctaggtcgggtcgtggggacaggtagttcacgttctacaccatcagcacgcctgctagtctagtaagttnttttgacttagttttattatttgtactagtactaagttaacttaaattaacgtcggtacccgttcgggttacggtaccggttacggaccggtaaagggaccgtaaagggtacgtaaaacgtacgaaaaccggtagttaggtcggacgtagacctaccgtacttccgttcgttccttcgtaccg

SEQ ID NO: 185094 - DNA, 666 bp, Homo sapiens
  misc_feature: GYAE6OF01B8D8P.14.23.C01.1.454.CMB.1.raw
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
  modified_base (257)..(257): a, c, t, g, unknown or other
  misc_feature (257)..(257): n is a, c, g, or t
tcagcgtctagtaccacgaccggtgctcgatttagtacacgtgattagggattgggggaggaactgctcagttaggacccagacggaaccattggaagccccagcgcagcttctcttcctcctgctactctggctccagataccactggagaaattagtgatgacgcagtctccagccacctgtctgtntctcgaggggaaangccacctntccgtgcagggccagtcagtgtgtagagcaacttagcctggtaccngcagaacctggccaggctccgaggcctcctcactcgtagtggtagcacgtcccaccgagggcctacgttcggtcgtcccaggcctaggttcaggttggctaggttgggctgggaccaggtacgttcgactccgtacaccatccagcacgcctcgctacgtagtcgtaagtgttttcgactttagttttaacttagtttacgtacgtaacgttactaacggttaacttaacggttaaccgttccgggtacccgtttaacgggttcgggttaaccggtttaccgggaaccggtaaacggggttaccggtaaagggtttaacgggaaaaccttaccggtaaaacggtacgtagggttcggtaccgtacggtacgtaacccgtgtttaccgttcgtttccgttacgttacccg

SEQ ID NO: 185095 - DNA, 574 bp, Homo sapiens
  misc_feature: GYAE6OF01B6NWD.14.23.C01.1.454.CMB.1.raw
  modified_base (204)..(204): a, c, t, g, unknown or other
  misc_feature (204)..(204): n is a, c, g, or t
  modified_base (368)..(368): a, c, t, g, unknown or other
  misc_feature (368)..(368): n is a, c, g, or t
  modified_base (406)..(406): a, c, t, g, unknown or other
  misc_feature (406)..(406): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagaagcaacttagcctggtaccagcagaaacctggccaggctccaggctcctcatctatggtgcactccaccgagggccacgtggtcgtacccagccgtaggttcagtcggcaggtcgggtctgggacagngttcactctcacatcagcacgcctgcagtctagaagtntttgcttagttttatagttgtctagtctagttaataagtaactcggtaccttcggtggttacggttccggaccgtaagggtacccgtaaagggtacggtaaacgtaccgaaaacggacgttcggtacggactcggacctaccgacgttctacggttccttcgtacccg

SEQ ID NO: 185096 - DNA, 791 bp, Homo sapiens
  misc_feature: GYAE6OF01DBU27.14.23.C01.1.454.CMB.1.raw
  modified_base (206)..(206): a, c, t, g, unknown or other
  misc_feature (206)..(206): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtctccagccaccctgtctgtgtctccgaaggggaaanacgcccacctctcctgcagggccagtcagagtgtagaagcaattagctaggtaccagcaagaacctggaccaggcctcccgaggcctcctcattctagtggtcgaccaactcccacgacgggccctaacgttcgggtccgtccccgaaggtcccgtaagggtttccaagggttcgggacctaagggggtttcggggtaccgttagggggaaacctaagggtacggttttaccaacccgtttccgttaaccaacccacgttaccgaacggacccaacggtcccgttacggaccgtaaacggttccgttaaggtaaagtttacgttttttacggaaccgttttaaggtttttaaactttaagttttcggttaaccgaagttaaccgtaaagtttaaacgttaaacgttaaaccgtcgggtacccgttaccgggttaacgggtaccgtttaaccgggaaccggtaaacggggtaacccgtaaagggtaacggtaaaaacgtaccggtaaaaaccggtaacggttaggtacgggtaccgttacgaccgtaaaccgtaacgttaccgttacggttaccttcgttaacccg

SEQ ID NO: 185097 - DNA, 545 bp, Homo sapiens
  misc_feature: GYAE6OF01A5CVA.14.23.C01.1.454.CMB.1.raw
  modified_base (202)..(202): a, c, t, g, unknown or other
  misc_feature (202)..(202): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (401)..(401): a, c, t, g, unknown or other
  misc_feature (401)..(401): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccatggagaaatagtgatgacgcagtctccagccaccctgtctgtgtctccaggggaaangccaccctctcctgcagggccagtcagagtgttagaagcaacttagcctggtaccagcagaacctggccaggctcccaggctcctnatctatggtncactccacagggccacgtggtcgtccccagcccagggttcaggtggcaggtggtctgggacagacgttcactctcaccatcagcagcctgcagtctagaagtnttttcgctagtttattattgtctagtcagttataacgtaacgtcggtcctacggtacggtacgttacggaccgtaagggacgtaagggtagtaaagtacgaaacgtagtggtcggctggacctaccattcctcgttcttctacg

SEQ ID NO: 185098 - DNA, 608 bp, Homo sapiens
  misc_feature: GYAE6OF01APCJ9.14.23.C01.1.454.CMB.1.raw
  modified_base (202)..(202): a, c, t, g, unknown or other
  misc_feature (202)..(202): n is a, c, g, or t
  modified_base (303)..(303): a, c, t, g, unknown or other
  misc_feature (303)..(303): n is a, c, g, or t
  modified_base (374)..(374): a, c, t, g, unknown or other
  misc_feature (374)..(374): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccacctgtctgtgtctccaggggaaanacgccaccctctcctgcagggccagtcagagtgttagaagcaacttagcctggtaccagcagaaacctggccaggcctcccaggctcctcatctatggtcncactcccaccgaggggcccaacgtgggtctccccagccgaggttccaggtggctaggtgggtctggggacnggagttcactctcaccatcagcagcctgctagtctagaagtattttgcttagttttacttattgtactaggtctaagttaataaacgttaacgttcggtcccttaccgggttacggtaccggtttacgggacccgtaaagggggacccgtaaagggtacgggaaaactaccggaaaacgtacgtggtacggacgttacggacctaaccgtacttccgtcgtttccttacgtacg

SEQ ID NO: 185099 - DNA, 548 bp, Homo sapiens
  misc_feature: GYAE6OF01CVO3Z.14.23.C01.1.454.CMB.1.raw
  modified_base (300)..(300): a, c, t, g, unknown or other
  misc_feature (300)..(300): n is a, c, g, or t
  modified_base (404)..(404): a, c, t, g, unknown or other
  misc_feature (404)..(404): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaagagccaccctctcctgcagggccagtcagagtgtagaagcaacttagcctggaccagcaagaacctggccaggcctccaggctctcatctatggtncatccacgaggccacgtggtctcccagccaggttcaggtggcaggtgggtctggggacaggtacgttcactctacaccatcagcagctgctagtctagtaagtnttttgacttagtttatagttgtcagtcagtaataataacgtcggccttacgtggtacgttcggacgaacgggtaccgaaggtaggaaatacgaaacgtaactggtcggacgtcgactacccgtattccgttactcgttcttacc

SEQ ID NO: 185100 - DNA, 511 bp, Homo sapiens
  misc_feature: GYAE6OF01EUCFA.14.23.C01.1.454.CMB.1.raw
  modified_base (203)..(203): a, c, t, g, unknown or other
  misc_feature (203)..(203): n is a, c, g, or t
  modified_base (397)..(397): a, c, t, g, unknown or other
  misc_feature (397)..(397): n is a, c, g, or t
  modified_base (491)..(491): a, c, t, g, unknown or other
  misc_feature (491)..(491): n is a, c, g, or t
  modified_base (494)..(494): a, c, t, g, unknown or other
  misc_feature (494)..(494): n is a, c, g, or t
  modified_base (502)..(502): a, c, t, g, unknown or other
  misc_feature (502)..(502): n is a, c, g, or t
  modified_base (508)..(508): a, c, t, g, unknown or other
  misc_feature (508)..(508): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagaagcaacttagcctggtaccagcagaaacctggccaggctcccaggctcctcatctatggtgcatccaccagggccacgtggtcgtcccagccaggttcagtggcagtggtctgggacagagttcactctcaccatcagcagcctgcagtctagaagtnttttgctagtttattattgtcagactagtataataactggcctcgtggacgttcggaccaagggaccgaaggtaggaaatacgaaacgtactgngcngacacatntctctntac

SEQ ID NO: 185101 - DNA, 591 bp, Homo sapiens
  misc_feature: GYAE6OF01DU37B.14.23.C01.1.454.CMB.1.raw
  modified_base (204)..(204): a, c, t, g, unknown or other
  misc_feature (204)..(204): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgtagaagcaacttagcctggtaccagcaagaacctggccaggctccaggcctcctnatctatgggtncactccaccgagggccacgtgggtctccccagcccgtaggttccaggtcggctagggttggggtactggggaacaggtagtttccacgttcctacgacccattcagcacgcctgctagtctagaacgttattttcgacttaagttttattagttcgtactaggtctaagttaattaacttaacgtcggtacccttccggtaggtaccggttacggaccgtaaagggaccgtaaggtacggaaatacgaaaacgtacgtggtggactgacctactatccttgtctcgtacc

SEQ ID NO: 185102 - DNA, 646 bp, Homo sapiens
  misc_feature: GYAE6OF01D7Q27.14.23.C01.1.454.CMB.1.raw
  modified_base (204)..(204): a, c, t, g, unknown or other
  misc_feature (204)..(204): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgcccaccctctcctgcagggccagtcagagtgttagaagcaacttagcctggtaccagcaagaaacctggccaggcctcccaggcctcctcattctagtggtcgcactcccacgagggccacgttggtctcccagccaggttcaggtggcgtaggtcgggtcgtgggactaggtagttccacgtctcacctatcacgcacgcctgctagttctagattattttgcttaagttttattagtttcgtacgtagtactaagttaacttaaagttaaccgttcggtacccgttaccgggttagggttaccggtttaccgggaccggtaaacggggaacccgtaaaggggtaacggtaaaaagttaccggtaaaaacggtacggttagggtacgggaccttacggaaccctaccgttacttacgttccggtttacttcgttacccg

SEQ ID NO: 185103 - DNA, 569 bp, Homo sapiens
  misc_feature: GYAE6OF01DWTIU.14.23.C01.1.454.CMB.1.raw
  modified_base (366)..(366): a, c, t, g, unknown or other
  misc_feature (366)..(366): n is a, c, g, or t
  modified_base (410)..(410): a, c, t, g, unknown or other
  misc_feature (410)..(410): n is a, c, g, or t
  modified_base (561)..(561): a, c, t, g, unknown or other
  misc_feature (561)..(561): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcaagaaacctggccaggctccagctcctcatctatggtgcatcccaccgagggcccagtgggtctcccagcctaggttccagtggcaggtgggtctggggacagngttcactctcaccatcagcagcctgcagtctagaagtattttgntagttttattatgtcagactagtataaataactggtccctcggtaggtaccgttcggaccaaagggtaccgaaagggtaggaaactccgtaaaaacggtacttgggtacggtaccgtacgaccctaacccgtaattccgttagttcccttntaaccccg

SEQ ID NO: 185104 - DNA, 665 bp, Homo sapiens
  misc_feature: GYAE6OF01AHM7Z.14.23.C01.1.454.CMB.1.raw
  modified_base (204)..(204): a, c, t, g, unknown or other
  misc_feature (204)..(204): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagaagcaacttagcctggtaccagcagaaacctggcctggctccaggctcctcatctagtggtcgcactccaccgagggccacgtggtcgtcccgagcccgtagggtttccaggttcggccgtaggtcggggtcgtaggggaccaggtagtttccacttcgtaccaccatcagcagcctgcagtctagtaagtattttagcttagttttattacgttttcagtctaagttaattaaacgttaaccgttcggtacccgttccgggttacgggtaaccggtttccgggaacccggtaaacggggtaacccgtaaaggggtacggtaaaaaccgttaaccggaaaaaccgggttaacgttagggtacggtaccttacgggaccctaaccgttacgttaccgttacggtttacctttcgtaacctttccccg

SEQ ID NO: 185105 - DNA, 561 bp, Homo sapiens
  misc_feature: GYAE6OF01BVYYF.14.23.C01.1.454.CMB.1.raw
  modified_base (204)..(204): a, c, t, g, unknown or other
  misc_feature (204)..(204): n is a, c, g, or t
  modified_base (293)..(293): a, c, t, g, unknown or other
  misc_feature (293)..(293): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccacctctcctgcagggccagtcagagtgtagaagcaattagcctggtaccagcagaactggcaggctccaggctctcatctatggtncatccacagggccactggtcgtcccagccaggttcaggtggcaggtgggtctgggacaggtattcgactctcaccatcagcacgcctgcagtctagtaagtattttgctagttttattagttgtcagtctaagttaattaagtaacgtcggtacccgttccgtagggtacgttccggaccgtaaacgggacgtaagggtacggaaacttacgaaacggtaactggtacggacctagacctaacctagtacgtcgttccttacgtaccg

SEQ ID NO: 185106 - DNA, 700 bp, Homo sapiens
  misc_feature: GYAE6OF01BPXE0.14.23.C01.1.454.CMB.1.raw
  modified_base (312)..(312): a, c, t, g, unknown or other
  misc_feature (312)..(312): n is a, c, g, or t
tcagcgtctagtaccacgaccggtgctcgatttagtacacgtgattagggattggggggaggaactgctcagttaggacccagacggaaccatggaagccccagcgcagcttctcttcctcctgctactctggctcccagataccactggagaaattgtgttgacacagtctccactccaccctgttctttgtcctccgaaggggaaagcgcccaccctctcctgcgacgggccagtcagagtgtaccaacacctaacttacgccttggtttcagcagacgcctggccaggcctcccgaggtcctcctactnttggtactgatcgaccaccgtcccgacgacggcccacggcactcccgacgacccgtaggttcaggtcggactacgggccgggtcgtagggactacggtaccttacgactctaccactagtccacgcacgtaccctagacggttactaggtaaacgttacgttttacggactttaaggttttaacttacgttgtaccgaggtacggtacgggccgggtaacgttacgtccgggccctacgttccggtacgggttaccggggacggggtacgtaacggggttgtaaaccggttaaccgaaacgggtacgttcggggtggtaccgttccggacccttaaccgtcgttacccggttacgttccgttacccttaccgttcccccgttaccccg

SEQ ID NO: 185107 - DNA, 523 bp, Homo sapiens
  misc_feature: GYAE6OF01C8XPG.14.23.C01.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (299)..(299): a, c, t, g, unknown or other
  misc_feature (299)..(299): n is a, c, g, or t
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
  modified_base (422)..(422): a, c, t, g, unknown or other
  misc_feature (422)..(422): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctcncctgcagggccagtcagagtgttagaagcaacttagcctggtaccagcagaaacctggccaggctccaggctctcatctatggtncatccaccagggccactggtcgtcccagccaggttcagtgcagtgggtctgggacagngttcnctctcaccatcagcacgcctgcagtctgaagtattttgactagtttatttattgtacagntaagttataataactggccttcggtgtacgttcggaccgaagggacctaaggtaggaaatacgaaaacgtataggtggctgaccacatcttcgtcttctac

SEQ ID NO: 185108 - DNA, 584 bp, Homo sapiens
  misc_feature: GYAE6OF01C0DC8.14.23.C01.1.454.CMB.1.raw
  modified_base (202)..(202): a, c, t, g, unknown or other
  misc_feature (202)..(202): n is a, c, g, or t
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
  modified_base (366)..(366): a, c, t, g, unknown or other
  misc_feature (366)..(366): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctcaggggaaangccacctctcctgcagggccagtcagagtgttagagcaacttagcctggtaccagcaagaacctggccaggctccgagcctcctnatctagtggtcncatcccacgagggccacgtggtctacccagccaggttcaggtcggactagggtcgggctagggaacngtacgttcacgttctcaactatcagcacnctgntacgtctagtaagtgttttcgactttaagtttatttatgttacagtacgtaagttaataacttaacgtcgggtaccttcgggtacggtacggttacggacgtaaacgggacctaagggtagtaaacgtacgaaacggtaactagggtacgactacgacctaccgtattcgtacgttcttccgtac

SEQ ID NO: 185109 - DNA, 609 bp, Homo sapiens
  misc_feature: GYAE6OF01DK4MZ.14.23.C01.1.454.CMB.1.raw
  modified_base (205)..(205): a, c, t, g, unknown or other
  misc_feature (205)..(205): n is a, c, g, or t
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtctccagccaccctgtctgtgtctccgaggggaaanagcccaccctctcctgcagggccagtcagagtgtagagcaacttagcctggtacagcaagaacctggccaggcctccaggcctccncatctagtggtncatcccaccgagggccagtggtctacccagcctaggttcaggtggactagggtcgggtctggggactaggtacgttcacttctaccaacctatcagcagccctagctagtctagaagttatttgacttagttttattagttgtctagctaagtaacttaaataacgtcggtaccttcggtacgggtaccgtttccgggaccgtaaaggggtaaccctaagggtacggtaaaactaccggtaaaaacggtagttagggtacggtccgtaggacctaccgttaacttcgttacgttcccttacgtacc

SEQ ID NO: 185110 - DNA, 572 bp, Homo sapiens
  misc_feature: GYAE6OF01CVQ3G.14.23.C01.1.454.CMB.1.raw
  modified_base (204)..(204): a, c, t, g, unknown or other
  misc_feature (204)..(204): n is a, c, g, or t
  modified_base (219)..(219): a, c, t, g, unknown or other
  misc_feature (219)..(219): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (379)..(379): a, c, t, g, unknown or other
  misc_feature (379)..(379): n is a, c, g, or t
  modified_base (420)..(420): a, c, t, g, unknown or other
  misc_feature (420)..(420): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccttgtctgtgtctccagggggaaanagcccaccctttccngcagggccagtcagagtgtagaagcaacttagcctggtaccagcagaaacctggccaggctccagctcctnatctatggtncatccaccgagggcccagtggtcgtcccagccagggttcaggtggcaggtgggtctgggacaggtgttcactctcaccntcagcagcctgcagtctagaagtatttgacttagtttattnttgtcagtctaagttaataataccgtggtcccttcggtcggtacgttccggaccgtaaggggaacctaagggtacggaaactaccgaaaacggtaacgtgggtaggcctacggaccaaccgtacttacttacggttccttcgactttccccg

SEQ ID NO: 185111 - DNA, 609 bp, Homo sapiens
  misc_feature: GYAE6OF01BGXD0.14.23.C01.1.454.CMB.1.raw
  modified_base (205)..(205): a, c, t, g, unknown or other
  misc_feature (205)..(205): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanagccaccctctcctgcagggccagtcagagtgttagaagcaacttagcctggtaccagcagaaacctggccaggctcccaggctcctcatctatggtgcactcccaccgacgggccacgtggtctccccgagtcccaggttccaggtggctaggtggggtctgggacaggtagttccacgtcctacacctatccagcacgccctgcgagtctagtagtgttttgcttagttttattatttagtctagtctaagttattaacttaaccgtcggtacccttccgggttggtaccggttccgggaccgaacgggaccgtaaagggtacggtaaataccggaaaaccggtagttaggtcgggtccgtcgacccgtaactacgttacctcggtttccttccgttacccg

SEQ ID NO: 185112 - DNA, 766 bp, Homo sapiens
  misc_feature: GYAE6OF01CH0AA.14.23.C01.1.454.CMB.1.raw
  modified_base (205)..(205): a, c, t, g, unknown or other
  misc_feature (205)..(205): n is a, c, g, or t
  modified_base (312)..(312): a, c, t, g, unknown or other
  misc_feature (312)..(312): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtcctccgaggggaaanacgcccaccctctcctgcagtcggccagtcagagtgtagaagcaacttagcctggtaccagcaagaaacctggaccgaggcctcccgaggcctcctcatctatggtncactcccacgaggccacgtggtcgcccagcctaggttccaggtggcgtaggtcgggtctgggaacaggtacgtttccacgttcctaccaacctatccgaaggccacggtcccctggacctaacggttccgtaaggtaaacgtttagtttttcggaacgttttaaggtttttaattttagtttacggtacgtaacggtaaccgttaaaggtttaaacttaaaacgttaacccggttcgggttaccccgtttacccggggttaacggggttaaccccgggtttacccgggaaacccgggtaaaaccggggggtaaacccgtaaaagggggttaaacggggtaaaaaccgttaaacccggtaaaaaaccggtaaccggttcggggttaaccggtaccggttaccgggtaacccctaaccggttaaccgtttccgttcggtttaaccctttaccccgg

SEQ ID NO: 185113 - DNA, 654 bp, Homo sapiens
  misc_feature: GYAE6OF01DCOQJ.14.23.C01.1.454.CMB.1.raw
  modified_base (205)..(205): a, c, t, g, unknown or other
  misc_feature (205)..(205): n is a, c, g, or t
  modified_base (310)..(310): a, c, t, g, unknown or other
  misc_feature (310)..(310): n is a, c, g, or t
  modified_base (324)..(324): a, c, t, g, unknown or other
  misc_feature (324)..(324): n is a, c, g, or t
  modified_base (590)..(590): a, c, t, g, unknown or other
  misc_feature (590)..(590): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanacgcccaccctctcctgcagggccagtcagagtgttagaagcaacttagcctggaccagcaagaaacctggacccaggcctccgaggcctcctcatctagtggtncacggtcccaccgnggccacgtggtcgcccagccgtaggttcaggtcggcgtagggtcggggtcgtaggggaacaggtacgttccacgtcctaccgacctactcgacgcgacgtccgtcgacgtacgtctacggtaagttagttttcgactttagttttaatttagttcgttacgtagtacgtaagttaagttaacttaacggttccggtacccgttccgggttacggtaccggtttaccgggaccggtaaaccgggaaccggtaagggtaacggtaaanaccggtaaaacgtaacggtaggttcgacgtacgacgtaacctacttcgtacgttcttctacccg

SEQ ID NO: 185114 - DNA, 699 bp, Homo sapiens
  misc_feature: GYAE6OF01BFSVI.14.23.C01.1.454.CMB.1.raw
  modified_base (204)..(204): a, c, t, g, unknown or other
  misc_feature (204)..(204): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagtgttagaagcaacttagcctggtaccagcaacgaaacctggccaggcctcccaggctcctcatctatggtgcactccaccgagggccacgtcggtcgtccccaggccgtagggttccaggttcggcgtacggtcggggtcgtggggacctaggtacgtttccaaccgttccttaccaaccctagttaccgacggcctaacggtcccgtgaccgtacggttaccgttaggtaaacgtttacgtttttgaccgtttaaggttttttaacttaagttttcgtaccgtagtaccgtaaagtttaactttaaacgtaaccgttccgggtacccgttaccgggttacgggttaccgtttaccggggaccgtaaacgggaccgtaaacgggtaggtaaaacgtaaccgaaacggttacgtacggtacggtcctacggaccgtacctagttccgttagttcccttgtaaccc

SEQ ID NO: 185115 - DNA, 654 bp, Homo sapiens
  misc_feature: GYAE6OF01C69EL.14.23.C01.1.454.CMB.1.raw
  modified_base (207)..(207): a, c, t, g, unknown or other
  misc_feature (207)..(207): n is a, c, g, or t
  modified_base (314)..(314): a, c, t, g, unknown or other
  misc_feature (314)..(314): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggcctcccagataccactggagaaatagtgatgacgcagtctccagcccaccctgtctgtgtctccgaaggggaaanacgcccaccctctcctgcagggccagtcagagtgtagagctaactagcctggaccagcaagaaacctggaccaggcctacccgaggccctcctcattctagtggtcnctactcccaaccgcgggccacgtggtctccccagcctaggttcaggtggcgaggtcgggtctagggacagtagttcacctttcaccgtactactcgacgctacgccttagctaggtctagtaacgtttattttggactttaaggttttaatttagtcgttacgagtactaagttaactaagttaaccgttccggtaccgttacggtacggttacggtttacccgggaccggtaaacgggtaacccggtaaagggtaaacggtaaaacgtaacccgaaaacggtaagttccggtggtacctcggaacctaccgttacgttcgtacgttccttacgtacccg

SEQ ID NO: 185116 - DNA, 650 bp, Homo sapiens
  misc_feature: GYAE6OF01D4GET.14.23.C01.1.454.CMB.1.raw
  modified_base (205)..(205): a, c, t, g, unknown or other
  misc_feature (205)..(205): n is a, c, g, or t
  modified_base (292)..(292): a, c, t, g, unknown or other
  misc_feature (292)..(292): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
  modified_base (446)..(446): a, c, t, g, unknown or other
  misc_feature (446)..(446): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanacgccaccctctcctgcagggccagtcagagtgttagaagcaacttagcctggtaccagcagaaacctggccaggctccaggctccncatctatggtgcactccaccgagggccacgtggtcgtccccagccgtaggttcaggtcggcgtaggtgggtcgtgggacaaggtacgttcactcgtacaccgtatcagcagccctgcagtntagaagttntttcgactttagttttattagttntacgtagtactaaggttaacttaaagttaccgttcgggtacccgttacccgggttagggttaacccggtttccgggacccggtaaaacgggggtacccgtaaaagggggttacggaaaacgttaaccggtaaaaacggtacggttcggtacgggcgttaccgacctaacccgttacttccgtttagttcccttacgttaccccg

SEQ ID NO: 185117 - DNA, 641 bp, Homo sapiens
  misc_feature: GYAE6OF01BE4BA.14.23.C01.1.454.CMB.1.raw
  modified_base (204)..(204): a, c, t, g, unknown or other
  misc_feature (204)..(204): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccacctctcctgcagggccagtcagagtgttagagcaacttagcctggtaaccagcaagaaacctggccaggctccaggctcctcatctatggtgcatccaccgaggccactggtcgtcccagccagggttcaggtggcaggtgggtcgtggggacaggtagttcactccgtacaccgatacagccagcctgctagtcgtagtaacgttattttgacgtttaagtttatttaagtttggtactaaggtcctaagttaaataaagttaaaccgttcggtacccgttacccgggttacgggtaccgtttaccggggacccgtaaacggggtaacccgtaaaggggtaacgggtaaaagtaccgtaaaaaccgtaacggtacggttagggaccttagaacccgttaccacgttaccgttcttccgtttaccgtaaccc

SEQ ID NO: 185118 - DNA, 547 bp, Homo sapiens
  misc_feature: GYAE6OF01AQSHF.14.23.C01.1.454.CMB.1.raw
  modified_base (294)..(294): a, c, t, g, unknown or other
  misc_feature (294)..(294): n is a, c, g, or t
  modified_base (404)..(404): a, c, t, g, unknown or other
  misc_feature (404)..(404): n is a, c, g, or t
  modified_base (542)..(542): a, c, t, g, unknown or other
  misc_feature (542)..(542): n is a, c, g, or t
tcagcgtctagtaccacgaccggtgctcgatttagtacacgtgattagggattgggggagggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcaggggccagtcagagtgttagaagcaacttagcctggtaccagcagaaacctggccaggctcccaggctcctcntctagtggtgcatccaccaggggcccactggctccccagccaggttcaggtggcaggtgggtctggggacagagttcactcgtcaccatcagcagcctgcagtctgagtntttgctagtttacttattgtcagtctaagtaatacgttaacgtcggccttccggtggtacgttcggaccaaggggtaccgtaagggtcggtaaatacgaaacgtacgtggtgggtcctaggcctacatcgtgtccttntaccg

SEQ ID NO: 185119 - DNA, 537 bp, Homo sapiens
  misc_feature: GYAE6OF01AOPMJ.14.23.C01.1.454.CMB.1.raw
  modified_base (204)..(204): a, c, t, g, unknown or other
  misc_feature (204)..(204): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
  modified_base (502)..(502): a, c, t, g, unknown or other
  misc_feature (502)..(502): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgcccaccctctcctgcagggccagtcagagtgtagaagcaacttagcctggtaccagcagaacctggccaggcctccaggcctcctcatctagtggtgccatcccacgagggcccagtggctcccagccaggttcaggtcggctaggtgggtctgggacaggtagttcactcncacntcagcagcctgcatcagagttatttgactagtttatatgacagtctaagttataatactcggacctcggtagtaccgtcggaccgtaagggaccagggtacgaactacggaaacgtagnggtcgacgtcgactacctgtacgttctctctaccg

SEQ ID NO: 185120 - DNA, 623 bp, Homo sapiens
  misc_feature: GYAE6OF01DWLLS.14.23.C01.1.454.CMB.1.raw
  modified_base (204)..(204): a, c, t, g, unknown or other
  misc_feature (204)..(204): n is a, c, g, or t
  modified_base (314)..(314): a, c, t, g, unknown or other
  misc_feature (314)..(314): n is a, c, g, or t
  modified_base (432)..(432): a, c, t, g, unknown or other
  misc_feature (432)..(432): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgcccaccctctcctgcgagggccagtcagagtgttagagcaacttagcctaggtaccagacaacgaaacctggaccaggcctcccgaggcctcctcatcctagtggtncactcccgaccgagggccacgtggtcgtcccagccgtaggttcgaggtggctagggtgggtctaggggacaggtacgttcacctctacacatcagcacgcctgctagtctagaagttnttttagctttagttttattgtttgtacagtactaagttaacttaagtaaccgtcggtacccgttcggttacgggtaccggttcgggaccgaaacggggtacctaaggggtacgaaaacgtaaccggaaacggtaagtcgggtcggtaccgtacgaccgtaactacgttccgttacgtttccttcgtacccg

SEQ ID NO: 185121 - DNA, 566 bp, Homo sapiens
  misc_feature: GYAE6OF01BDUW9.14.23.C01.1.454.CMB.1.raw
  modified_base (204)..(204): a, c, t, g, unknown or other
  misc_feature (204)..(204): n is a, c, g, or t
  modified_base (406)..(406): a, c, t, g, unknown or other
  misc_feature (406)..(406): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagaagcaacttagcctggtaccagcagaaacctggccaggcctccaggctcctcatctatggtgcatcccaccgagggccacgtggtcgtcccagccaggttcaggtcggcaggtgggtctggggacaggagttcactctcaccatcagcagcctgcagtctgtaagtntttgcttagtttattattgtctagctaagttactaataacgtcggccgttccggtggtacggttcggaccgaagggaccgtaagggtacggaaaataccgaaacgtacgttaggtcggtaccgtagaccctacgtacgttccttagttccttacgtcccg

SEQ ID NO: 185122 - DNA, 845 bp, Homo sapiens
  misc_feature: GYAE6OF01AIG52.14.23.C01.1.454.CMB.1.raw
  modified_base (209)..(209): a, c, t, g, unknown or other
  misc_feature (209)..(209): n is a, c, g, or t
  modified_base (219)..(219): a, c, t, g, unknown or other
  misc_feature (219)..(219): n is a, c, g, or t
tcagcgtctagtaccacgaccggtgctcgatttagtacacgtgattagggattgggggagggaacgtggctcagttaggacccagacggaaccatggaagccccagcgcagcttctcttcctcctgctactctggctcccagactaccactggagaaatagtgaatgacgcagtctccagccacctgtctgtgtctccgaggggaaacncgccaccctntcctgccgagggccagtcagagtcgttaagacgcaacgttagcctaggtaccagccgtagaaaacccttggacccaagggtccctaccgaaggtccttccctacgaacgttccctagtttcgggtcgaccaagttcccccgaacccgaggggtacccctaacgtttcggggttccgtaccccctaagggccgtttaacggttccgaagtccggggtacaaccggggtttcggggaaccccgggtaactaagggttaccgtttaccgaaccgtttacctacccggtaaaccccggtaatttcccgaaacgggtccgtaaccgtcccggtttaaccggcccgtaaggttacccgttaacggaaagggtttactttttaccggacgtttacgggtttttaactttaacggttcgttacccgaaggttccttaaggtttaaaaccgttaacttaccggttaaccggtaccccgttacgggtttaccgggtaacgttccggttaacccgggaacggtaacccggtaaaggtaacggttaaaacccgtaagaaaaaccggttcgtaagggttcggaaccgtgtaaccccgttacaaacgttttcgacgtttccgtttaaagcccggtttacc

SEQ ID NO: 185123 - DNA, 565 bp, Homo sapiens
  misc_feature: GYAE6OF01EJVLU.14.23.C01.1.454.CMB.1.raw
  modified_base (205)..(205): a, c, t, g, unknown or other
  misc_feature (205)..(205): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngcccaccctctcctgcagggccagtcagagtgttaagagcaacttagcctggtaccagcagaaacctggccaggctccaggcctcctcattctatggtgcactcccaccgacggggccacgtggtcgtcccagccaggttcaggtggcaggtgggtcgtggggacaggtacgttcactctccacatcacgcagccctgctagtctagaagtattttgcttagttttattagttgtcagctagtaataataacgtggcctacggtggtaccgttcggaccgaagggaccgaagggtacgaaacgttacgaaaccgtagttggtcggctacggacctacctatccgtagttccttcgtaccg

SEQ ID NO: 185124 - DNA, 596 bp, Homo sapiens
  misc_feature: GYAE6OF01CNT5N.14.23.C01.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagaagcaacttagcctggtaccagcaagaacctggccaggctccaggcctcctcatctatggtncatccaccgagggccacgtggtctcccagcctaggttcaggtggcaggtgggtctgggacaggacgttcacgtctcacctatcagcagcctgcagtctagaagtattttgacttagtttattattgtctagtctaagttaataataacgtcggtaccttccggtaggtaccggttaccggaccgaaacgggaccgtaaagggtacggtaaacgtaccgtaaaaccggtaacgttggtacggtaccgtacgacccgtaaccctacgttaccgttacggttcctttaccgtacccg

SEQ ID NO: 185125 - DNA, 599 bp, Homo sapiens
  misc_feature: GYAE6OF01AMBDC.14.23.C01.1.454.CMB.1.raw
  modified_base (207)..(207): a, c, t, g, unknown or other
  misc_feature (207)..(207): n is a, c, g, or t
  modified_base (209)..(209): a, c, t, g, unknown or other
  misc_feature (209)..(209): n is a, c, g, or t
  modified_base (217)..(217): a, c, t, g, unknown or other
  misc_feature (217)..(217): n is a, c, g, or t
  modified_base (442)..(442): a, c, t, g, unknown or other
  misc_feature (442)..(442): n is a, c, g, or t
  modified_base (446)..(446): a, c, t, g, unknown or other
  misc_feature (446)..(446): n is a, c, g, or t
  modified_base (453)..(453): a, c, t, g, unknown or other
  misc_feature (453)..(453): n is a, c, g, or t
  modified_base (467)..(467): a, c, t, g, unknown or other
  misc_feature (467)..(467): n is a, c, g, or t
  modified_base (476)..(476): a, c, t, g, unknown or other
  misc_feature (476)..(476): n is a, c, g, or t
  modified_base (557)..(557): a, c, t, g, unknown or other
  misc_feature (557)..(557): n is a, c, g, or t
tcagcgtctagtaccacgaccggtgctcgatttagtacacgtgattagggagttgggggagggaacgtgctcagttaggacccagacggaaccatggaagccccagcgcagcttctcttcctcctgctactctggctcccagactaccactggagaaatagtgatgacgcagtctccagccaccctgtctgtgtctccaggggaaancnccaccctntcctggcagggccagtcagagtcgttagaagccaagttgcctggtaccagtcaagaaacctggccaaggcctacccgaggtcctcccgtctattccgtagtcgggtcgctacgtcccaacggacgggtcccacgttgggtctccccgataccgtaggttccaggtacggctagggtcgggtcgtgggactagtgttccactctcactagtcgagctacgcctgcngtcngtaagtntttagcttagtttntagttcganagatagtaatataacgtggtaccttcgtaggtacgttcgacgaacggttacgaggtacggtaactaccggaaacgtacggngtcggtacgtgacccgtactacgttgttcccgtgttctaccg

SEQ ID NO: 185126 - DNA, 729 bp, Homo sapiens
  misc_feature: GYAE6OF01BP9FH.14.23.C01.1.454.CMB.1.raw
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctccngcagggccagtcagagtgcaacaccaacttagccttggttcagcagacgcctggccaggcctccgaggcctcctcatgtatgatcgcactcccagacgggcccaccggcacgtcccagtccgtaggttcaaggtcggacgacgggtcgggtctaggggaacctacggttacctttccgaacgtttcccacaaccctataccgagtaccgacggtacccgttaaggacgttaccgttaggtaaacggtttatttttacggaacttttaaggtttttaacttttaccgttacgggttacgttacggaccgtaacggggtaccggggtacttaacggtttcggggtaccccgttaccgtttaccggttaacccggggtttccgggggaacccgggggggtaaccgttaaggggtaccgggtaaacggtttaaccggaaaaccggttaacggttcgggtcgggtaccgtcggtaccgtaaccgtacttacggttacgtttacttcggttaacccg

SEQ ID NO: 185127 - DNA, 558 bp, Homo sapiens
  misc_feature: GYAE6OF01D8A76.14.23.C01.1.454.CMB.1.raw
  modified_base (204)..(204): a, c, t, g, unknown or other
  misc_feature (204)..(204): n is a, c, g, or t
  modified_base (413)..(413): a, c, t, g, unknown or other
  misc_feature (413)..(413): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagtgttagaagcaacttagcctggtaccagcaagaacctggccaggctccagctcctcatctatggtgcactccaccgagggccacgtggtcgtcccagccgtaggttcaggtggcgtaggtgggtctggggacagtgttcacgtctacaccatcagcacgcctgctagtctagaagttnttttgacttagttttattagttgtactagtctaagttaactaagtactggtccgttacggtggtacgttcggacgaacgggtacgtaaagggtagaaactacgtaaacgtagtcggtggactgacctactatctcgttctcgtac

SEQ ID NO: 185128 - DNA, 579 bp, Homo sapiens
  misc_feature: GYAE6OF01B0U4D.14.23.C01.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
  modified_base (425)..(425): a, c, t, g, unknown or other
  misc_feature (425)..(425): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagaagcaacttagcctggtaccagcagaacctggccaggcctccaggcctcctcatctatggtcncatccaccgacgggccacgtgggtcgtcccagccgtagggttcaggtggctagggtcgggtcgtggggactaggtacgtttcacttctaccaccatcagcagtcctgcagttctagtaagttnttttgacttagttttattagttgtcagtctagttaataagtaacgttcggccttcggtgtacggttcggaccgtaacgggaccgtaagggtacggaaacgtacgaaacgtaacgtggtcggactggacctaccgtattctcgttccttcgtacc

SEQ ID NO: 185129 - DNA, 662 bp, Homo sapiens
  misc_feature: GYAE6OF01BOAJP.14.23.C01.1.454.CMB.1.raw
  modified_base (204)..(204): a, c, t, g, unknown or other
  misc_feature (204)..(204): n is a, c, g, or t
  modified_base (303)..(303): a, c, t, g, unknown or other
  misc_feature (303)..(303): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcgagggccagtcagagtgttagagcaacttagcctggtaccagcaagaacctggccaggcctccaggcctcctcatctatggtncactccacgacggccacgtgtcgtcccagccgtaggttcaggtcggcgaggttcggggtcgtagggacaggtacggttcactcctacgaccatcagcacgcctgactagttccgtaggtaacgttagttttacgacgtttaagttttaatttacgtttcgtacgtaacgtactaaagtttactaaacgttaaacgttccgggtcccgttaccggttcggggttaacccgttaccggggaacccggtaaacggggtaaccgaaaggggttaacgtaaaaacgtaaccggtaaaacgtaacggttgggtaccgggactacggaccctaccgttacgttcttaccggtttcttcctaccccg

SEQ ID NO: 185130 - DNA, 551 bp, Homo sapiens
  misc_feature: GYAE6OF01BTPE4.14.23.C01.1.454.CMB.1.raw
  modified_base (203)..(203): a, c, t, g, unknown or other
  misc_feature (203)..(203): n is a, c, g, or t
  modified_base (410)..(410): a, c, t, g, unknown or other
  misc_feature (410)..(410): n is a, c, g, or t
  modified_base (422)..(422): a, c, t, g, unknown or other
  misc_feature (422)..(422): n is a, c, g, or t
  modified_base (424)..(424): a, c, t, g, unknown or other
  misc_feature (424)..(424): n is a, c, g, or t
  modified_base (433)..(433): a, c, t, g, unknown or other
  misc_feature (433)..(433): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagagcaacttagcctggtaccagcagaaacctggccaggctccaggctcctcatctatggtgcatccaccagggccactggtcgtcccagcctaggttccaaggtcggctaggtcgggtctgggactaggtagttcacgtctcaccgatcagcagcctgcagtctagaacgtntttgctagtttntnttgtcagtnagtataagtactcgcctggtacggtacgtcggaccgaagggtacctaagggtacgtaaatacgaaacgtagtacggttcggacgtagaccgtacctacgttctacgtcttcgtaaccg

SEQ ID NO: 185131 - DNA, 649 bp, Homo sapiens
  misc_feature: GYAE6OF01C5XFE.14.23.C01.1.454.CMB.1.raw
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (304)..(304): a, c, t, g, unknown or other
  misc_feature (304)..(304): n is a, c, g, or t
  modified_base (314)..(314): a, c, t, g, unknown or other
  misc_feature (314)..(314): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaaggggaaangcccaccctcncctgcagggccagtcagagtgtagagcaacttagcctggtaccagcaacgaacctggccaggcctccaggcctcctcatctagtgtncatcccacgnggccacgtggtctccagcctaggttcagtggctagggtcgggctaggggactagggtacgtttaccacgtttcaccgtaacctatccgagccacgccgtggacctaggtccttaggtaacgttattttcggactttaaggttttatttagtacgttcgtaagtactaagttaacttaaacttaacgttcggtacccgttacggttacggggtaccgtttacccgggaccgtaaacggggtaacccgtaaagggtacggaaaacgtaaccgtaaaacggtaccgttaggtcggacgtacgaccctaaccgtattccgttactccgtttacctaccg

SEQ ID NO: 185132 - DNA, 689 bp, Homo sapiens
  misc_feature: GYAE6OF01CK8Z3.14.23.C01.1.454.CMB.1.raw
  modified_base (207)..(207): a, c, t, g, unknown or other
  misc_feature (207)..(207): n is a, c, g, or t
  modified_base (314)..(314): a, c, t, g, unknown or other
  misc_feature (314)..(314): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtcctccgaaggggaaanacgcccaccctctcctgcagggccagtcagagtgtagaagcaacttagcctggtaccagacaagaaacctggccaggcctacccgaggcctccctcatctagtggtncactacccaccgagggccacgtcggtcgtcccaggccgtaggttcaggtggcagggtgggtcgtaggggacaggtacgttcactcctacacctatccgagccgacgtccctaggacctaggttaccgtaagtaaaggtttacgtttttaggaaccttttaaggtttttaatttagttcgtaacgtaggtactaaagggttaacttaaacgtaaccggttccggtacccgttaccgggttacgggttaccggttacccgggaccggtaaaaccggggtaaccgtaaaggggtaaacgtaaaagttaaccggaaaacggtacgttagggtcggaccgttagaccctaactacttacggtttctaccgttcttacccg

SEQ ID NO: 185133 - DNA, 786 bp, Homo sapiens
  misc_feature: GYAE6OF01BNJK6.14.23.C01.1.454.CMB.1.raw
  modified_base (204)..(204): a, c, t, g, unknown or other
  misc_feature (204)..(204): n is a, c, g, or t
  modified_base (314)..(314): a, c, t, g, unknown or other
  misc_feature (314)..(314): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccacctgtctgtgtctccgaggggaaancgccacctctcctgcagggccagtcagagtgttagaagcaacttgcctggtaccagcaagaaacctggaccaggcctacccgaggcctccgtacattcctagtgggtacncctactcccaaccggagggcccaacgttcgggtcgtacccgaggccgtaggttccaggttacggcgtaggggtcggggtctacggggaactaggtacgtttcaccgttctaaccaaccctatacccgacggacctaacggtcccgtacggtaccgtaacgggttaccgttaacgggtaaggttttaacgtttttacgggtaacttttaagggtttttttaatttaacgggttttacggttaacgtaacggttaccgttaaagtttaaacgtttaaaccgttaaaccggtttccgggtaacccgtttacccggggtttacggggtaaacccgggttttacccgggaacccgggtaaacgggggtaaacccggttaaacggggtaaaccgggtaaaaacgtacccgggtaaaaaccgtaggttacgggtacggaccgttacgaccgtactacgttcgtacgttctttacgtacc

SEQ ID NO: 185134 - DNA, 690 bp, Homo sapiens
  misc_feature: GYAE6OF01C3ROJ.14.23.C01.1.454.CMB.1.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (236)..(236): a, c, t, g, unknown or other
  misc_feature (236)..(236): n is a, c, g, or t
  modified_base (285)..(285): a, c, t, g, unknown or other
  misc_feature (285)..(285): n is a, c, g, or t
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
tcagcgtctagtaccacgaccggtgctcgatttagtacacgtgattagggattgggggaggaactgctcagttaggacccagacggaaccatcggaagccccagcgcagcttctcttcctcctgctactctggctcccagataccactggagaaatagtgactgacgcagtctccagcccacctgtctgtcgtctccgaggggaancgccaccctntcctgcgagggccagtcagngtgtacgagctaactgcctgaccagcacgaactgccagcctccagctcncntctagtggtcnccatccacgtcgggccacgtcggtctcccgaggacccgtaggttcaggtcggctagggtcggtcgtacggggactaggtacgttccactccgtacaaccgtagtaccgacggcctacgtcccgttgaccgtacgttacgtaggaaacgtttacgttttcggacgtttaagttttactttacgttcggtaacgtaacggtcttaaggttaacttaaacgttaccggtcgggtcccgttaccgggtacggtaaccgggtttcccgggaccgtaaaccggggtaaccgtaagggtaccggtaaacttaaccggtaaaccggtaaccggttcggttacgggaccttacggtaacccgtaccgttaacgttccgttaccggttcccgttcgtaaccg

SEQ ID NO: 185135 - DNA, 681 bp, Homo sapiens
  misc_feature: GYAE6OF01AXF3L.14.23.C01.1.454.CMB.1.raw
  modified_base (303)..(303): a, c, t, g, unknown or other
  misc_feature (303)..(303): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagacgcccaccctctcctgccgagggccagtcaggagtgttagaagcaacttacgccgtaggtaccagcaagaaacctggaccaggcctccgaggcctccncatctagtggtgcactccgaccgacgggccacgtggtccgtcccagtcccgtagggttcaggtggcgtagggtcggggtccgtaggggactaggtacgttaccacttcctacctaccataccgacgcctacggtccgtcgacgtacggttctaaggtaacggttactttttacggacgtttaacgtttttagttaacgtttcggtacgtacgttacgttaaagttaattaaagttaacccggttccgggtacccgttaccgggttacgggtacggttaccgggaaccgaacggggtaaccgaagggttaagaaaccgtaacgtaaacgtacgtgggtccgacgtcgaacgtactagtaccttcgttccttacgtaccg

SEQ ID NO: 185136 - DNA, 565 bp, Homo sapiens
  misc_feature: GYAE6OF01AVBXD.14.23.C01.1.454.CMB.1.raw
  modified_base (204)..(204): a, c, t, g, unknown or other
  misc_feature (204)..(204): n is a, c, g, or t
  modified_base (561)..(561): a, c, t, g, unknown or other
  misc_feature (561)..(561): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcagggccagtcagagtgttagagcaacttagcctggtaccagcagaaacctggccaggcctcccaggcctcctcatctagtggtcgcactcccaccgagggccacgtggtcgtcccagcctaggttcaggtggcgaggtcgggtctggggacaggtacgttccactctacacctatccagccacgtcctgctagtctagtaagttatttgacttagtttattagttgtcagtctaagttataacgtacgtcggtaccttccggtggtaccgttcggaccgtaacgggacagggtacgaaacgtacgaaacgacgttggcgacgtgaccactatctcttctntacc

SEQ ID NO: 185137 - DNA, 690 bp, Homo sapiens
  misc_feature: GYAE6OF01DYYZJ.14.23.C01.1.454.CMB.1.raw
  modified_base (205)..(205): a, c, t, g, unknown or other
  misc_feature (205)..(205): n is a, c, g, or t
tcagcgtctagtaccacgaccggtgctcgatttagtacacgtgattagggattggggggaggaactgctcagttaggacccagacggaaccatggaagccccagcgcagcttctcttcctcctgctactctggctcccagataccactggagaaatagtgatgacgcagtctccagccaccctgtctgtgtctcgaaggggaaancgccaccctctcctgcagggccagtcagagtgttagaagcaacttagcctaggaccagcaagaacctggccaggcctccaggcctctcatctagtggtcgactactcccgaccgagggcctacgtggtctcccagtccgtaggttcaggtggcgtagggtcgggtctgggactagtagttcactctacacatcagcacgtcctgactagttactaggtaaagtttgttttacggactttaagttttttaattaacgtttcgtacctaagtacttaaagttaattaaacgttaccgttcgggtcccctttaagggttacggtaacccggtttccggggaaacccggtaaaacgggggtaaccctaaagggggttaaacggtaaaaaccgttaaccggaaaaaacggttaccggttacgggttacggaccgttaaccggacccttaaaccggtacttttacgtacccgtttacttaccgttaccccg

SEQ ID NO: 185138 - DNA, 639 bp, Homo sapiens
  misc_feature: GYAE6OF01BCVUJ.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagcgccaccctctcctgcgagggccagtcagagtgttagagcaacttgcctggaccaacagaacctggccaggcctcccaggcctcctcatctagtggtgcctatcccacgaggggccacgtgggtctccccgaggccctaagggtttcaggtcggcgtaggttcggggtcgtaggggacaggtacgttccactcaccaccatcagcagccgtgctacgtcgtagaagttatttcgacttagttttattacttgtactagtctaagtaattaacgtaacgtcggtacccttaccgggttagggtacccggtttacgggacccgaaacggggtaaccggtaagggtaacggtaaaaccgtacggaaaaccggtacgttagggtacggcgtacgtacccgaccgttaacttcgttagttcccttaccgtcgttaccccg

SEQ ID NO: 185139 - DNA, 706 bp, Homo sapiens
  misc_feature: GYAE6OF01D5PX9.14.23.C01.1.454.CMB.1.raw
  modified_base (481)..(481): a, c, t, g, unknown or other
  misc_feature (481)..(481): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcgagggccagtcagagtgttagaagctaacttagcctggtaccagcacgaaacctggccaggcctccgaggcctcctacatctagtggtgcactcccgaccgacgggcccacgtcggtcgtacccgacgccgtaggttccaaggtcggacgtaggttcggggtcgtacggggactaaggtacgttacaaccttcgttaccaacccgatttaccgaacgtcgaacccgccgtacggcgtaagttccgtaaggtaaacggtttntttttacggacctttaagggttttttaacttaagttttcggtaactaaggtactaacgttaattaaacgtttaccgtcggttacccgttaccgggttacgggtacggttacccggaccggtaaacgggtaacccgtaagggtaaccgaaaacgttaaccgaaaaccggtagttaggtcggaccgtagacccgtaccgatttaccgttcgtcccttagtaaccccg

SEQ ID NO: 185140 - DNA, 583 bp, Homo sapiens
  misc_feature: GYAE6OF01DJMOI.14.23.C01.1.454.CMB.1.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
  modified_base (303)..(303): a, c, t, g, unknown or other
  misc_feature (303)..(303): n is a, c, g, or t
  modified_base (402)..(402): a, c, t, g, unknown or other
  misc_feature (402)..(402): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccacctgtctgtgtctccgagggggaaanagccaccctctcctgcagggccagtcagngtgtagaagcaacttagcctggaccagcaagaacctggccaggcctccgaggcctcctcatctagtggtnctatcccgaccgagggcctacgttggtcgtcccagccctaggttcaggtcggctagggttcgggtcgtggggactaggtacgtttccacttctcacctntacgacgcagccctgctagtctagaagttatttggacttagttttattagttgtactagtactagttaattaacgtacgtcggtccttcggtggtaccgttcggacctaagggacctaagggtacgaactacgaaacgtagtggtcggactgacctacctattccgtacgtccttctaccg

SEQ ID NO: 185141 - DNA, 676 bp, Homo sapiens
  misc_feature: GYAE6OF01DFJD9.14.23.C01.1.454.CMB.1.raw
  modified_base (208)..(208): a, c, t, g, unknown or other
  misc_feature (208)..(208): n is a, c, g, or t
  modified_base (238)..(238): a, c, t, g, unknown or other
  misc_feature (238)..(238): n is a, c, g, or t
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
  modified_base (379)..(379): a, c, t, g, unknown or other
  misc_feature (379)..(379): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggcctcccagataccactggagaaatagtgatgacgcagtctccagcccaccctgtctgtgtctacgaaggggaaacncgcccaccctctcctgcagggccagtcagngtgtagaagcaattgcctggaccagacagaacctggaccaggcctccaggcctcctanatctagtggcncactcccaccgacggcccagtcggtctcccgacgccgtaaggttcaggttcggacgtagggtcgggttaccnggggaactaggtacgttacaccgttctaccaaccatcagccacgcctgactagtctaaggtaacgtagttttagactttagttttaacttagttacgtacgtaagtacttaaagtaaacttaaagtaaccgtccgggtacccgttaccgggtacggttaacccggtttaccgggaaccggtaaacggggtaaacccggtaaagggtaacggtaaaaaccgtaacgtaaaacccgggtaaagttcgggaacggtccgtacgaacccgtaccacgttactcgtttctaccgttaacccg

SEQ ID NO: 185142 - DNA, 610 bp, Homo sapiens
  misc_feature: GYAE6OF01B1KBN.14.23.C01.1.454.CMB.1.raw
  modified_base (204)..(204): a, c, t, g, unknown or other
  misc_feature (204)..(204): n is a, c, g, or t
  modified_base (306)..(306): a, c, t, g, unknown or other
  misc_feature (306)..(306): n is a, c, g, or t
  modified_base (595)..(595): a, c, t, g, unknown or other
  misc_feature (595)..(595): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagaagcaacttagcctggtaccagcaagaaacctggccaggcctccgaggcctcctcatctagtggtcncactcccacgacggccacgtggtctcccagccaggttcaggtggacgtaggtcggggtctaggggactaggtacgttcacttcctacaaccgtatcgagctacgcctagacgtagtcgtaaggtaagtttattttacggactttaaggtttttattagttcgtacagtactaagttaactaacgttaccgtcggtcccgttacgggtaggtccgtaccgggacgaaacgggtaccgtaaagggtacgaaactacgaaacgtacgtggtcgactacgacctacctacttntacgttctcgtaccg

SEQ ID NO: 185143 - DNA, 545 bp, Homo sapiens
  misc_feature: GYAE6OF01EHU5X.14.23.C01.1.454.CMB.1.raw
  modified_base (203)..(203): a, c, t, g, unknown or other
  misc_feature (203)..(203): n is a, c, g, or t
  modified_base (402)..(402): a, c, t, g, unknown or other
  misc_feature (402)..(402): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagaagcaacttagcctggtaccagcagaacctggccagctccaggctcctcatctagtggtgcatccaccagggccacgtggtcgtcccagccctaggttccaggtcggctaggtgggtctgggacagagttcactctcaccatcagcagcctgcagtctgaagtnttttgacttagttttattattgtctagtactagttaataagtaactggtccttcggtggacgttcggaccgaacgggaccaagggtagaaatacgaaacgtaagtaggtcggacttcgactaccgacttactcgttctcgtac

SEQ ID NO: 185144 - DNA, 794 bp, Homo sapiens
  misc_feature: GYAE6OF01DODW4.14.23.C01.1.454.CMB.1.raw
  modified_base (205)..(205): a, c, t, g, unknown or other
  misc_feature (205)..(205): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctaccgaggggaaanacgccaccctctcctgcagggccagtcagtagtgttaagaagctaacttagccttagggtaaccagccaaacgtaaacccgtgggacccaagggcctcccgaagggtccccttaccctacattcgtaagtcgggtcgcctacgtcccgaacccgaggggtcccctaacgttcggggttccgtaccccgacggtaccccgtaagggtttccaagggttcggaccgtagggttcggggtcgtaggggtaacctagggtacgtttcacgttccgtaccaaccgtatcgaacgccgtaacggcccttaggacctaacgttcgttaaggtaaagtttactttttcggaacgtttagttttttacgttaagtttcggttaccgtagtaccttaaggttaacttaaaacggtttaacccggttacgggttacccgtttaccgggttacggggtaaccggtttacccggggaacccgtaaacggggtaaacccgtaaggggtaacggtaaaactaaccggtaaaaaccggtagttacggtacgggtacccgttgaacccgtaacctagttacccgttcttacccgtttcgtaacccg

SEQ ID NO: 185145 - DNA, 541 bp, Homo sapiens
  misc_feature: GYAE6OF01E38NS.14.23.C01.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaacctggccaggctcccaggctcctcatctatggtncatcccaccgagggcccactggtcgtcccagccaggttcagtggcaggtgggtctgggacagtagttcactctcacctatcagcacgcctgcagtctagtaagtattttgactagtttattattgtcagtactagtaataataactcggtccttccggtggtacgtttcggaccgaacgggaccaagggtaggaaatacgaaacgtaataggtggcgtgaccacctatcttcgtcttctac

SEQ ID NO: 185146 - DNA, 671 bp, Homo sapiens
  misc_feature: GYAE6OF01D26M2.14.23.C01.1.454.CMB.1.raw
  modified_base (204)..(204): a, c, t, g, unknown or other
  misc_feature (204)..(204): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgttagaagctaacttagcctggtaccagacaacgaaacctggccaggcctcccgaggcctcctcatctagtggtgcactcccgaccgacgggcccacgttcggtcgtacccgacgtccgtaggtttcaggtcggaccgtagggttcggggtcgtaggggacaggtacgttacacgttcctacaccgtatccgacgcgacgccgtcgacgtacgtacgtagtaagttagtttacgtacgttagtttattacgttcgtacgacgtacgacgggtcgggtacgaacgtttttcggaccgtccgttaccgttacgggttccggggtaccgggggtaacggtaacggggtacggtaacggttaacgtaaaccggtaacggtacgggtacggtcgtcgtaccgaccgttacgttcgttacgttccttccgtccgttaccccg

SEQ ID NO: 185147 - DNA, 630 bp, Homo sapiens
  misc_feature: GYAE6OF01AWJFD.14.23.C01.1.454.CMB.1.raw
  modified_base (205)..(205): a, c, t, g, unknown or other
  misc_feature (205)..(205): n is a, c, g, or t
  modified_base (425)..(425): a, c, t, g, unknown or other
  misc_feature (425)..(425): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanacgcccaccctctcctgcagggccagtcagagtgtagagctaacttagcctggtaccagcaacgaacctggccaggcctcccgaggcctcctcatctagtggtgcatcccacgacgggccacgtggtctcccagccgaggttcaggtggcgaggtgggtcgtgggacaggtgttccactctaccaccatcagccacgcctgacgtagtctaggtaagttntttcgacttagttttacttagtttcgactgtactaagttaataacgttaaccgcggttcccttaccgggtaggtacccgggtttaccgggacccggtaaacggggacccgtaaagggttacggtaaaacctacggtaaaaccgtacgttcgggtacggtacctcggaacctaaccgtacttccgttcgttccgtttaccgtaccc

SEQ ID NO: 185148 - DNA, 729 bp, Homo sapiens
  misc_feature: GYAE6OF01C5YCA.14.23.C01.1.454.CMB.1.raw
  modified_base (204)..(204): a, c, t, g, unknown or other
  misc_feature (204)..(204): n is a, c, g, or t
  modified_base (298)..(298): a, c, t, g, unknown or other
  misc_feature (298)..(298): n is a, c, g, or t
  modified_base (314)..(314): a, c, t, g, unknown or other
  misc_feature (314)..(314): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgtagaagctaacttgcctggaccagcaagaaaccctggaccaggcctacccgaggccttcctnacttctaagtcggtanccaactcccgaaccgcgggccacgtcggtccgtacccgagacccgtagggttcacggtggacagggttggggtacctgggggactaaggtactttaccgactttacctacaaccctagttaccgagacccgacgtcccgttagaccgaacgtttaccggttaagaaacggtttaacgttttttcggaactttaaggttttttaattagtttcgtacgtacggtactaaagtttaataaacgttaaccgttaccgggttcccgttaaccggttcggggttaacccgtttcgggaccggtaaaacggggtaccgtaaacgggttaacggaaaacgttaaccgaaaaccggttagttacgggtacgggaccttacgggacctaacgttaccgttattacgtttccgtacgttaacccg

SEQ ID NO: 185149 - DNA, 577 bp, Homo sapiens
  misc_feature: GYAE6OF01AR2XH.14.23.C01.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
  modified_base (421)..(421): a, c, t, g, unknown or other
  misc_feature (421)..(421): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagaagcaacttagcctggtaccagcagaaacctggccaggcctccaggctcctcatctatggtncactccgaccgagggccacgtggtcgtccccatccgaggttccaggtcggcagggttgggtctggggactaggtagttccactctacgactatcagcacgcctgctagtactgtaagtnttttgacttagttttattagttgctagactaagttaataacgtaacgtcggtaccctcggtaggtaccgttcggaccgaaacgggtaccgtaagggtacgaaagtaccgaaacgtacgtaggtcgacgtcgactacctatcttacgtcttctaccg

SEQ ID NO: 185150 - DNA, 752 bp, Homo sapiens
  misc_feature: GYAE6OF01DA44N.14.23.C01.1.454.CMB.1.raw
  modified_base (202)..(202): a, c, t, g, unknown or other
  misc_feature (202)..(202): n is a, c, g, or t
  modified_base (313)..(313): a, c, t, g, unknown or other
  misc_feature (313)..(313): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgagggaanacgcccaccctctcctgcgacgggccagtcagtagtgttagagctaacttgcctggtaccagcaagaaccgtggaccacggtctcccgaggtccttctcattctagtggtnacctactcccgaaccggacgggcctacggtcggtaccgtacccgagtcccgtaggttccaacgggtcggccgtagggttcgggtacgtaggggactaggtaacgttccgaccttccgtaccacctagtccgacggaccacggtcccgtagaccgtaagttccggttaaggtaaacgttttcgttttaggtaaccgttttaaggttttttaccttagtttacgtaacgtacgggttaaccttaagggttaactaaacgttaccggtcccggttaccgtttccgggtacgggttaacccggttacccggaccgggtaaacgggaacccgttaaggggttaaaccgtaaaacgtaacccggtaaaaccggtgttacgggtacggtaccctacgaaccccgttacgtaaccgtttcgtttaaccgttccgtttagtacccccg

SEQ ID NO: 185151 - DNA, 628 bp, Homo sapiens
  misc_feature: GYAE6OF01COUGX.14.23.C01.1.454.CMB.1.raw
  modified_base (203)..(203): a, c, t, g, unknown or other
  misc_feature (203)..(203): n is a, c, g, or t
  modified_base (259)..(259): a, c, t, g, unknown or other
  misc_feature (259)..(259): n is a, c, g, or t
  modified_base (447)..(447): a, c, t, g, unknown or other
  misc_feature (447)..(447): n is a, c, g, or t
  modified_base (473)..(473): a, c, t, g, unknown or other
  misc_feature (473)..(473): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangcccaccctctcctgcagggccagtcagagtgtagaagcaacttagcctggtaccngcagaacctggccaggcctcccgaggcctcctcattctagtggtgcctacgtacccaccgaggggcccacgttgggtccgtccccaggtccctaggttcaggtggcgagggttgggtcgtcggggactaggtagtttcccacgttctaccaccatccagcacggcctggcagtctagaagttgttttnacgtagttttattagtcgtactagtntaaggttaataacgttaaccgtcggtaccctttcgggtacggttaccggttcggacccgtaaaggggacccgtaaaggggtagaaacgtacgaaaacggtagttagggtacgacgtaggaccctaaccgtattccgttacgttccttcgtacccg

SEQ ID NO: 185152 - DNA, 925 bp, Homo sapiens
  misc_feature: GYAE6OF01BOIM8.14.23.C01.1.454.CMB.1.raw
  modified_base (215)..(215): a, c, t, g, unknown or other
  misc_feature (215)..(215): n is a, c, g, or t
  modified_base (841)..(841): a, c, t, g, unknown or other
  misc_feature (841)..(841): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacacagtctccagccaccctgtctgtgtcctcgagggaagcgccacctctcngcgagggccagtcagagttgtagaagctaactgcctaggaccagacaacgaaacctggacccacgggccctacccgacggtcctcccgtactacttacgttacgtcggggttcacctaccgtaccccgaacccggtacgggaccctaacggtcgggttcccgtacccgacgtccccggtagggttccgaggggtcgggacgtacggggttcggggtcgtacgggggacctagggtacgtttccaaccgttccgtaacccaaccgtacgttaccgacggtacccgtaccggtccccgtagggtccgttaaacgggtttccgttaaacgggtaacggtttttagttttaccggttacgtttttaaaggttttttacttaccgtttttaacggtacggtttaacggtaacggttaaaccgtttttaaagttaaaccccggtttaaccgggtttcccggggttaaacccccggtttttcccggggaacgggggttttaaccccggggttaacccggggtaaccgggtaaaaaccgggggtttaccccggggttaaaagggtttaaaccgggaaaaacccgtttaaaccccgggaaaacgggttaaccggggtttagggtaaccccggggnttttaaaacccccgggacccgtaaccccgtttacggggtttaacctttcccggtttaaaccccggtttcccttaaacccccggg

SEQ ID NO: 185153 - DNA, 658 bp, Homo sapiens
  misc_feature: GYAE6OF01DRDKI.14.23.C01.1.454.CMB.1.raw
  modified_base (313)..(313): a, c, t, g, unknown or other
  misc_feature (313)..(313): n is a, c, g, or t
  modified_base (482)..(482): a, c, t, g, unknown or other
  misc_feature (482)..(482): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaagacgccaccctctcctgcagggccagtcagagtgtagagcaacttagcctggtaccagcaagaaccgtggccacggcctcccgaggcctcctacacttcgtagtggtcncactcccgaccgacgggccacgtcggtcgtacccgagtccgtaggttccaggtcggcgtagggttcgggtcgtacggggaactacggtacgtttaccaccttacctaccaacctctaccgacggaccacggtcccgttaggccgttaacggtcgttaggtaaacgtttntttttacgacgtttaagtttttactttaagtttcgttacgagtacgttaagttaataaacgttacgtcggttccgttccggttaggttacggtttacggaccggtaacggaccgtaaggtacggaactaacgaaacgtgtcggtcgacgtgacctactatccttcgttctcgtacc

SEQ ID NO: 185154 - DNA, 688 bp, Homo sapiens
  misc_feature: GYAE6OF01C0A8H.14.23.C01.1.454.CMB.1.raw
  modified_base (204)..(204): a, c, t, g, unknown or other
  misc_feature (204)..(204): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaancgcccaccctctcctgcagggccagtcagagtgttaagagctaacgttgcctggtaccaggcaagaaacctggccaggcctcccgaggcctcctcactctagtcggtcgactactcccaccggacggcctacgttcggtccgtaccccgacggtccgtaggttccgaacggtcggacgtaggggttccggggttactcgggggtaacaacggtacgtttccaaccgttctaccgaacctacgtccgtaacgaccgacgtcccgtcgacgtacgtcgtaggtaagttagttttacgtacgttagttttactttagttcgtaccgtagtactaagttaataacgttaacgtccggtccgttcgggtacgtaccggttaccggacggtaacgggtaccgtaagggtaacggaacgtaaccgtaaacggtaacgtgggttacgacgtacggaccctacgtaacgttgtaccgttccttccgttacccg

SEQ ID NO: 185155 - DNA, 640 bp, Homo sapiens
  misc_feature: GYAE6OF01BIKNX.14.23.C01.1.454.CMB.1.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
  modified_base (428)..(428): a, c, t, g, unknown or other
  misc_feature (428)..(428): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcaggccagtcgngagtgttagaagctacttacgccgtcggtaccgagacaacgaaaccgtacggccgacggcctcccacggcgtcctcactctatggtgcactcccaccgacggccgacgtggtcggtcccacgcgtacggttcgaggtacggcgtacgtaggggtcgtcgggacgagtacgttcgtactctccaccaactcgagaccngacccgtgtcgacgtatagaagttattttcggactagttttatttagttgtcgacgtacaagttaattaacttaacgtcggtccgttcccggtagggtaccgttccgggaccgtaaacggggaccgtaagggtaaacggtaaactaccgaaaacggtagttagggcggtacgtcgactaccccgaattaccggttcttcgttccgtaacccg

SEQ ID NO: 185156 - DNA, 752 bp, Homo sapiens
  misc_feature: GYAE6OF01CQSMV.14.23.C01.1.454.CMB.1.raw
  modified_base (339)..(339): a, c, t, g, unknown or other
  misc_feature (339)..(339): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagactaccactggagaaatagtgatgacgcagtctccagcccacctgtctgtgtcgtaccgaggggaaacacgcccaccctctcctgcgagggccagtcaaggtagtgttaagaacgctaaacttagccgttggaaccaggacaacgtaaaccgtggaccaagggtcctacccgaggtccctaccgtctaatctagtcggtnacactcccaccgagggcctacggttcggtcctacccgagcccgtaaggttcgaggtcggaccgtagggttccgggtctgggggactaacggtacgtttaccaccttcacccaacgtctacgacgcgtaacgccgtcggtactacggttactaaggttaaacgttgtttacgacgtttaaggtttttatacgtttacggtacctaaggtaccttaaaggtttaaacttaacgttaaaccggttccggtcccggttacggttaacgggttacccgttaccgggaacccggtaaacggggtaaccgtaaacgggttacggtaaaacgtacccggtaaaaacgggttaacgttcgggaaccgttacggacctaaccgtaccggacttttaccggtcttccgtttaacccgttacccg

SEQ ID NO: 185157 - DNA, 784 bp, Homo sapiens
  misc_feature: GYAE6OF01A56ZY.14.23.C01.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagactaccactggagaaatagtgatgacgcagtctccagccaccctgtctgtgtctcgaggggaaancgcccacctctcctgcgagggccagtcagagtgtaanagcaacgttgcctaggtaccagcgaacgtaaccgtcggaccgacggcctacccgaggtcctccctactattcctagtcggtcgccaacgtcccgaacgacgggtccctacgttcggtccgtacccgacgtaccgtaggttcgacgggttcggacggtaggggttcgggtcgacggggtaacgacgttacggtttaccaccgttcctaccaaccgtagtaccaacggcttaacgtcccgtagtccgtagttacgtagtaaacgttttgtttacgtacgtttaagttttacgttagtttacggacttaaggtaaccttaaagtttaaacgttaaacgttaaccggttaccgggttccccgttacggggttaaaccgggttaccccgggtttacccggggaaaccgtaaacgggggtaaacccgtaaagggggtaaaccaaaaccggtttaaccgtaaaacgggttaccgttgggggtacgtaacccgttcgtaaaccggtaaccttaccggttagttttaccgttacccgtttccgttaaccccg

SEQ ID NO: 185158 - DNA, 659 bp, Homo sapiens
  misc_feature: GYAE6OF01C6CI4.14.23.C01.1.454.CMB.1.raw
  modified_base (207)..(207): a, c, t, g, unknown or other
  misc_feature (207)..(207): n is a, c, g, or t
  modified_base (651)..(651): a, c, t, g, unknown or other
  misc_feature (651)..(651): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtcctccagcccaccctgtctgtgtctccgaaggggaaangcccaccctctcctgcagggccagtcagagtgtagagcaattgcctggaccagcagaacctggccaggcctcccgagcctcctcatctagtggtgcactcccgaccgacgggccacgttcgggtcgtccccagccgtaggttacaggtggcgtagggtcggggtcgtacggggactaggtacgtttccacgttcctacaccctatcgacgactacgcctcgacgtagtacgttaggtaagttatttttaggactttaagtttttacttagtttagttacgtagtacttaaggttaacttaaacgttaccgttacgggtcccttcgggtacggtaccggttaccggaccgtaaacgggtaccgtaagggtaccgaaagtaccgaaaccggtaacgttagggtcgaccgttacgcccgtaaccgttactttactacgttcccgttnttaacccg

SEQ ID NO: 185159 - DNA, 854 bp, Homo sapiens
  misc_feature: GYAE6OF01DSAA7.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatgtgatgacgcagtcctccacgccctaccctgtctgtcgtctaccggaaggggaacacgccctaccctctccgtgccgagggcctagtcgagtagtagttaagagtactaacttcgccgtaggtaccagaccaacgaacccgtggacccgaacggtccctacccgacggtcctccgtactacgttcgtagtcggtcgactacctacccgacggacggtcctacgtcggtaccgacccgtacgtacccgtggttacgacggttcgggtaccgtacggggttcgggggtaccctaggggtaaccgtaagggttaccgtttacccgtaccttcccgtaacctaacccgtaacgttccgaaccgtccggaaccgtcccggtttacggacgttacggttacgttaaagggtttaacgtttcgttttaacggtacgtttttaagttttaacgttttacgttcgtaaccgttacgtaagtttaacgttaaacgttaaaccgtttaccggttcccgggttacccggtttaccgggttaacgggtaccggtttaaccgggaaccggtaacccggggttaaacggtaaacggggttaaccgtaaaaaccggttaaaccgtaaaccggttaaggttccgggttacggtacccggtaacgtttaacccgacgttcgtttaaccgttacgggttttacccttccgttaccccg

SEQ ID NO: 185160 - DNA, 808 bp, Homo sapiens
  misc_feature: GYAE6OF01BMQF2.14.23.C01.1.454.CMB.1.raw
  modified_base (204)..(204): a, c, t, g, unknown or other
  misc_feature (204)..(204): n is a, c, g, or t
  modified_base (735)..(735): a, c, t, g, unknown or other
  misc_feature (735)..(735): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttagagcaacttagcctggtaccagacgaacgaaaccgtggccaggcctacccgaggcctcctctatcctagtcggtgaccacgtcccgaaccgacgggtacccacgttacgggtccgtaccccgacggtcccgtagggtttccgaagggtcggaccgtaggggttcggggtaccgtagggggaacctaacgggtacggttaccacccggttacctaccgtaacccgacgttaccgacggccgtaaccggccccgtacggtacccgtaacggtttcccgttaagggtaaaggttttacgtttttacgggaccttttaaaggttttttaatttacgtttcggttaacgtagggttaaccttaaaggtttaactttaaacgtaacgggttacccggttccccggttaccgggttacgggtaccccggtttcgggaacccgtaaaacgggggtaccgtaaaggggttaacgggtaaaaaccgttaccggaaaaaccgggttnttacgggggacgttaccgttacggaacccgtaacccttaggttccctttacggttcctttaaccgttaccccg

SEQ ID NO: 185161 - DNA, 706 bp, Homo sapiens
  misc_feature: GYAE6OF01CZCCA.14.23.C01.1.454.CMB.1.raw
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
  modified_base (304)..(304): a, c, t, g, unknown or other
  misc_feature (304)..(304): n is a, c, g, or t
tcagcgtctagtaccacgaccggtgctcgatttagtacacgtgattagggattgggggaggaactgctcagttaggacccagacggaaccatggaagcccagcgcagcttctcttcctcctgctactctggctcccagactaccactggaagaaatagtgatgacgcagtctccagcccacctgtctgtgtctccgaggggaaancgccacctctcctgcgagggccagtcagngtgttagaagcaactagcctggtaccagcaagaaccgtgccaggcctccgaggtctcctcatctagtggncactcccgaccgagggccagtcggtctccccaggcccgtaggttacacggttcggacgtagggttcggggtacctaggggaactacgggtacgttcccacgttctaccgaaccgtagtccaagaccacgtcccgtgaccgtacgttcgttaaggtaacgtttatttttcggactttaaggtttttacttaacgttcggttaacgtaacgtctaaaggtttaaacttaacgttaacggttccggtacccgttccgggttaacgggtacccggtttacccgggaaccgtaaacggggtaacccgtaaaaggggttaccggtaaaactaaccgtaaaaacggtacgttacgggtacggtaccgtacgaccgtaaccctattccgttaacgtcctttacgtacccg

SEQ ID NO: 185162 - DNA, 759 bp, Homo sapiens
  misc_feature: GYAE6OF01BUXTF.14.23.C01.1.454.CMB.1.raw
  modified_base (204)..(204): a, c, t, g, unknown or other
  misc_feature (204)..(204): n is a, c, g, or t
  modified_base (316)..(316): a, c, t, g, unknown or other
  misc_feature (316)..(316): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaancgccaccctctcctgcgagggccagtcaggagtgttaagaagctaacgttagcctggtaccagcaacgtaacctggaccaggcctaccaggcctccgtcactctagtcggtncactcccaccgacggcctacgtgtccgtccgacgtctaggtcaggtggcgaggtacggtcgtacgggacaggtagttaccgactaccgtacgactacgtcaacggtcctaacggtcccgttacgaccgtacggttacttaaggaaccgttattttcggaaccgttttaaggttttacttacggttacgttacgtacggtaccggtaaggggccgggttaacgttaaccggttccggggacccgttacccgttacccggttacgggttttaccgggggggaaccccgggggtaaccgtaaacggggtttccgggtaaaaccgtttaaaccgggtaaaaaccgggtccgtttaggggggcccttaacccggggtacgtaacccgttaaccccgttaaggttccggttttaccgtaaccccttttacgacccgttttacccccggg

SEQ ID NO: 185163 - DNA, 615 bp, Homo sapiens
  misc_feature: GYAE6OF01DJLO6.14.23.C01.1.454.CMB.1.raw
  modified_base (204)..(204): a, c, t, g, unknown or other
  misc_feature (204)..(204): n is a, c, g, or t
  modified_base (335)..(335): a, c, t, g, unknown or other
  misc_feature (335)..(335): n is a, c, g, or t
  modified_base (424)..(424): a, c, t, g, unknown or other
  misc_feature (424)..(424): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccacctctcctgcagggccagtcagagtgttagaagctaacttagcctaggtaccagcaagaaacctggcccaggcctcccgaggcctcctcattctagtggtcgcactcccacgagggcctagtggtcncccagtccaggttcaggtgcagggttcgggtctgggacaggtacgtttcactctcaactatcgaagccagcctgcagttctagaagttntttggacttagtttttatagtttcgtacagtactagttaataacgttacgtcggtacccttcggtagggtaccccgttacgggacccggaaaacgggtacctaaaggggttacgaaaacgttaccgaaaacggtacttcgggtacgggccttaggaccctaacctagttccgtacgtttctaccgtacccg

SEQ ID NO: 185164 - DNA, 784 bp, Homo sapiens
  misc_feature: GYAE6OF01CW1U6.14.23.C01.1.454.CMB.1.raw
  modified_base (211)..(211): a, c, t, g, unknown or other
  misc_feature (211)..(211): n is a, c, g, or t
  modified_base (363)..(363): a, c, t, g, unknown or other
  misc_feature (363)..(363): n is a, c, g, or t
  modified_base (771)..(771): a, c, t, g, unknown or other
  misc_feature (771)..(771): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtctccagcccaccctgtctgtacgtcctaccgaaggggaaanacgcccaccctctccgtgacgacgggtccctagtcgaagtagttagttaaggaacgtctaacgttacgccgttacggaccaggtccaaacgaacccgtggacccgaggtccctacccggaggtccttaccctatacttccgtaggtcggtcnccgtaacctcccgaaaccggtacgggccctagttccgggtccgacccccgagtaccccgttaagggttccgaagggtcgggtaaccgtaggggttcggggtacgtcggggtaaacacggggtttactttacccaccgttttcgaccccgtaaacctagtacccggaacgaccgtaccgtccgtacgtaccggtaacgttccgttagggtaaacgtttctttttacgggaacttttaggtttttaattaacgttcgtaccgtaagtaacttagttaaacttacgttaaccgtcgggttaccccgtgggttacggtacccggttaacgggaccgtaaagggtaaccctaagggtagtaaaccaacggtaacgtagtcggtcgacgtacgacccgtaacttgtcccgttancccgttgtaaccc

SEQ ID NO: 185165 - DNA, 630 bp, Homo sapiens
  misc_feature: GYAE6OF01BS55Q.14.23.C01.1.454.CMB.1.raw
  modified_base (188)..(188): a, c, t, g, unknown or other
  misc_feature (188)..(188): n is a, c, g, or t
  modified_base (203)..(203): a, c, t, g, unknown or other
  misc_feature (203)..(203): n is a, c, g, or t
  modified_base (310)..(310): a, c, t, g, unknown or other
  misc_feature (310)..(310): n is a, c, g, or t
  modified_base (454)..(454): a, c, t, g, unknown or other
  misc_feature (454)..(454): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctcagccaccctgtctgtntctccgaggggaaanacgcccaccctctcctgcagggccagtcagagtgtagagctaacttgcctggaccagcaagaacctggccaggcctcccgaggtcctcctcattcctagtcggtacncctaactccccgaacgacgggtcccaacggtcggtacgtcccccgaggtccctagggttcaggtcggctagggtcgggtctaggggacaggtacgttcacgtctacgacctgtcagtcacgtcctgcctagtcgtaggtagttntttgacttagttttattagttgtcagttacaagtttaataacgttaacctcggtccgtttacggtccggttacggttccggacgaaacgggtaccgtaaggtaccggtaaaataccgaaacggtacgttggtcggacttacggactaccgtagttccgtttgttccttcgttaccg

SEQ ID NO: 185166 - DNA, 647 bp, Homo sapiens
  misc_feature: GYAE6OF01B6PTS.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaagagcccaccctctcctgcagggccagtcagagtgttagaagcaacttagcctggtaccagacagaaacctggaccaggcctccgaggcctcctcactctagtggtgccactcccgaccgacgggcctacgtggtcgtccccagccgtagggttcagggtcggacgtagggtcgggtcgtaggggaactaggtacgttcacttcctacacctatcgagcacgtcctagctagttctagtaagttagttttgactttaagttttattacgttgtacagtactaagttaataacgttaacgtcggtaccgttaccgggttaggtaccgggttccggaaccggtaaacgggtaaccgtaaagggttacgaaaacgtaccgtaaaaccggtagttcggtcggacctacggaccctaacgttacttacgttcgttccgttactaccccg

SEQ ID NO: 185167 - DNA, 652 bp, Homo sapiens
  misc_feature: GYAE6OF01C5A7M.14.23.C01.1.454.CMB.1.raw
  modified_base (206)..(206): a, c, t, g, unknown or other
  misc_feature (206)..(206): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtctccagcccaccctgtctgtgtctccgaaggggaanacgcccaccctctcctgcagggccagtcagagtgttagagctaacttagcctggaccagcaagaaccgtggcccaggcctccgaggcctcctcatctagtggtcgcatcccgaccgacgggccacgttggtccgtacccacgccgtaggttcaggtcggcgtacggtggggtactggggaactaggtacgttcacgttccacgtaccagtacgagacgacgccctgtacctaggtcctagtaagttagtttcgacttaagttttacttagtcgtacctagtactaagttaactaacgttacggtccggtaccgttccggtacgggttaccgttcgggaccggtaacgggtaacccggtaaagggtacggaaaactacggtaaaacgtaacggttaggttacggacgtaggaccctaacgtacgttcttacgttccttacgttaccc

SEQ ID NO: 185168 - DNA, 827 bp, Homo sapiens
  misc_feature: GYAE6OF01DIM4W.14.23.C01.1.454.CMB.1.raw
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
  modified_base (246)..(246): a, c, t, g, unknown or other
  misc_feature (246)..(246): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtctccagcccacctgtctgtgtctaccgaggggaaancgcccaccctctccngcgacggccagtcagagtgtagaanctaacttagctacggacagacacgtaaaccgtcggaccacggcctaccgaggtcctacctctactccgtagtcggtcgactacgtacccgaccggtacgggccctaacggttccggttaccgtaccccgtacgtaccggtacgggttacgagggtcggtacggtacggggtttcggggtaccggtacggggtaacgtaacggtacgtttaccctaccgttccctaaccgtacccgtagttaccggaacgaccgtacgtcccggttacgggaccgttaacggttcgttaaaggttaagtttaacggttttacgttaacggtttaacggtttttttaacttcggttttacgtaacggttaacgtacgtttaaacgggtttaaacttaaaccgtttaacggttacccgggtttcccggttaaaccggggttaccgggttaacccgggttaccggggaaccggtaaaccggggtaaaccggttaagggtaaaccggtaaaactacccgggtaaaacgttaccgggttacggtacggtccgtaacgtacccgtacttacgttcgttactttaccgtccgttacccg

SEQ ID NO: 185169 - DNA, 682 bp, Homo sapiens
  misc_feature: GYAE6OF01DAVT5.14.23.C01.1.454.CMB.1.raw
  modified_base (194)..(194): a, c, t, g, unknown or other
  misc_feature (194)..(194): n is a, c, g, or t
  modified_base (207)..(207): a, c, t, g, unknown or other
  misc_feature (207)..(207): n is a, c, g, or t
  modified_base (320)..(320): a, c, t, g, unknown or other
  misc_feature (320)..(320): n is a, c, g, or t
  modified_base (629)..(629): a, c, t, g, unknown or other
  misc_feature (629)..(629): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagactaccactggagaaatagtgatgacgcagtctccagccaccctgtcctgtgtcnccgaaggggaaancgcccaccctctcctgcagggccagtcagagtgtagagcaacgttgcctaggtaccagcagaaaccgtggaccaggcctaccgaggtcctccctactattcctagtcggtacnctactccccgaaccgacgggccctaacgttggtccgttcccaggacccgtaggttcgaggtcggacgacgggttgggtccgtaggggaacctaggtacgttcctacttcgactacccagtccgaaggccacgtcctcgactacgttacgtagtaaagttcgttttaggactttaaggttttaacttatttgacaagtactaaggttataactaaccgtcgggacccttccggtagggtaccgttccgggaaccgaaacgggtaacccgtaaggttaaacggaaacgtaaaccccgtaaaggttaacccngggttaaccgccgttaacgacgtaaccacgtttctccgttacctcttaacccg

SEQ ID NO: 185170 - DNA, 633 bp, Homo sapiens
  misc_feature: GYAE6OF01CPAXQ.14.23.C01.1.454.CMB.1.raw
  modified_base (208)..(208): a, c, t, g, unknown or other
  misc_feature (208)..(208): n is a, c, g, or t
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
  modified_base (330)..(330): a, c, t, g, unknown or other
  misc_feature (330)..(330): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtcctaccgaaggggaaancgcccaccctctcctgcgacgggccagtcagagtgtagagctaactagctggacagcaagaacctggccaggcctccgaggtctcctnatctagtggtncactccacgaggccacgtggtcnccgagccaggttcaggtgctagggtggtcgtagggacaggtacttcacgtctaccactactcgacgacacgtccgtagcgtacgttacgtagtaagtttagttttcggacgtttaagtttttaacttacgtttgttaccgaagtacttaaagttaaagtttaacgtaaccgttcgggttacccgttcgggttacgggttacgttacccgggacgtaaacgggaacgttaacgggagtaaacctacggaaacggtacgtaggtcgtacgtacacgtacctacgtacttcgttcctcttaccccg

SEQ ID NO: 185171 - DNA, 712 bp, Homo sapiens
  misc_feature: GYAE6OF01B8AHY.14.23.C01.1.454.CMB.1.raw
  modified_base (207)..(207): a, c, t, g, unknown or other
  misc_feature (207)..(207): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtctccagcccaccctgtctgtgtctccgaaggggaaancgcccgccctctcctagcgagggccagtcagagttagttaagaagtactaacgttagccgttaggtaaccaggcaacggaaaaccgtggaccgaggcctacccgaggcctcctcattctagtggtcgactactcccgacgacgggcctacgttcggtccgtaccccgagcccgtaggttcgaggtcggtacgtagggtcggggtcgtcgggaacgtacggtacgttaccacttccgtaaccaccgtatacgacggacctacggtccctaggaccgttacgttaccgttaaggtaacgtttacgttttcggtaacttttaggtttttaactttacgttttagtacctacggttactaaagtttacttaaacgttaccgtcggtcccgttacgggtacggtaccggttaccgggacgtaaacggggactaacggggtaactaaacgtacgtaaacggtacgtggttacggctacgtacgaccttacgttactcgttacgttctaccg

SEQ ID NO: 185172 - DNA, 700 bp, Homo sapiens
  misc_feature: GYAE6OF01ELO2D.14.23.C01.1.454.CMB.1.raw
  modified_base (204)..(204): a, c, t, g, unknown or other
  misc_feature (204)..(204): n is a, c, g, or t
  modified_base (308)..(308): a, c, t, g, unknown or other
  misc_feature (308)..(308): n is a, c, g, or t
  modified_base (312)..(312): a, c, t, g, unknown or other
  misc_feature (312)..(312): n is a, c, g, or t
  modified_base (466)..(466): a, c, t, g, unknown or other
  misc_feature (466)..(466): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctacgaggggaaancgccctaccctctcctgcgagggccagtcagtagtgtagagcaacgttagcctggtaccagacaacgaacctggccaggtcctccgagtcctactcattctagnggtnctactcccgaccgacgggccctacgttggtaccgtcccacgttccgaaggttcaggtcggcgtagggtcgggtccgtaggggactaggtacgttccacgttcctaccacgtactcgagtccgtacgccgtagcgtagtacgtagtaacggtttntttacggacgttttagttttaagttatttacgtagtaagttaccgttaaagttaaacgttaacgttaccgttccggtacccggtttacggtaaccggggtaccggttaccgggaaccgggttaacggggtaaccgtaaaggggtaaacgtaaaacgtaaaccggtaaacggttagttacgggtcggacgtacgaaccgtaccttagttaccttcggtttaccctcgttaacccg

SEQ ID NO: 185173 - DNA, 983 bp, Homo sapiens
  misc_feature: GYAE6OF01CGZML.14.23.C01.1.454.CMB.1.raw
  modified_base (152)..(152): a, c, t, g, unknown or other
  misc_feature (152)..(152): n is a, c, g, or t
  modified_base (194)..(194): a, c, t, g, unknown or other
  misc_feature (194)..(194): n is a, c, g, or t
  modified_base (209)..(209): a, c, t, g, unknown or other
  misc_feature (209)..(209): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaanaaaggtagtgatgacgcagtcctccagcccaccctgtctgtntctcgaaggggaaancgcccaccctctcctgcgaggccagtcagagttagttaagaagctaacgttacgccgttaggtaaccaggtaccaaacggtaaacccgtggacccaagggtccccttacccgaggtcccttaccctactacgttccttaaggttcgggtacgacctaaccgttacccccgaaccgggtaaccgggggtccctaacgggtttaccggggtttcccggtacccccgtaagggtacccccggttaagggttttaccgaacgggggttcgggtaccgtaaggggggtttccggggttacggtacgggggaaccgttaagggttaaccggttttcccaaacccggttttcctaacccgtaacccgtaacgttcccggaaacgggtccctaccgggtaccccggttaggaaccccgtttacgggttacgtttaaacgggttaaacgtttacggttttttacgggaacccgtttttaaggtttttttaaacgtttacgtttaccgggttaacgttaaacggtaaacccgttttaaaggtttaaaaacgttttacccgtttaaacccgggtttccggggtaccccctttttaccgggggaacgggttttaaccccggtttaccgggggaaaccggtaaaaccgggggttaaaccgtaaacggggtttaaacggaaaaaccgtttaacccggtaaaaccgggttagggttacgggttcggacccttacgtaacccgtaacggtttacttcccgttttaccgtaccgtttacccgtaaccccgg

SEQ ID NO: 185174 - DNA, 596 bp, Homo sapiens
  misc_feature: GYAE6OF01A9RWP.14.23.C01.1.454.CMB.1.raw
  modified_base (204)..(204): a, c, t, g, unknown or other
  misc_feature (204)..(204): n is a, c, g, or t
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
  modified_base (422)..(422): a, c, t, g, unknown or other
  misc_feature (422)..(422): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgttaagagcaacttagcctggtaccagcaagaaaccgtggaccaggcctcccgaggcctccctnatctagtggtncactcccacgagggccagtggtcgtcccagcctaggttccaggtggcaggttgggctgggacagtcgttcactctacgaccatcgagctagtctagctacgtctagaagttntttgacttagttttattattgtacagtactaagttaactaagttaaccgtcggtacccttccggttagggtaaccgttccgggaccgtaaacggggtacccgtaagggtacggaaaacgtcgaaaacgtacgtagggtacgtctacgacctacgtactcgtcttcgttctaccg

SEQ ID NO: 185175 - DNA, 622 bp, Homo sapiens
  misc_feature: GYAE6OF01AEZSE.14.23.C01.1.454.CMB.1.raw
  modified_base (205)..(205): a, c, t, g, unknown or other
  misc_feature (205)..(205): n is a, c, g, or t
  modified_base (304)..(304): a, c, t, g, unknown or other
  misc_feature (304)..(304): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngccaccctctcctgcagggccagtcagagtgttagaagcaacttagcctggtaccagcagaaacctggccaggcctccaggctcctcatctagtggtcncactccaccgagggcccacgtcggtcgtccccgagccgtaggttccaggtcggctagggtggggtcgtggggacaggtacgtttcaccttctaccacctatccgacgccgacgtccctggactacgttacgtagtaacgttagtttttacgactttagttttatttagtttgtacgtagtactaagttaattaacgttaacgttcggtacccgttccggtacgggtaccggttaccggaccgtaacgggaccgtaagggtacggaaactacgaaacgtacgtggtcggcgtgaccgtactatcttacgttcttctacc

SEQ ID NO: 185176 - DNA, 929 bp, Homo sapiens
  misc_feature: GYAE6OF01BH9VE.14.23.C01.1.454.CMB.1.raw
  modified_base (208)..(208): a, c, t, g, unknown or other
  misc_feature (208)..(208): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtctccagccacctgtctgtcgtcctccgaaggggaaacncgcccacccttcgtcctggccgacgggccagtcaggtagttagtaagaacgtctaacgttacgccgttaggtaaccagaccgaacggtaaaccgtcggaccgaacggtccctacccgacggtcccttacctaccgtacttccgttaagtcggttacgaccctaacgttaccccggaaccggaccgggtccctaacggttcgggtcccgtaccccgaggtccccgttagggttaccagggtcggtcgtaagggttcggggtacgtagggtaacgaggttacggttcctacgttaccgtcccaaccgtacgttacgaaccggtccgtaacccggtccgttacgggtaaccgttacggttaaccggttaaggtttaacggtttaccgtttttaggtaccggtttttaaaccgtttttaagtttacggttttaacgggtaacttaacggtttaaccgttaaagtttaaacgttttaaacccggtaaccgggtttacccgggtttaaccccgggttaccccggggtttaggggttaaacccccggtttaccggggaaacccggttaaacggggtaaacccggttaaaggggtaaacccggtaaaaaccggttaaacccgggtaaaccgggttaacccgggttaggtacccgggttaaccctacgggaaacccgtttaccgtacgtttaccggtttacccgtttaacggtttaccctttaaccccgg

SEQ ID NO: 185177 - DNA, 677 bp, Homo sapiens
  misc_feature: GYAE6OF01BKIS9.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctcgaggggaaangccacctctcctgcagggccagtcagagtgttagaagcaacgttagccgtaggtaccagacaacggaaaccgtcggaccgagggccctacccgacgggtccttccctacgtacttcgtagtcgggtcgaccactacccgaccgacgggccacgttgggtcgtacccgagtccgtaggttcgaggtcggcgtagggtcgggtacgtgggactaggtacgttaccacgtctaccacacgtacgacgtccgacgtccgtgtacgtacggtattagtaacgtttagttttcgactttagttttacttaacgttcgtacgacggtcggagggtcggggtaactaaggttccggaccgtcgttaccgttaccgggtttccggggaccgggggtaacggtaggggtacggtaacgtacggtaaacggttcgtggtacggcgtcgacgaccgtattcgttacgttccgttcgtcgttcccgg

SEQ ID NO: 185178 - DNA, 691 bp, Homo sapiens
  misc_feature: GYAE6OF01CI3RB.14.23.C01.1.454.CMB.1.raw
  modified_base (259)..(259): a, c, t, g, unknown or other
  misc_feature (259)..(259): n is a, c, g, or t
  modified_base (295)..(295): a, c, t, g, unknown or other
  misc_feature (295)..(295): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccacctctcctgcagggccagtcagagtgttagaagcaattagccgtggtacngacaagaaacctggccaggcctcccgaggcctcctnactctatcggtgcaactccaccgtacgggccacgtggtcgtcccgaagtccgtaagggttcacggtggccgtaggttcggggtctcggggaactacggtaggttccaccgttccgtacaacccgtattcgaacggcctaacggtcccgttacggacgtaaggttccgttaagggtaagttacgtttttcgaccgtttaaggttttttacttaagtttcgttaacgacgtaacgttacggtttaaataacttaacggttccggtacccgttccgggttaggtaccgttaccgggaccgtaaacggggccgtaaaagggtcggaaaactacggtaaaaccggtagttacgggtcggtacgttagaccgtaacctagttccgttagttcttacctaccg

SEQ ID NO: 185179 - DNA, 655 bp, Homo sapiens
  misc_feature: GYAE6OF01BX78U.14.23.C01.1.454.CMB.1.raw
  modified_base (205)..(205): a, c, t, g, unknown or other
  misc_feature (205)..(205): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaancgccaccctctcctgcagggccagtcagagtgttagaagcaacttagcctggtaccagcagaaacctggccaggcctccaggctcctcatctatggtgcactcccgacgagggccacgtgggtcgtccccagcccgtaggttccaggtggctagggtggggtcgttaggggactaggtagttccacttactccaaccagtcacgcacgcctgcgtagtcgtagaagttattttgctttagttttattagttgtacagtacgtaagttaacttaactaaccggttacggcccgttaccggttagggttaaccggttccgggaccgtaaacggggtaaccgtaaaggggttaaccggaaaacgttaccggtaaaaaccggtacgtttagggtaccgggtactacggaacccgtaacctacgttaccgtttcggttacccttccgttaacccg

SEQ ID NO: 185180 - DNA, 687 bp, Homo sapiens
  misc_feature: GYAE6OF01DXO1N.14.23.C01.1.454.CMB.1.raw
  modified_base (206)..(206): a, c, t, g, unknown or other
  misc_feature (206)..(206): n is a, c, g, or t
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
  modified_base (473)..(473): a, c, t, g, unknown or other
  misc_feature (473)..(473): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtctccagccaccctgtctgtgtctccgaaggggaaancgcccaccctctcctgcagggccagtcagagtgtaagagcaacttagcctggaccagcaagaacctggccaggcctccgaggcctctnattctagtggtcncactccgaccgcgggcctacgtgggtcctacccgacgtcccgtaggttcagggttcggacgtagggttcggggtctagggggaactaggtacgtttccaccttccgtaccaccgtactcgacggaccacggtccctcggtactacgggttacctaggtaaagtttnttttcggacgttttaagtttttatttacgttcgtacgtaagtacttaaagttaattaaaccgtaccggttcggtacccgttacgggttacgggtaccgttccgggaaccggtaaacggggtaacctaaaggggtaacgtaaaccgtaaccggtaaaacggtacggttggtacgactacgacccgtactatttccgtagtttcccttcgtacccg

SEQ ID NO: 185181 - DNA, 791 bp, Homo sapiens
  misc_feature: GYAE6OF01CU0V7.14.23.C01.1.454.CMB.1.raw
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
tcagcgtctagtaccacgaccggtgctcgatttagtacacgtgattagggatttggggaggaactgctcagttaggacccagacggaaccatggaagccccagcgcagcttctcttcctcctgctactctggcctcccagataccacgtggaagtaaatagtagatggaccgcagtcctccagcccaccctgtctgtcgtcctcggaaggggaaancgccctaccctcncctgcgacgggcctagtcgagagttgtaagacgactaacgttagccgtacggtaaccaggacctaacgaacccgtggacccgacggtccctacccgtaggtcccctcccgtctaacgtccgttaggtcggtactacccgaacctccccggaaccggtaccggggtaccctaccggttccggttaccgacccgtacgtaccggtaggttcgacgggtcggcggtaggggttcggtcggagggtacgtacgggttacttccaccgtacctaaccctacacgtacagacccgttacgccgtacgcgtacgttatacggttaagtttagtttccgtaagttttagttttaaacttggtactacgtcgttaacggtaaacttaacgttaaaccttaccgggtcccggttacccggtttcggggtaacccgggttaaccggttaccggaaccgggttaaacggggtaacgttaaacggggtaattaaaccgaaacggtaacccggttaaggtgggtacccgtactacgaacccgttacgtcgtttacctcgttacgttacctaccccg

SEQ ID NO: 185182 - DNA, 810 bp, Homo sapiens
  misc_feature: GYAE6OF01C0K9K.14.23.C01.1.454.CMB.1.raw
  modified_base (210)..(210): a, c, t, g, unknown or other
  misc_feature (210)..(210): n is a, c, g, or t
  modified_base (350)..(350): a, c, t, g, unknown or other
  misc_feature (350)..(350): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggcctccagactaccactggaagaaatagtgatgacgcagtctccacgcccaccctgtctgtgtctaccgaaggggaaanacgcccaccctcctcctgccgagggccagtcagagttgtaagaacgactaacgttacgccttaggaccagacaacggaaaccgtggacccgaggtccctacccgaggtccttaccctctaacttcgttagttcgggtacnccgacctaccccgaaccggtaccgggtaccctaccggtcgggttccgtaccccctagttaccccggtaagggtttacgacggttcggaccgtaaggggtttcggggtaccgtaggggaacctaacgggttaccgtttcccaactttccgaccaaccgtactccgaacgcctaaccgtccctagggtacctacggttacgttaagttaaacgtttagttttacggtaacttttaagtttttaagttttacgtacgttacgtaacgtacgttaaagtttaaacgttaaacgttaccgggttaccggttcccgttacggttacggggtaccgtttaacccggacgggtaaacccgggtaaccgtaaaggggtaccgtaaacctaaccgggaaaaccgtacggttcgggtacgtaccgttacacccgtaaccttcgtttacgtaccgttcctttccggtaaccc

SEQ ID NO: 185183 - DNA, 812 bp, Homo sapiens
  misc_feature: GYAE6OF01DFU4H.14.23.C01.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (277)..(277): a, c, t, g, unknown or other
  misc_feature (277)..(277): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctccagataccactggagaatgtgatgacgcagtctccagccacctgtctagtcgtctccgaggggaaacncgcccaccctctcctgcgacgggccagtcagtacgtntagacgctaacttagcctggtaccagcaacgtaaccnggaccaagggtccctaccgaggtcctccgtacgacttacgttagtcggtcgccgtaacttcccgaaccggaggggtaccctacggtttcgggtaccgttaccccgaacggtacccggttaaggtttccgtaagggttcggtaccggttacggggtttcggggttaccggtacgggggtaactacgggttacgtttacccgaaccggttttccaaccggtaaccctagtaaccgtacggtacccgtaacggtcccgttaggaccttacgggtttaccgttaaggtaaaacgttttcgttttacggaccgtttaaggttttttaacctagtttccggtacgtaacgttacgttaagtttaaacgtaacgtttaccggtcccggttacccgttaccgggttcgggttaaacccgttccgggaaccggtaaacggggtaacccttaaggggtaacccggtaaacttaaccggaaaaccgttcgttacgggttacgaccgttacgaccttaacgtccgttggttacctcttccgtaaccg

SEQ ID NO: 185184 - DNA, 769 bp, Homo sapiens
  misc_feature: GYAE6OF01EX3MN.14.23.C01.1.454.CMB.1.raw
  modified_base (204)..(204): a, c, t, g, unknown or other
  misc_feature (204)..(204): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccaggggaaangcccaccctctcctgcgagggccagtcagagtgttaagaagctaacgttagcccttagggtaacccagaccaaggaaaacccgtggacccaaggccctcccaggtcctcctcatctatggtgccactccgaccgagggccctacgtcgggtcgtaccccgagcctaagggtttccaggttcggacgagggttggggttccgtgggggtaaccagggttacgtttcctaaccgttcctacctaaccctagttccgaacgtccgacggtcccttagccgtaacggtccttaaggtaacgttagtttttacggacgtttaaggtttttaattagtttcgtaccgtagtaccgtaagtttaacgtaaacgtttaaaccggttcggtaccccgttacccgggttacgggtaaccggtttacccggggaacccgtaaaacgggggtaaccgtaaacggggttaacggaaaaacttaccgtaaaaaccgggtaaaccgttcgggttacggtaccgttacggaaaccccgttacccgtaacgttcccgtttacgttccttacccgttaacccg

SEQ ID NO: 185185 - DNA, 844 bp, Homo sapiens
  misc_feature: GYAE6OF01C1BFZ.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctcctgctactctggcctcccagactaccactggaagaaatgtgaatggacgctagtctccacgcccacctgtcctgtcgtcctaccggaagggggaaacacgtccccaccctcctccgtgcgacgggccagtcgaagtagttagttaagaacgactaacgttacgcctaggtaaccagaccgaagaaccgcggaccgacggtcctacccgacggccctcctactacttaccgtagtcgggtctccaccgtacccaccggacggtaccctacgtcggtacccgtaccgaccgtaccgtacggttacgacggtcgaggtacgggttgggtacggttaggggaactaggtaccgttactaccgtacctacctaaccgactaccgagaccgtacgtccgtaggacgtaacgttacgtaaggtaagtttacgttttacggtaacgttttaaggttttaagtttacgtttactaacggttacggttaaccgttaaagtttaaacgttaaacgttaaccggggtacccgttacccggggttaccgggttaccggggttaacccgtttaacccggggaaaccgggtaaaccgggtaaaccgggttaacgggtaaaacggtaaaccggttaaacccgtaaaaaccgggttaggttaccggtaagggttaccccgtaacggtaacccgtaaccgtacgtttaaccgggttctttaccgttacccgtttacccccgg

SEQ ID NO: 185186 - DNA, 696 bp, Homo sapiens
  misc_feature: GYAE6OF01BLK18.14.23.C01.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (295)..(295): a, c, t, g, unknown or other
  misc_feature (295)..(295): n is a, c, g, or t
  modified_base (310)..(310): a, c, t, g, unknown or other
  misc_feature (310)..(310): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccacgtggagaaatagtgatgacgcagtctcagccacctgtctgtcgtctcgagggaancgcccacctntcctgcgagggccagtcagagtgttagacgcaacttagcctggaccagcaacgaaccgtggccaggcctcccgaggtcctcctnacttctagtcggtcnctactcccgacgtacggcctacgtcggtccgtcccagtccgtaggttcaggtcggcgtagggtcgggtcgtagggactaggtcgttccacgttctaccgacctatcgaacgccgtacgtccctagacttacggttcgtaacggtaacgtttacgttttacgacgttttaagtttttactttagttcgggtacaacggtacttaaaggtttaacttaaacgttaccggtcgggtacccgtttacgggttacggtacccggttacgggaaccgttaaacggggtaccgtaaagggttaccgaaaacgttaccgaaaaccggttagtcgggtagacccgttcggaaccctaaccgttacgtttacccgttagttcccttcgttaccccg

SEQ ID NO: 185187 - DNA, 630 bp, Homo sapiens
  misc_feature: GYAE6OF01B7L7M.14.23.C01.1.454.CMB.1.raw
  modified_base (203)..(203): a, c, t, g, unknown or other
  misc_feature (203)..(203): n is a, c, g, or t
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (348)..(348): a, c, t, g, unknown or other
  misc_feature (348)..(348): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaancgccaccctctcctgcagggccagtcagagtgttagaagctaacttagcctggtaccagcagaactgccaggctccagctcnatctagngtncatcccacgaggccagtggtctcccagcctaggttcaggtggcaggtgggtcngggacagtagtcactcacacatcagcagcctgactagtctagtaagttattttgactttaggttttattactttggtactagtacgttaagttaattaaacgttaacgttcgggtacccgttaccgggttacgggtaaccggtttccggggaacccgtaaacgggggtaacccgtaaaggggttacggaaaaaccgttaccgaaaaacggttaaccgttgggttacgggacccgttgacccgtaaacccttagtttaccgtcgtttacgtcccgttaacccg

SEQ ID NO: 185188 - DNA, 840 bp, Homo sapiens
  misc_feature: GYAE6OF01D1H6R.14.23.C01.1.454.CMB.1.raw
  modified_base (155)..(155): a, c, t, g, unknown or other
  misc_feature (155)..(155): n is a, c, g, or t
  modified_base (217)..(217): a, c, t, g, unknown or other
  misc_feature (217)..(217): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggcctcccagactaccacgtggaanaaatagtcgatgacgcagtcctccagccctacctgtctgtcgtcctaccggaaggggaaacnccgaccctaccctcgtccgtggccgtaacgggccctagtcgaaggtagttagtaagaacgtctaaacgttcgccgtacgtaaccagtaccaaacgtaacccgtcggacccgaacgggtccctaccccggtaaggtccccttacccggtactaacgttccgttaacggttcgggtaccgaaccctaccgttacccccggaaccggtaccggggtcccttacggttccgggttaccccgtaccccgtaggttacccggtacggtttaccggaacgggttccggaacggttcgggtttcgggtaccggtacggggtaacgtaacgttacgttcccgaaccttccccgtaacgacctacgtaccgacggtacccgtacgtccccgtaggtccgtaacgttcgtaaaggttaacgtttcgtttacgtacgttttaagtttaacgtttcggttacgtactacgtaacgttagttaaactaaccgtttacgtcggtacccgttacggtaccgggtacgttaccggaaccggggtaacgtaaccggtaagggttaaaccaaacgtaaccggtaaacgtgggtcgtacggactacgaccctaagttccgttacgtacttcgtaactacccgg

SEQ ID NO: 185189 - DNA, 698 bp, Homo sapiens
  misc_feature: GYAE6OF01BVOSD.14.23.C01.1.454.CMB.1.raw
  modified_base (203)..(203): a, c, t, g, unknown or other
  misc_feature (203)..(203): n is a, c, g, or t
  modified_base (328)..(328): a, c, t, g, unknown or other
  misc_feature (328)..(328): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccacctgtctgtcgtctccgaggggaanacgcccacccgtctcctgcagggccagtcagagtgttagaagctaacttaggcctggtaaccagcaacgaaaccgtggaccctagggcctacccgaacggtcctaccgtcattcgtagtgggtcnctacttcccgaaccggacggggccctaacggttcgggttaccgtacccgaggtaccccgtaagggttccaagggttcgggcgtaggggttcgggtcgtaggggaaccaggttacgttaccgacttccgtaccaccgtactcgacgctacgtcctgacgtagttctaagtaacgttatttcgactttaagttttattaatttcggtactaaggtactaaggttacttaaagtacccggtcgttaccgtaccgggttaggtacccggttcgggaacgaaacgggtaccgtaagggtaaccgaaacttaccgaaaacggtgttacggcgtacgtacggaccctacgttacgttcttacgtttctccgttaccg

SEQ ID NO: 185190 - DNA, 709 bp, Homo sapiens
  misc_feature: GYAE6OF01DB1IC.14.23.C01.1.454.CMB.1.raw
  modified_base (490)..(490): a, c, t, g, unknown or other
  misc_feature (490)..(490): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtctccagcccacctgtctgtgtcctccgaaggggaaacacgcccctaccctctccgtgcgacgggccagtcagtagtgttaagagactaacgttacgccgtacggtaaccaggaccaaacgtaaccgtcggaccgtaggcccctaccgaggtcccttcctactaacttccgtaggttcggtactccgtaacctcccgaccggtacgggtccctacggtcgggttccgacccgacgtcccgtaggttacaggggtcgtacggtagggttcgggacgtagggactacggtacttaccgtactcctaccgactagtcacgtacncgtaccgacgtacgtaacgtcgttaagtaacgttagttttaggacgttttagttttagtttagttacgttactaaggtacgttaagttaacgttaacgtaaccgttcggttaccgttccggtacgggttccgttacggacggtaacggaacgtaaggtaacgaactaacgaaacgttacgtaggtcgtacgacgactactacttatcgtactcttaccg

SEQ ID NO: 185191 - DNA, 627 bp, Homo sapiens
  misc_feature: GYAE6OF01BCEME.14.23.C01.1.454.CMB.1.raw
  modified_base (204)..(204): a, c, t, g, unknown or other
  misc_feature (204)..(204): n is a, c, g, or t
  modified_base (308)..(308): a, c, t, g, unknown or other
  misc_feature (308)..(308): n is a, c, g, or t
  modified_base (613)..(613): a, c, t, g, unknown or other
  misc_feature (613)..(613): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttaagaagctaacttgcctggtaccagcaagaaacctggaccaggctacccgaggcctcctcatctagtggncactccaccgcggccacgttcggtcgtaccccagaccgtaggttcaggtggacgtaggttcggggtacgtgggaactaggttacgttaccaccgtccgtaccaacctagtccgagtccacggtcctagactagtcgtaagtaagttgttttcgacgttttagttttacttagttacgtacgagtacttaaggttaattaacgtacgtcggtaccttcgggtggttaccgttacggactaacgggacgtaaggtacgtaaactacgaaacgtagtacggtcggactaggacctacgtactacgttnttccgttcgtaccg

SEQ ID NO: 185192 - DNA, 950 bp, Homo sapiens
  misc_feature: GYAE6OF01D8CW4.14.23.C01.1.454.CMB.1.raw
  modified_base (219)..(219): a, c, t, g, unknown or other
  misc_feature (219)..(219): n is a, c, g, or t
tcagcgtctagtaccacgaccggtgctcgattttagtacacgtgattagggattggggggaggaactgctcagttaggacccagacggaaccatggaagccccagcgcagcttctcttcctcctgctactctggcctcccagactaccacgtgggaagaaatagtgatgacgcagtcctccacgcccaccctgtctgtcgtcctaccggaaggggaaancgccctaccctctcctgcgacgggcctagtcagtagttagtaagaacgtactaacgttcggccgtacggtaaccagacgaaacgtaacccgtcgggacccgacgggtccctacccggtacggtcccttaccctacgtacgttaccgttaaggttcggggtaccacctaacccgtacccggaacccgggaccgggtacccttaccgggttcggggttaccctaccccggacggtacccggttacgggttaccggaggtcgggtaccggttagggggttcggggtaccgttacgggggaactaacgggttacttaccctaccggtcccttaaccaaccgtacgtaccgtaacgtaccgtacccggtacccgttagggtacccgttaggttaccgttaaagggttaacgtttttcgtttaacgttaacgtttttaagtttttacgttagtttacggttaccgtaacgttaaacgtttaacgttaaagttaacccgggtttacccggtcccgggttaacccggtttcccggggtaaccgggtttaaccggggttaacccggtaacccggggaaaacggggtaaacccgggttaaaaggggttaaacccgtaaaaaccggttaaaacccggtaaaccgggtttagggttaccggggaacgttacccgggtaaaccgtaacccccttaaaccggtttcgttaccccgttttacgtttacccgttaccggttaccccc

SEQ ID NO: 185193 - DNA, 741 bp, Homo sapiens
  misc_feature: GYAE6OF01C2TZD.14.23.C01.1.454.CMB.1.raw
  modified_base (204)..(204): a, c, t, g, unknown or other
  misc_feature (204)..(204): n is a, c, g, or t
  modified_base (367)..(367): a, c, t, g, unknown or other
  misc_feature (367)..(367): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatgtgatgacgcagtctccagccaccctgtctgtcgtctacgaggggaaancgccctaccctctccgtgcgacgggcctagtccgaaggtagttagttagaagacctaaacgttgccgttaggtaaccagaccgaaagtaaacccgtcgggaacccaagggtcccctacccggaacgggtcccttaccctacgaacttccttaaggtcggtacnccctaacgtcccccgaaccgggccggtaccctacgtcggggttacccgcccacggtcccgtaaggttcgaggtcggacgtaggggttcgggtacgtagggaacgtaacggttcgttaccgacttcccgtaaccgactagtcgacgccgtacgcctcggactacgttcgttaggtaactttacgtttgtacgtttaagttttactttacgtggtacttaggtactaagtttaactaataccggttcgtccgttacggtacggttacgtacccggacggtaacgggaaccgtaaggtaacggtaaactaccgaaacgttagtcgggtcggtaccgtacggacttaaccgtagttccttaccgttcttcccgtaccg

SEQ ID NO: 185194 - DNA, 905 bp, Homo sapiens
  misc_feature: GYAE6OF01C9KYW.14.23.C01.1.454.CMB.1.raw
tcagcgtctagtaccacgaccggtgctcgatttagtacacgtgattagggattgggggaggaactgctcagttaggacccagacggaaccatggaacgccccagcgcagcttctcttcctctgctactctggcctcccagactaccacgtggaagtaaataggtgaagtggaaccgctagtcctccacgccctaccctggtccttgtacgtccgtaaccggaagggggaaacaccgtaccccacccttctcccgtacggaccgaccggggtaccctaaggtcgtaagggtaacggttggttaacggaactactaaccgttacgtccgtaacggtaaccgacgacgaacgtaaccggtcggaccgtacggcctaccgcgtcctcctacacgttctagtcggtcacctaccgtacccaccggtacgttcccgaggtccggtacctacccgtcgtaccggtcggttaccggtaggtccggtacgtggggttaccggggtacggtacgggaacgtacggttacgttacctaaccgtccgtaaacctcctaaaccgtccgaaccgaccgtaccggtaccgtccggtaacggtacggttaccggtaagggtaaacggttacggtcgggttaaccggttaacggtttaacggttttaacgttaaccgtttaacggttaaacttaaccgtttaaatttaaaccgtttaaagtttaaacttaaccgtttaaccggtttaaaccggttttaacgggttaacccgggggtaaccgggttaacgggtaaacccggttaagggtaaccggtaaggtaaacgttaaaccggtaaacggttacggtacgggttaccgtaacggtacccgtaacccgtaccgttacgttaccgtttacgttacccgttccgtttaaccccg

SEQ ID NO: 185195 - DNA, 861 bp, Homo sapiens
  misc_feature: GYAE6OF01CWF90.14.23.C01.1.454.CMB.1.raw
  modified_base (306)..(306): a, c, t, g, unknown or other
  misc_feature (306)..(306): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtcctccagcccaccctgtctgtgtctccgagggggaacagcccaccctctcctgcgagggccagtcagagtgtagaagctaacttagcctggtaaccagcaagtaaaccgtggaccaggcctcccaggcctcctacntactagtcggtagcactcccgaccgacggccctacgttgggtacctcccaggtccccgtaggttccgacggtcggacgtagggttcggggtcgtaggggactaaggtacgtttaccaccttcgtacccaacctacgtaccgacgtaccgaaccggtcccttaacgggtccgtaacggttacccgttaagggttaaaaacggttttacggtttttttaccggtaaccgtttttaaaaggggtttttttaaaccttttttacgggtttaccggttttaaccgtaacgggttaacccttaaaaaggttttaacttaaaaaaccggttaccgtttacccgggtaacccgtttccgggttaaccgggggttacccgggttacgggtaaccccggtaaaaccgggggtaaaccgttaaacggggtaaacgggtaaacctaaaacccgggtaaaaaaccggttaccgtttccggggtaaacgggtacccgttaaggacccccgttaaaccgtacggtttcccggtttaaacgttttcccgtttttaaaccgttcccccccgg

SEQ ID NO: 185196 - DNA, 801 bp, Homo sapiens
  misc_feature: GYAE6OF01E0MB4.14.23.C01.1.454.CMB.1.raw
  modified_base (210)..(210): a, c, t, g, unknown or other
  misc_feature (210)..(210): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagactaccactaggagaaatagtgatcgacgcagtctccagccacctgtctgtacgtctacggaaggggaacncgccctaacccttctaccgtcggaccgaacggggtccaggtaccgaaggttacggttagttaaacggaactaccgtaacgttacggtcccgttacgggtaacccaaggaccgtaaaccggaaacccggttggaacccgaccggggtacccttacccggaacggtccctttaccccgtagtaaccgtttcgtaaaccgggtttggggtaccctaccggtaaccctaccccggtaacccggggtaaacggtcccggtttaaacgtttccggggtaccccgtacgtaaaccgggttccggtttaacggtcggtaaccgggtgaccggtttaagggtcggggtacgtacgggacgttacggtacgttcctacgtcctacgactacgtacgacgtcgtacgtcctagcgtacgtacgttacgtagttacgttagtactttagtttacttagttacgtaccgtagtacgttaagtaacttaacgtacgtccgttacgttcggtacggtaccggtacgaacggaacggtaacgtaacggtaacgtaaacgtaacgtacggtatcggagtacacgtactcgtctcgtcttcgtctaccg

SEQ ID NO: 185197 - DNA, 690 bp, Homo sapiens
  misc_feature: GYAE6OF01BAH1O.14.23.C01.1.454.CMB.1.raw
  modified_base (205)..(205): a, c, t, g, unknown or other
  misc_feature (205)..(205): n is a, c, g, or t
  modified_base (319)..(319): a, c, t, g, unknown or other
  misc_feature (319)..(319): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaancgcccaccctctcctgcgacgggccagtcagtagtgttagaagctaacgttagcctggtaccagacaagaaacctggaccaggcctccgaggcctccgtcactctagtgggtcncactcccgaccgacggggcctacgtcggtccgtccccagccgtagggttccagggtcggacgtagggtcggggtcgtacggggaactaggtacgttccaccgttcgtaccaaccctacgtaccgaacgggccaacggtcccctaggtaccgtacggttacgttaaggtaacgtttagtttttcggacgtttaagtttttaacgtttagtttcggtacgtacgtacgtaagttaacgttaaacgttaccggtcggtacccttcgggttacggtaccggttcccggaacgaacgggtaccgtaagggtacgaaacgtacgaaacgtacgtggtcggtactacggacctactacgttcgttcgtcttcgtaccc

SEQ ID NO: 185198 - DNA, 741 bp, Homo sapiens
  misc_feature: GYAE6OF01B08SF.14.23.C01.1.454.CMB.1.raw
  modified_base (107)..(107): a, c, t, g, unknown or other
  misc_feature (107)..(107): n is a, c, g, or t
  modified_base (207)..(207): a, c, t, g, unknown or other
  misc_feature (207)..(207): n is a, c, g, or t
  modified_base (221)..(221): a, c, t, g, unknown or other
  misc_feature (221)..(221): n is a, c, g, or t
tcagcgtctagtaccacgaccggtgctcgatttagtacacgtgattagggattgggggagaactgctcagttaggacccagacggaaccatggaagccccagcgcancttctcttcctctgctactctgctccagactaccagtggaagaaatgtgatgacgctacgtctccacgcctacctgtctgtcgtcacggaaggggaaacncgccctacctctcngcgaggccagtcagtagtagtaagacgtactaacgttcgacgttaggaccagacaacggaaaccgtcggaccgaggtccctaccgagtcctcctacctagttacctaggtcggttacacctaaccgtacccgaaccggaaccggggtcctaacggttcgggtacgtaccccgaggtccgttaaggttacgaggtcggacgtgggttagggtacgtaacgggaaagttcgttacaactctacaacgttagcagcacgtcctagacgtagtactaaggtaagtttacgtttacggatttaagttttaattacgttagtacgtaagtacgttaaagtaagttaaacgtacgttaccggttccgtaacccgggttaggtacccggttcggaaacccggtaaagggtaaccggtaacggtaaaggtaaaccgtaaaaccggaaacgtacggttaacgggacccgtacgtaccggtaaccctaacgttacctacgtttacccgtacttaccggtaccctttacccg

SEQ ID NO: 185199 - DNA, 732 bp, Homo sapiens
  misc_feature: GYAE6OF01B4URF.14.23.C01.1.454.CMB.1.raw
  modified_base (204)..(204): a, c, t, g, unknown or other
  misc_feature (204)..(204): n is a, c, g, or t
  modified_base (322)..(322): a, c, t, g, unknown or other
  misc_feature (322)..(322): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctcgaggggaaancgcccaccctctcctgcgaggccagtcagagtgtaagaagtcaacgttagctaggtaccagacgaagaaccgtcggaccgacggcctaccgaggtcctacctcacttctagtcggtcnccacgtacccacggacgggtcctacgtcggtactcccgagccgtaggttcaggtcgcgtaggtgggtctagggactagtacgttccgactcgtaccacctagtaccgaggcctaacggtcctgtacgtacgttacgtaaggtaagtttaacgttttggaacctttaaggtttttactgtttacggtcctaacggtaacttaacgtttaaacgttaacgttaaccgttccgggtacccgtttacgggttaccggggttaaccgtttacccggggaacccggaaaagggttaaccccggtaaagggtaaacgtaaaaccgtttaccggaaaacggtttacggtacgggtacggacctttaaccggacctaaaccggtttctaaccgtttcggttaacccttaggttaccccg

SEQ ID NO: 185200 - DNA, 740 bp, Homo sapiens
  misc_feature: GYAE6OF01A5EYX.14.23.C01.1.454.CMB.1.raw
  modified_base (206)..(206): a, c, t, g, unknown or other
  misc_feature (206)..(206): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaaggggaaancgccaccctctcctgcgagggccagtcagagtagttaagaagcctaacttacgccgtaggtaaccaggacaaacgaaaccgtcggaccaacgggccctacccgaaggtcctcccgtacattccgtagtcgggtcgacctaactccccgaaccggtacggggaccctaacgttcggtcgtacccccgaggtacccgtagggttccgaagggtcggacgtaggggttcggggttccgtagggggaacgtaaggtacgtttacacccgttcctaccaacccgtatccgaacgcgtaccgcccgttagaccgtagttacgtaagtaacgtttagttttacggaccgtttaagtttttattacgttgtacgtaggtacttaaaggttaacttaagtaaccgtcgggttccccgttacggttcgggtaccgttacgggaacccgggtaaacggtaccgaaagggtaacggtaaactaacggaaaacgtagttcggaggttactacgacgtaacctgttaccttgttcctttacgtacccg

SEQ ID NO: 185201 - DNA, 802 bp, Homo sapiens
  misc_feature: GYAE6OF01BOBH1.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctcagccaccctgtctgtgtctccgagggaaagcgcccaccctctcctgcgacgggccagtcgagtagtgttaagaacgtcaacgttagccgtggtaccagaccaagaaaccgtcggaccctaggcctacccgaggtcctccgtcattccttagtcgggtcgcctactacccgaccggtacggccgacgttcgggtccgtacccgacggtccgttaaggttccgtaaggtcgggacgtacggggttcggggtcgttaggggaacctaaggttaccgtttacgaccgttaccgtacccaacccgtacgttaccgacgccgtaacgttcccgtaggtacctaaggttacgttaggtaacgtttagttttcgaacgttttaacggtttttaacttaacgtttgtaaccgtaagtacgttaagtttaaagtaaaccgttaacggtccggttaccccggttacgggttaccgggttaaccggtttacccgggaaccgtaaaccggggaacgggtaacgggttaaaaccggaacgttaaacccggtaaaacggtaccggttagggtaccggttaccccgtaaggtacccgtaaccgttacggtttaccttacccggtttcgttaacccgtttaccccgg

SEQ ID NO: 185202 - DNA, 704 bp, Homo sapiens
  misc_feature: GYAE6OF01A9LL7.14.23.C01.1.454.CMB.1.raw
  modified_base (207)..(207): a, c, t, g, unknown or other
  misc_feature (207)..(207): n is a, c, g, or t
tcagcgtctagtaccacgaccggtgctcgatttagtacacgtgattagggattgggggaagaactgctcagttaggacccagacggaaccatggaagccccagcgcagcttctcttcctcctgctactctggctcccagataccactggagaaatagtgatgacacagtctaccagcccaccctgtctgtgtctaccgaggggaaancgcccaccctctaccgtgacgacgggccagtcagtaggttacgttaagaacgtactaacttacgccgtaggtaaccagacaacgaaaccgtcggaccacggacctcccgaggtcctccgtctactacgtagtggtcgactacacccgaccgacggtcctacgtcgggtaccgtaccccgaggtccgtacgggttcgagggtcggacgtagggttcgggtacgtacggggaaccgtaggtacgttcaccttccgtaccaaccgtacgtccgagaccgtaccgtcccgtcgtacgtacgttacgtaggttaacgtttcgtttaacgtacgttttagttttagttagttccgtatacggtataagttattaacgtaccgtcggtccgttaccggttaggtaccgttacggacggtaacggtacgtaaggtaacggaaactaaccggaaacgtagtacgggtcgtacctcgaccgtacgtattaccgtcttcctgtacccg

SEQ ID NO: 185203 - DNA, 663 bp, Homo sapiens
  misc_feature: GYAE6OF01B4FGU.14.23.C01.1.454.CMB.1.raw
  modified_base (204)..(204): a, c, t, g, unknown or other
  misc_feature (204)..(204): n is a, c, g, or t
  modified_base (314)..(314): a, c, t, g, unknown or other
  misc_feature (314)..(314): n is a, c, g, or t
  modified_base (473)..(473): a, c, t, g, unknown or other
  misc_feature (473)..(473): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgcccaccctctcctgcagggccagtcagtagtgttagaagctaacttagcctggtaccagacacgaaaccgtggaccaggcctaccgaggtcctcctcatctagtggtncactccgaccgacgggcctacgtcggtcgtcccgagtccgtaggttcaggtcggacgtaggtcggggtcgtaggggactaggtacgttacactccgtcacctatcagccagtccctagctaggtctaggtaattgtttgctttaagttttacttagttntacgtagtactaagttaacttaagtaccggttcggtacccgttacggttacgggttacccgttacgggaacccgtaaacggggtaaccgtaaaggggttacgaaaacgttaccgaaaacggttacgtcgggttacggaccgttacgacccgtaccgttatttacccggtctttacccgttcgttaacccg

SEQ ID NO: 185204 - DNA, 708 bp, Homo sapiens
  misc_feature: GYAE6OF01BODGP.14.23.C01.1.454.CMB.1.raw
  modified_base (194)..(194): a, c, t, g, unknown or other
  misc_feature (194)..(194): n is a, c, g, or t
  modified_base (209)..(209): a, c, t, g, unknown or other
  misc_feature (209)..(209): n is a, c, g, or t
  modified_base (333)..(333): a, c, t, g, unknown or other
  misc_feature (333)..(333): n is a, c, g, or t
  modified_base (520)..(520): a, c, t, g, unknown or other
  misc_feature (520)..(520): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagactaccactggagtaaatgtgactgacgctagtctccagcccaccctgtcctgtntctccgaggggaacngcctacccgtctccgtgcacgggccagtcagagtagttagaagtctaacttagcctaggtaacccagtcaagtaaaccgtggacccgaggcctaccgaggtcctccgtactatctagtgggtcnctactcccgacgacggtccctaacgtcgggttccgtccccgacgtacccgttaggttacccgtaggttccgggacgtaaggggttcgggggttaccgtaggggtaactaacgggttaccgttacctacgttacctccgaaccctacgtcgacgccgacgtccctacgctaacgtccgtagtaagttntttacggtacttagttttaacttagttcgtactaagttcgtaagtttaactaacgttcgtacgtacccgttccgggttagtacccgttcgggaccgaaacgggttacgaaagggttacaaacgttaccgaaaacggtcgtaggtcgaccgtaggtaccctaccgtcttacgtcttaccttcgtacccg

SEQ ID NO: 185205 - DNA, 771 bp, Homo sapiens
  misc_feature: GYAE6OF01A2IO8.14.23.C01.1.454.CMB.1.raw
  modified_base (203)..(203): a, c, t, g, unknown or other
  misc_feature (203)..(203): n is a, c, g, or t
  modified_base (232)..(232): a, c, t, g, unknown or other
  misc_feature (232)..(232): n is a, c, g, or t
  modified_base (317)..(317): a, c, t, g, unknown or other
  misc_feature (317)..(317): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaancgcccaccctctcctgcaggccagtcagngtgttagagcaacttgcctaggtaccagacaacgaaaccgtcggaccaggcctacccgaggtcctccctcacttcctagtggtcnccgtactcccgaccgacgggccctacgttacggtcgtccccgacgtaccgtacgggttccgtaggtcggcgtagggttcggggttacggtacggggactaagggtaaccgtttccgtaacccgtttccgtacctaaccgtaccggttaccgaacgtcccggtacgtaccccggttagccgttaggttacccgttaaggttaacgtttacgttttcgtaaccgttttaagtttttaattgtttcgttaaccgtaacgttacgttaagtttaaaccgttaaccgttaacgggttccggtacccccgtttacggggtacgggttaaccgggttaccggaaccgggttaaacgggaccggttaaagggtaacggaaaaccgttacgaaaaccgttacggtaggtccggtaacctccggaacctacgttacttacgtttcgtcccgtttcttaccccgg

SEQ ID NO: 185206 - DNA, 620 bp, Homo sapiens
  misc_feature: GYAE6OF01A9GI3.14.23.C01.1.454.CMB.1.raw
  modified_base (204)..(204): a, c, t, g, unknown or other
  misc_feature (204)..(204): n is a, c, g, or t
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (314)..(314): a, c, t, g, unknown or other
  misc_feature (314)..(314): n is a, c, g, or t
  modified_base (613)..(613): a, c, t, g, unknown or other
  misc_feature (613)..(613): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaancgcccaccctctccgtgccagggccagtcagtagtgtagaagctaacttgcctggtaccagcagaacctggccaggcctccagctcctnatctntggtncactccgacgnggccagtcggtcgtcccaggccgtaggttccaggtcggcgtagggtcgggtacctggggaccaggtacgtttccacgttccaccaccctaatccacgtcacgtcctgactacgtctagtaagttatttcgacttagttttattagttgtaccagtactaagttaactaacttaacgtcggtacccttagggtacggtaaccgttccggacggtaacgggaccggtaaagggttagaaaacgttacgaaaaccgtacggttggtcgtactcgacctaccttattaccggttcgtttcctntaccccg

SEQ ID NO: 185207 - DNA, 785 bp, Homo sapiens
  misc_feature: GYAE6OF01CUQV8.14.23.C01.1.454.CMB.1.raw
  modified_base (207)..(207): a, c, t, g, unknown or other
  misc_feature (207)..(207): n is a, c, g, or t
  modified_base (308)..(308): a, c, t, g, unknown or other
  misc_feature (308)..(308): n is a, c, g, or t
  modified_base (321)..(321): a, c, t, g, unknown or other
  misc_feature (321)..(321): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtctccagccaccctgtctgtgtctaccgaaggggaaanacgccaccctctcctgcagggccagtcagagtgttagaagcaacgttagccgttaggaaccagcaaagaaccgtggaccaaggcctacccaggcctcctanatctagtcggtanctactcccaaccgagggccctaacgttcgggtacgtaccccgaagtacccgtaacgggtttccaagggttcggaccgtaaggggtttacggggaccgttaggggggaaaccctagggttaaccggtttacccgtaaccttacccggttaccgaaaaccctaagttaccggaagacccgtaacggtacccgttacgacgtacggttaaccgttaagggtaaaagtttaaccgtttttagggaaccttttaaaggtttttaaactttagtttacggttaacgtaacggtacttaaagggttaaacttaaacgtttaccggttaccggtacccgttaccggttacgggtaaccggtttaccgggaccgtaaacggggtaacctaaaggggtacgtaaaactaaccgaaaacggtagttacggtacggacgttacgaccgtactaactcttacgttcctacgttaacc

SEQ ID NO: 185208 - DNA, 702 bp, Homo sapiens
  misc_feature: GYAE6OF01BRGJY.14.23.C01.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (301)..(301): a, c, t, g, unknown or other
  misc_feature (301)..(301): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctcaggggaaancgccaccctntcctgcagggccagtcagagtgttagaagcaattagcctggtaccagcagaaacctggaccaggcctccaggctcctcatctatggtcncactcccgaccgacggggcctacgtgggtcgtccccgaagcccgtaagggttccagggttcggcctagggtcggggttacctggggacaaggtagtttccgaacttcctaccgacctagtccgaagtcgacgtccctgcctaagggttcctacgggtaagttacgtttttaggaccgtttaaggttttaatttacgtttgttacgtagtaccgtaagttaattaacgttaaaccgttccgggtacccgtttaccggttacgggttaccgtttcccgggaaccgtaaacgggggtaacccgtaaaaggggttaccggaaaacgttaccgaaaaaccgggtaacttagggttcggtaaccgttcgaaccgtaccgtaacttccggtgtttccgttcctacccg

SEQ ID NO: 185209 - DNA, 578 bp, Homo sapiens
  misc_feature: GYAE6OF01CSXJE.14.23.C01.1.454.CMB.1.raw
  modified_base (204)..(204): a, c, t, g, unknown or other
  misc_feature (204)..(204): n is a, c, g, or t
  modified_base (306)..(306): a, c, t, g, unknown or other
  misc_feature (306)..(306): n is a, c, g, or t
  modified_base (369)..(369): a, c, t, g, unknown or other
  misc_feature (369)..(369): n is a, c, g, or t
  modified_base (378)..(378): a, c, t, g, unknown or other
  misc_feature (378)..(378): n is a, c, g, or t
tcagcgtctagtaccacgaccggtgctcgatttagtacacgtgattagggatttggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagaagcaacttagcctggaccagcaagaaacctggcccaaggcctcccaggcctcctcatctatggtncactcccaccgacgggccacgtgtcgcccagccgaggttcaggtggcagtgggctgggacagngttcactcncacatcagcacgcctgcagtctagtaagtattttgcttagtttattagttgtctagtctaagttactaaattaacgtcggtccttacggtagggtaccgttcggaccgtaaaggggtacccgtaagggtacgaaagtaccgtaaaacggtacgttaggtcgggactacgacctaaccgtattcgtacgttcttcgtaccg

SEQ ID NO: 185210 - DNA, 799 bp, Homo sapiens
  misc_feature: GYAE6OF01A3DI7.14.23.C01.1.454.CMB.1.raw
  modified_base (208)..(208): a, c, t, g, unknown or other
  misc_feature (208)..(208): n is a, c, g, or t
  modified_base (252)..(252): a, c, t, g, unknown or other
  misc_feature (252)..(252): n is a, c, g, or t
  modified_base (322)..(322): a, c, t, g, unknown or other
  misc_feature (322)..(322): n is a, c, g, or t
  modified_base (785)..(785): a, c, t, g, unknown or other
  misc_feature (785)..(785): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgctagtctccagcccacctgtctgtgtcctacgaggggaaacncgcccacctctccgtgcgagggccagtcagtagtgttaacgaanactaacgtttacgccgttacggtaccagacgaacgaaaccgtggaccacggcctcccgaggtcctccctntaacgttctaggtggtacacctacctcccgaaccggcggtcctaacggttcggtacccgtcccgacggccgttacgggttcgacggttcggtcgtacggggttcggggtaccgtaggggaaccgtaggttaccgttacctaaccgttccgtaaccccgaacgttctacccggaacggtcctaccgggtcccctaggtacccgttacgggttaactacggggtaaacttttcggtttacgtaacgttttaacggtttttattccgttaggttaccgtacgttaacgttaaacgttaaattaaccgttaccggttccggtaccgggtttaccggtaaccggggttccgttaaccgggaacggttaaccggtaacgggtaaacggtaaacggtaactaaaccggtaacgtacggttagggtcccgttacggacgtaccttaccgtagttacccttacggtttaccnccgtttaaccccgg

SEQ ID NO: 185211 - DNA, 739 bp, Homo sapiens
  misc_feature: GYAE6OF01CVLNX.14.23.C01.1.454.CMB.1.raw
  modified_base (722)..(722): a, c, t, g, unknown or other
  misc_feature (722)..(722): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagactaccactggaagtaaattagtgaatgacgcagtctccagcccaccctgtctgtgtctccgaggggaacacgcccaccctctccgtgcgacgggccagtcagtagttagttaagaagtcctaacgtttacgcccgttagggtaccaaggtccgaaacgtaaacccgtgggacccgaagggtcccttacccgaacggtcccttacctctaacttcgtaagttcgggttacgacctaacgtccccgaaacccgcggggtaccctaacggttcgggttccgtaccccgtacggtcccggtaagggttttccgaacggtcgggtaccgtaggggttcggggtacgtggggaactagggtaactttccaccgttctaccgacctatccgacgtcgaccgtccgttcgacgtacgttcgtaaggttaacgttagttttcccggattttaagttttattacttgtacgtagacgttaagttaataaccgtacgtcggtacccgttcgtacgggttaccgtccggaacggtaaggtaccgaaggggtaactaactacgaacgtaacgtgtaggcctacgactacgtactnttcgtcttaaccgtccg

SEQ ID NO: 185212 - DNA, 695 bp, Homo sapiens
  misc_feature: GYAE6OF01C1O7I.14.23.C01.1.454.CMB.1.raw
  modified_base (157)..(157): a, c, t, g, unknown or other
  misc_feature (157)..(157): n is a, c, g, or t
  modified_base (176)..(176): a, c, t, g, unknown or other
  misc_feature (176)..(176): n is a, c, g, or t
  modified_base (209)..(209): a, c, t, g, unknown or other
  misc_feature (209)..(209): n is a, c, g, or t
  modified_base (223)..(223): a, c, t, g, unknown or other
  misc_feature (223)..(223): n is a, c, g, or t
  modified_base (319)..(319): a, c, t, g, unknown or other
  misc_feature (319)..(319): n is a, c, g, or t
  modified_base (686)..(686): a, c, t, g, unknown or other
  misc_feature (686)..(686): n is a, c, g, or t
tcagcgtctagtaccacgaccggtgctcgatttagtacacgtgattagggattgggggaggaactgctcagttaggacccagacggaaccatggaagccccagcgcagtcttctcttcctcctgcttactctggcctacccagactaccagtggaanaaatgtgatgacgcagtcnccagccacctgtctgtcgtctaccgaggggaanacgcccacccttcncctgcacgggtccagtccaagtagttgtaagacgctaacgttagccttagggaaccagcaaagaacctcggaccaggcctaccgaggcctacctanactctaagttcggacactactacccgaaccgtacgggcccttaacgtcggttaaccgccccgtaagtcccggtaagggttaccgaagggttcggaaccgtggggttacggggttccgtacggggtaaacgaagtacggtttacccacgtttccgaacctaacgttactacgaacgtaccaacccggtcgtacgtacgtaacggttacgtaacggtaaagtttaccgtttagatttaaacggtttatttaaggtctacagtactagtaactatacgtcgtacgtcgtagtacgttacgacggaggaacgtaacggaagtaaccgtaagaaacgtagtcgtacgggtcacgactaccggtactagttcncttgtaccc

SEQ ID NO: 185213 - DNA, 708 bp, Homo sapiens
  misc_feature: GYAE6OF01CZ32X.14.23.C01.1.454.CMB.1.raw
  modified_base (187)..(187): a, c, t, g, unknown or other
  misc_feature (187)..(187): n is a, c, g, or t
  modified_base (696)..(696): a, c, t, g, unknown or other
  misc_feature (696)..(696): n is a, c, g, or t
  modified_base (702)..(702): a, c, t, g, unknown or other
  misc_feature (702)..(702): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccacctgtctgngtctccgaggggaaatcgcccacctctccgtgacacgggccagtccgagagttagttaacgaaagtcctaacgttagccgttaggaccagcgaacgaaaccgtgggaccaagggcctcccgaaggccttacctcaactttccgtagttcggtgacctaacttccccgaaaccggtacgggggccctaaaccggtttcgggttccgtaccccctaagttcccgtaacgggtttccgaaaggtttcgggccgttaaggggttacgggtcctagggggaaccctaggtacgtttactccgtactacccaactactccgaagtcctacgcccgttgacgtagtcttaacgaaggttattttcggactttaggttttattaacgttgtacgtagtactaaggttaataaacgtaacgttcggccgtttacggacgtaccgtttcgggacccgaaaggttaaccgtagggtacgttaaagaccgaaacgttagtcggttagcgtacactacgatntacgtntactcg

SEQ ID NO: 185214 - DNA, 897 bp, Homo sapiens
  misc_feature: GYAE6OF01BH9EX.14.23.C01.1.454.CMB.1.raw
  modified_base (206)..(206): a, c, t, g, unknown or other
  misc_feature (206)..(206): n is a, c, g, or t
tcagcgtctagtaccacgaccggtgctcgatttagtacacgtgattagggattgggggaggaactgctcagttaggacccagacggaaccatggaagccccagcgcagcttctcttcctcctgccttactctggctcccagataccactggagaaatagtgatgacgcagtctccagccaccctgtctgtgtctccgaggggaaangccaccctctcctgcgagggccagtcagagtgttaagaagctaacgttacgcctaggtaccagacaacgaaacctggaccgacggtcctcccgaggtcctccgtcactctagtcggtgcactccacgacggccacgtggtcgtcccagtccgtagttcgacgtcggacgtacggttggggtaccgtaggggacgtaaggttacggtttaccctacgttacccttaccaaacccgtagtaccggaacgtacccgtaaccgggttccccgtacggtaccgtaacgggttaccccgttaaagggttaaacggttttaccgtttttacggaaaccgtttttaaggtttttttaacgtttaacgttttacgggtaaccctaacgggttaacccgtttaaagggtttaaacccttaaaccggttttaaaccggtttccccggggtaaccccggtttaccggggttacgggtttaaccccgggtttaaccggggaacccggttaaaaccgggggaacccggtttaaaggggttaaaaccggtaaaacccgtttaaacccgggtaaaaacccggttaccggggtttaacgggggttcccggtaaccccgtttaacgggtaaaccccccgttaaacccggtttagttttaacccccgggtttaccgttttaaacccccgttttccggggttaaccccccg

SEQ ID NO: 185215 - DNA, 852 bp, Homo sapiens
  misc_feature: GYAE6OF01DT50J.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctcctgctactctggctcccagactaccacgtggagaaatagtgatgacgcagtcctccagcccaccctgtctgtgtctccgaggggaagacgcccaccctctcctgcgacgggccagtacaaggtagttagttaagaacgactaaacgttcgaccgtcggtaaccacgacgaaacgaaacccgtggacccgaacggccctacccgaaggtcccttacccactacttacgtaaggtcggtcgacctacgtacccgaaccggacgggcctacggttggtccgtacccgacggtacctagggttcgaggtcgggcgtagggtcggggtacgtagggacgtacggtaccgtttcaccgttccgtaccaacgtacgtaccgacgacgtaccgtcccgtaggtacgtaacgtttacggtaacgttaaacggtttatttttacggtacgttttaagttttttaacgtttacggtttacgttaacgtagttaaccggttaagtttaaacgttaaaccgtttaccggttacccgggttaccccgtttcgggttaaccggggttaacccgtttaccggggaaacccggttaaacggggtaaaccccgggttaaaggggttaaaccgggtaaaacttaacccgggtaaaaacggttaaccgggttcggttaacccgggaaccttcggaaaccccgttaaccgttacgtttaaccgtttccgttaaaccgtttccgttaaaccccg

SEQ ID NO: 185216 - DNA, 669 bp, Homo sapiens
  misc_feature: GYAE6OF01E44EG.14.23.C01.1.454.CMB.1.raw
  modified_base (204)..(204): a, c, t, g, unknown or other
  misc_feature (204)..(204): n is a, c, g, or t
  modified_base (619)..(619): a, c, t, g, unknown or other
  misc_feature (619)..(619): n is a, c, g, or t
tcagcgtctagtaccacgaccggtgctcgatttagtacacgtgattagggattgggggaggaactgctcagttaggacccagacggaaccatggaagcccccagcgcagcttctcttcctcctgctactctggctcccagataccactggagaaatagtgatgacgcagtctccagccaccctgtctgtgtctcgaggggaaancgccaccctctcctgcagggccagtcagagtgtagagcaacttgcctggaccagcagaaacctggccaggcctcccgaggcctccgtcacttctagtcggtcgcctactccccgaaccggacgggtcccctacgttcgggttccgtacccccaggtcccgtagggtttccgaagggtcggtaccgtaggggttcggggtcgtacggggaactaacggtacgtttccaaccgttcctaccaccctagtccgaacgccgacgtccctggacctacggttccgttaagtaacgtttacgtttttcgaacgtttagtttttaattagtttcgtacgtaacgtactaagttaactaacgttaaccgtcggtccgttacggtcggtacgttacggaccgaacggaccgtaggtaacgaaanaccgtaaacgagtcggtcgctacgcctaacttctctcgttccgtctcccg

SEQ ID NO: 185217 - DNA, 801 bp, Homo sapiens
  misc_feature: GYAE6OF01DJZCQ.14.23.C01.1.454.CMB.1.raw
  modified_base (211)..(211): a, c, t, g, unknown or other
  misc_feature (211)..(211): n is a, c, g, or t
  modified_base (224)..(224): a, c, t, g, unknown or other
  misc_feature (224)..(224): n is a, c, g, or t
  modified_base (358)..(358): a, c, t, g, unknown or other
  misc_feature (358)..(358): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctccagataccacgtggaagaaatagtgatgacgcagtcctcacgccaccctgtctgtgtcctacgaaggggaacgacncccaccctctccngcgacgggccagtcaggtagtagttagaacgaccgtaacgttacgccgttaggaaccagacgaaacggtaaacccgtcggacccgacggaccctacccgacggtcctaccgtactacgttacgtaggtcggtanactaccgacccgtaccggacgggtacctacggttccggtccgtaacccgaccgtaccggtacggttcgagttcggcgtagggttcggggtacgtaggggaactaggtaacgttccgacccgtttaccaccgaccgtagtaccgacgtaccgtccgtacgtaccgggtaccttaggttactaaggtaaactttagttttacggtactttaagttttacgttagttccgtacgtaacttaacgttaaagtttaacgtaaccgttacggcccgtttaccgggtttaccggaccggggtaaccctttaccggggaaccggtaaacgggtaaccggtaaagggtaaccgtaaccgttaaacgaaaaccggttaagggttggtaaccgggtcttaaccggaccctaaacggtttaccgtattttacccggtaccctttcgtaaccccgg

SEQ ID NO: 185218 - DNA, 895 bp, Homo sapiens
  misc_feature: GYAE6OF01DXVC2.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctcctgctactctggctaccagactaccactggaagtaaatagtgactggacgctagtcctccacgcccaccctgtctagtcgtcctaccggaaggggaaacaccgccccaccccttctcccgtaggcgacgggtacccaggtaccgaggtagttaggttaaggacgtactaaacgttacgtccgtacgggtaccaagaccgaaaccgaacccgtcgggacccgtaccggtacccttacccggacggttccccttaccgtaccgtaacgtttacgttaacggtttcgggtccgtaaccctacccgtaaccccggaacccggggttacccgggaacccttaccggtttccgggttaccccggtacccccgaacggtttaccccgaacgggttttaccggagggggtaccggtaacggttaggggttcccgggggtacgttaaccggggacgtaacggttccgtttaaccacccgttaccttaccgaacccgttaaagtcccacgtaaccgtaccgtccgttcgaccgtacggttacgttaacggtacgttttacgtttaccgtagttttaaacggttttctaggtttacgtactaaggtaccttaagtttaataaccgttaccggtaccggttcccggtagggttacgggttaaccggtaaccgggtacccggtaaccgggtaaccgttaaaggtacggttaaactaacggtaacgtacgtttagggcttaccggtaccttacggaccttagttcccgttacgttcccgttacgtcccg

SEQ ID NO: 185219 - DNA, 988 bp, Homo sapiens
  misc_feature: GYAE6OF01EG3EM.14.23.C01.1.454.CMB.1.raw
  modified_base (206)..(206): a, c, t, g, unknown or other
  misc_feature (206)..(206): n is a, c, g, or t
  modified_base (316)..(316): a, c, t, g, unknown or other
  misc_feature (316)..(316): n is a, c, g, or t
  modified_base (334)..(334): a, c, t, g, unknown or other
  misc_feature (334)..(334): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtctccagccaccctgtctgtcgtctaccgaggggaancgcctaccctctcctgcgagggccagtcagtagttgtagaagctaacttagcctaggtaccagacaacggaaaccgtcggaccgacgggtcccgtcccgggcctcccgtnacgttcgttagtcgggtnaccgtacctcccgaacgaccgggacctacggttcggtaccgtacccgaaggtcccgtagggtttaccgagggttcggacgttaaggggttcggggttacgtacggggaacctaagggttaaccgtttccgtaaccgtttcccgtaacctaacccgtagttaccccgaacggtacccggtaacgggtacccgttaccggaacggtttacggtttaaccgttaaagggtttaaacggttttacgtttttacggaaccgttttttaaagttttttaacgtttaacggtttaccggtaacctaagggttaacccgtttaaaggtttaaacccgtttaaaggtttaacccccgggttccggggttttaaccccccgggttacggggggttttaaccccgggggttaaacccgggttttacccggggggaaaacccgggtaaccggggggtttaaaaccccggtaaaaggggggtttaaaacccggttaaaaaaccccgggttaaaaccggttaaaaaccccggggtttaaccgtttagggggggtttaaccccggtcccgttaaaaccggtaccccgttaaaaaccccggtttcggtttaaccggtttaccccgtttttaccccgttaaaccgtttaacccccggttttacccccccgg

SEQ ID NO: 185220 - DNA, 970 bp, Homo sapiens
  misc_feature: GYAE6OF01ESK75.14.23.C01.1.454.CMB.1.raw
  modified_base (228)..(228): a, c, t, g, unknown or other
  misc_feature (228)..(228): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggcctcccagactaccactgggaataaacttaggtgaactgaacgcgagtcctccagccctacccgttggtctgttgttcctaccggaaggggaaaanccgtacccctaccccgttctcccgtggaccgtacgggggacctaacggttccgaaaggttacggttagtttaaaggaaaacgtccttaaacgttttacggacccgttacgggtaacccgtaggtacccaacggttaaaacccgttcgggaccccgaacggtcccttacccgtaacggtcccttacccgtacgtaactttacgttacgttacggtcgtaccctaaccgttacccgaaccggacgggtacctaacggttcggtaccggtacccgtaacggtccgtaagggttccgtaggtaccggagtacgggtggtaccgtagggaactaggttacgttaccacgtccgtaacctaccggtaactccgaacgaccgttaaccgttcccggtgtaacccgtacggttacgttaacggtaacgttttacgttttaacgttcgttttaaacgtttttagttaagtttttccgggaacttaacggttaccgttaaaagtttaaaccgtttaacgtaaaccgtttaccccgggtacccgttaacccgggttttaacgggttaaccccgggttaacccggaaaccgggttaaaccggggtaaaccgttaaacgggtttaaaccggaaaacgtttaacccgggaaaaccggttaaaccgtttacggggttaccccggaaccggtttacccgaaaacggttaccctaacccgttttaccgtacccgtttttacgacccccgggtttaaccc

SEQ ID NO: 185221 - DNA, 743 bp, Homo sapiens
  misc_feature: GYAE6OF01AMP5P.14.23.C01.1.454.CMB.1.raw
  modified_base (204)..(204): a, c, t, g, unknown or other
  misc_feature (204)..(204): n is a, c, g, or t
  modified_base (420)..(420): a, c, t, g, unknown or other
  misc_feature (420)..(420): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcgagggccagtcagagtgttagagcaactgcctggtaccagcagaacctggaccaggcctcccgaggtcctccgtcatcgtagtcggtcgcactccgacgacggccctacgtggtcgtacccagcccgtagggttccaggtcggccgtagggttcgggtcgtcggggaacaggtacggttaccacgttccgtacaaccctntaccgacgtcctacgtcctaggtacgtacgttccgtaaggttaacgtttacttttacggaccgttttaagtttttaaacgtttgtttaccggtaacgtaacggttaccgttaaagtttaactttaaacggttaacccggtccgggttaccccgtttaccgggttacgggttaacccggttacccgggtaacccggaaaggggtaacccgtaaggggttaaacgtaaaacggttaacccggaaaaccggtacggttacgggtacgggtacccgttacggaaccctaacgttacgttacccgtttagttcccgttacgtaccccg

SEQ ID NO: 185222 - DNA, 895 bp, Homo sapiens
  misc_feature: GYAE6OF01CZVEF.14.23.C01.1.454.CMB.1.raw
  modified_base (172)..(172): a, c, t, g, unknown or other
  misc_feature (172)..(172): n is a, c, g, or t
  modified_base (550)..(550): a, c, t, g, unknown or other
  misc_feature (550)..(550): n is a, c, g, or t
tcagcgtctagtaccacgaccggtgctcgatttagtacacgtgattagggattggggggaggaactgctcagttaggacccagacggaaccatggaagccccagcgcagcttctcttcctcctgctactctggctccagataccactggaagaaatagtgatgacgcagtcnccagcccacctgtctgtgtcctccgaaggggaacacgcccaccctctcctgcgagggccagtcaaggtagttgtaagaagactaactacgcctggaccagcaaacgaaccgtggaccaggcctacccggaggtcctacctactacgtacttagtcgggtacaccgtaacctacccccggaaccggtaacggggtccctaacggttcggggttaccccgtacccccggaacggtaccccggttaacgggttaccggtaacggggttcggggacccggttagggggggtttccggggttaccgggttaacggggggaaaccttaacggggtaccgttttaccccgaacccgttttaccctaacccgtaaacccgtttaanaacccggtaacggacccggtaaacccggttcccgttacgggtaacgttacgggtttaacgttaacgggtaaaagtttttccgtttttacggtaacgtttttaaacggttttttaatttcgggttacgttaacccgtaggttaactttaaacgggtttaaattaaaccggttaacccgttcgggttacccgttacgggttacggtaacccggttaaccgggaccggaaaaccgggggtaattaaacggggtaaacgtaaaccttaacgggaaaacggttaccggttagggtaccggtctaaccggaccctaactttagttccggttacttccttccgttaaccccg

SEQ ID NO: 185223 - DNA, 697 bp, Homo sapiens
  misc_feature: GYAE6OF01EC04W.14.23.C01.1.454.CMB.1.raw
  modified_base (211)..(211): a, c, t, g, unknown or other
  misc_feature (211)..(211): n is a, c, g, or t
tcagcgtctagtaccacgaccggtgctcgatttagtacacgtgattaggggattggggggaggaactgctcagttaggacccagacggaaccatggaagccccagcgcagcttctcttcctcctgctactctggctcccagataccactggagaaatagtgatgacgcagtctccagcccaccctgtctggtcgtctccgaaggggaaacncgcccaccctctcctgcagggccagtcagagtgtagaagctaacgttgcctaggaccagacaacgaaaccgtggaccacggcctcccgaggtcctcctacacttctagtgggtcgacctacctcccgaacccggacgggacctacggtcgggtccgtccccgaggtcccgtaggttccaggttcggacgtaggggttcgggtcgtaggggactaaggtacgttcactcgtcacctagtcgagccacgtccctgctagtctaggtaagttgttttcacgtttagtttttaattagttcgtactaaggtctaaagttaacttaaacgttaaccggtcggtaccccgttacgggtacgggttaacccggttccgggaaccggaaacggggtaacccgtaaggggtacgtaaaacgtaaccggaaaacgttacgtcgggtacgccgtaaggaccctaacgttacgtccttacgtttccctacgttacccg

SEQ ID NO: 185224 - DNA, 787 bp, Homo sapiens
  misc_feature: GYAE6OF01B63F2.14.23.C01.1.454.CMB.1.raw
  modified_base (154)..(154): a, c, t, g, unknown or other
  misc_feature (154)..(154): n is a, c, g, or t
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
  modified_base (306)..(306): a, c, t, g, unknown or other
  misc_feature (306)..(306): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggcctcccagactaccacgtgganaaatagtgatgacgcagtctccacgccacctgtctgtctctacgaaggggaanacnccaccctctcctgccgagggccagtcagtgtcgtagaagccaattcgcctagaccgagacacgaaacctcggaccgcggcctccgaggtcctcctntaactctaggtcggtagctactacccgaccggtccgggacctaccgttggtcccgtacccggacgtaccggtaggttaccgagtccgggacgtacgggtcggggttcgtacgggtaacgagttccgttctacccgttcgtaccaaccgtacttcgacgtcgtaacctccgttacggtacctaagtccggttagaacgtttaccgttttagtacctttaagtttttaacttcgggtttataaccggtcttacccggtaaaagtttaaccggtaactttaaccgttaccgggggttacccttacccgggttaacgggttaccggttaacccgggtaccgggtaaaaaccgggtaacccgttaaaggggaaacccgttaaaaccggaccttaaaaaccgggtacgggttacgggttaaccgccgtttaaccgaaccccgtacttacgttttaccccgtacggttttaccctaaccgttaccccg

SEQ ID NO: 185225 - DNA, 783 bp, Homo sapiens
  misc_feature: GYAE6OF01CY81P.14.23.C01.1.454.CMB.1.raw
  modified_base (212)..(212): a, c, t, g, unknown or other
  misc_feature (212)..(212): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggcctcccagataccacgtggaagaaatagtgatagacgacagtcctccagcccaccctgtctcgtgtctccgaaggggaanacgcccaccctctcctgcgacgggccagtacaaggtagtacgttagaacgactaacgttacgtccgtacgggttaaccagtaccgaaacggtaaaacccgtggaacccgacgggtacccttacccgaagggtacctacccttacgaactttaccgtaagtcgggtacgacctacgtaccccgaacggacggggaccctaacggtcgggttacccgtaaccccgaggtaaccccgtaggtttacggaacggttcgggaccgtagggttcgggggacgttacgggggaaactacgggtaacgtttacccaccggtttactcccgaaacgtacgttacacgaccgtacgtcccgtagtaccgtagttacgttagtaaacggtttacttttcgtaacgtttaagttttattacgttacgtacgtaagtaaccgttaaggttaactaaacgttacgtacggtaccttacggtacggtttaccgaccggtacgaagggtaacccgtaaagggactaaagtacgaaaacgtacggtagtaacgcgtagacctactaagtcctaacggtctagtacccg

SEQ ID NO: 185226 - DNA, 694 bp, Homo sapiens
  misc_feature: GYAE6OF01C0BE4.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtctccagccaccctgtctgtgtctccgaaggggaacagcccaccctctcctgcacgggccagtcagagtgtagagactacttagcctggacagcaagaacctggaccaggcctaccgaggcctactcactcgtagtcggtacgctactcccgaaccgacggggtccctaacggttgggttcctaccccgtagtacccgtagggtttccgaaggtcggcgtaagggttcggggtcgtaggggactaggtacttcacgttcaccacataccgagctacgtccgtacgcgtacgtcgtaggtaagttagttttacggtctttaagtttttaacttttgtacgttacgtacgtaactaagttaacgtaaactaacggttccggtacccgttacggtacgggttaccggttacgggaccggtaaagggtaaccgtaaagggtaacggaaacgttaaccgaaaacggttacgttagggtaccgtactacggacctacgttaaccgtccgtttaacttccgttcctaacccg

SEQ ID NO: 185227 - DNA, 704 bp, Homo sapiens
  misc_feature: GYAE6OF01DHB9J.14.23.C01.1.454.CMB.1.raw
  modified_base (203)..(203): a, c, t, g, unknown or other
  misc_feature (203)..(203): n is a, c, g, or t
  modified_base (309)..(309): a, c, t, g, unknown or other
  misc_feature (309)..(309): n is a, c, g, or t
tcagcgtctagtaccacgaccggtgctcgatttagtacacgtgattagggattggggggaggaactgctcagttaggacccagacggaaccatggaagccccagcgcagcttctcttcctcctgctactctggctcccagataccactggagaaatagtgatgacgcagtctccagccaccctgtctgtgtctcgaggggaancgcccaccctctcctgcgagggccagtcagagtgtagaagctaacttagcctggaccagcaacgaaccgtggaccaggcctcccgagcctctcatctagtcggtcncactcccacgacgggtccacgtcggttccgacccgacgccgtaggttcaggtcggacgtagggttcggggtctagggggactaaggtcgttccaccgttctaccgaacctatacggacgcctaacgcccgttaggcgtaaggttccttaaggtaaaggtttcgttttacgacgttttaaagtttttaattcgtttacgttacgtacggtaacttaaggtttaaattaaaccgttacggttccgggtccccgtttacgggtcgggtttaaccgttaacccggggacggtaaaccggggttaaccgtaaaggggtaacgaaacgttaaccgtaaaaaccggtggttaggttcggacgttacgacgtaaccttaggttcttacggttccttcgtaccc

SEQ ID NO: 185228 - DNA, 879 bp, Homo sapiens
  misc_feature: GYAE6OF01EM45D.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccacctgtctgtgtctccgaggggaaanacgccaccctctcctgcgacgggccagtcgagtacgtagttaacgaacgactaaacgttacgccgtaggtaacccagacaaacggtaaacccgtggacccgaacgggtccctacccgaaggtcccttccctactaattccgttagtcgggtcgacctaccgttacccgaaccggacgggtaccctacggtttcgggtccgtaccccgaagtcccggtaggttccgaggttcggaccgtagggttcggggtacggtacgggaacgtacggtacggtttcaccgttacctaccgaaccgttaacgtaccgaacggtccgaccgtcccgtaggtacccgtagttaccgttaaggttaacgtttacgtttttcggtaacgttttaagtttttaagttttacgtttacggtttaccgaaaggttacggttaaaacgtttaactttaaaccggttaaaccgggttcccgggttacccggtttaccgggtttaacccggggtaaccgggttacccggggtaaccggtaaaaccggggtaaccggttaaaacggggtaacgttaaaaacccgttaaccggtaaaaaccggttcgggttaaccgggttacggggtacccttaaaccggacccggtttaaccctacgttttccggtttcccggtttaacctcccggttaaccccgg

SEQ ID NO: 185229 - DNA, 743 bp, Homo sapiens
  misc_feature: GYAE6OF01ARDWZ.14.23.C01.1.454.CMB.1.raw
  modified_base (171)..(171): a, c, t, g, unknown or other
  misc_feature (171)..(171): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccatggagtaaatagtgatgacgcagtcnccagccacctgtctgtcgtctcaaggggaacacgccaccctcgtcctgcgacgggtcagtcagtagtgttaagaacgcaaacttggcctggaccagcaacgtaacctggccacggcctaccaggtcctctcaatctaacgtggttcgactactccacccggacggtccaccggttggtaccgtccaacggtccctagggttccgaggttcggaccgtaggggtcggggtttccgtaggggaactacgggtaacgtttaccgacctacgtacccaaacctagtaccgaacggtcctaacggccctaacggtcgtaaggtttacgaacggtaacgttaggttttacgtacgttttaagtttttagtttaactttagttaaccgtaagtaccgttaagtttaaaacttaacgttaaaccgttcggtaacccgttccgggttaacggttaccggggtaacccgtacgggaaacgggtaccggtaaagggttacgtaaaacggtaaccgaaacggtaaacggttcggtacggttaacgtcgtaacgtactacgttacgttacgttccttcgtaaccg

SEQ ID NO: 185230 - DNA, 767 bp, Homo sapiens
  misc_feature: GYAE6OF01BTZCT.14.23.C01.1.454.CMB.1.raw
  modified_base (123)..(123): a, c, t, g, unknown or other
  misc_feature (123)..(123): n is a, c, g, or t
  modified_base (225)..(225): a, c, t, g, unknown or other
  misc_feature (225)..(225): n is a, c, g, or t
tcagcgtctagtaccacgaccggtgctcgatttagtacacgtgattagggattgggggaggaactgctcagttaggacccagacggaaccatggaacgccccagcgcagcttctcttcctctnctactctcggcctcccagactaccacgtaggaagtaaagtgtagagtagacgtcacgtctaccacgccctaccgtgttctgtcgtccgtacgaaggggaacnccgaccctacccgtctacccgtgcggacgggcctaagtcgaaggtacggttacggttaagaacgtaccttaaacggttacggtaccttacgggaccgacgtaacgaaacgaacccggtacggaccacgggtaccttacccgaacggccttaccgtactacgttcgtacggttcggaccggacctacctacccggtaaccggacgggtcctaccgggttcggtcccgtaccgacgtacggtacggtacgagggtccggtggtacgggtcgggtacggtacgggacttacggtacgttaccgaacttccgtaacacttcgacgacgtaccgccgtacgtacgacgttacgtagttaacgtaggtttattacggtagtttacgtttagtccgttagtactaggttaactaagtacttaacggttacctaccgttcggttaccggtacgggttaacccgtcggaacgttacgggaacgtaaggtaacgaacacgtaacggtagtcggcgtacgtagtccctagttcgattacgtcccgtgtacccg

SEQ ID NO: 185231 - DNA, 809 bp, Homo sapiens
  misc_feature: GYAE6OF01A702L.14.23.C01.1.454.CMB.1.raw
  modified_base (186)..(186): a, c, t, g, unknown or other
  misc_feature (186)..(186): n is a, c, g, or t
  modified_base (202)..(202): a, c, t, g, unknown or other
  misc_feature (202)..(202): n is a, c, g, or t
  modified_base (204)..(204): a, c, t, g, unknown or other
  misc_feature (204)..(204): n is a, c, g, or t
  modified_base (225)..(225): a, c, t, g, unknown or other
  misc_feature (225)..(225): n is a, c, g, or t
  modified_base (233)..(233): a, c, t, g, unknown or other
  misc_feature (233)..(233): n is a, c, g, or t
  modified_base (778)..(778): a, c, t, g, unknown or other
  misc_feature (778)..(778): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtcctccagccacctgtcngtgtctccgagggaancnccacctctccgtgcgaggccngtacaggngtgttagaagctaacgttgaccgttaggtaccagtaccaacggaaaccttcggaccgtaacgggtccccgttacccccggacttccctacctagttccgttaagtcggggttcacctaccgtccccgaacccgggtacggggtcccctaacggttcgggtacccgttccccgaacggacccggttagggtttaccgacgggttcgggaccgttacggggttcggggttacgtacgggggtcctaagggtaccgtttaccaacgttccctaccgtaacctacgttacccgaaggcccgtacgtcccgtaacggtccgtacgttacggtaacggttaacgtttacgtttcggtaacgtttaagtttttagtttagttacggttacgtaacgttaacgttaagttaattaaaccggttacggttaccggtcccggtacggttaccggggttaccggttccgggaaccgggtaacggtaaccgggtaggtaaaccgtaaacgtaaccgtaaaggtaccgttagggccgtacgtcgaccctaacgttacnccgttacgtttcgttacctccgggttacccc

SEQ ID NO: 185232 - DNA, 830 bp, Homo sapiens
  misc_feature: GYAE6OF01DH0TF.14.23.C01.1.454.CMB.1.raw
  modified_base (211)..(211): a, c, t, g, unknown or other
  misc_feature (211)..(211): n is a, c, g, or t
tcagcgtctagtaccacgaccggtgctcgatttagtacacgtgattagggattgggggaggaactgctcagttaggacccagacggaaccatggaacgccccagcgcagcttctcttcctctgctactctggcctccagactaccactggaagaaatagtgatgacgcagtctccacgccaccctgtctgtcgtcctccgaaggggaaacncgccctaccctctcctgcgacgggccagtcagtagtgtagaacgctaacgttacgccgttacggaaccagaccgaacgtaaacccgtgggacccacggtcctacccggaggtccctacctctacttctagttggcgacaccgtacccgacggacggtcctacggtcggtccaccgacgacgtaggtcgacggtcggacgtacggtgggtcgtagggactaggtacgtttcacttacccacgtaacctcgtaccgacggtacccgtaacgtcccgtaacgtacgtacggtttaccgttaaggtttaactttagggttttaccgtaacgtttttagtttttaaacgttacggttttacgtaacggtaacgttaattaaaggtttaaacttaaacccggttaccggttacccgggttacccggtttacccggggttaaccgggttaccgggtaaccccggggtaacgtaaaaaccgggggttaaccgtaaaaggggttaacccgtaaaaaccgttaaacccgggtaaaacggttaacccggttcgggtaaaccggccgttaacccgacccgttaactttaccggttacccggtttactttaacccggtcctttaaaccccgg

SEQ ID NO: 185233 - DNA, 787 bp, Homo sapiens
  misc_feature: GYAE6OF01CFV1D.14.23.C01.1.454.CMB.1.raw
  modified_base (205)..(205): a, c, t, g, unknown or other
  misc_feature (205)..(205): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccatggaagaaatagtgatgacgcagtcctcagcccaccctgtctgtgtctccgaggggaaanacgcccaccctctcctgccgacgggccagtcagagttgtagaagctaacgttacggcctaggaccagacaacgaaccgtggcccgaggtccctacccgaggtccctcctctactccgttagtcggtcgactactacccgaccggaccgggtccgacgttcgggttccgtcccgacgcccggttacggttacgtacgggtcggtaccggtagggttcgggggttaccgaggggtaacctagggttaccgtttaccgtacttacccgtacgaacccgtacttccgaacggtcccgtaacggtccccgttaggtacccgtaggttaccgttaaggttaagtttacgttttagttacgtttaacggtttttttaattacgtttacggttactacggttaacgtaacgtttaaacttaaacgttaacccgtccgggtttaccgttacccgggttaggttacccgggttaaccgggaaccgttaaccggggacgtaaacgggtaacgtaaacgttaccggaaaacgttacggaggtttaccggctaccggtaaccgtaccgtattccgttacttccgttcttacccgg

SEQ ID NO: 185234 - DNA, 727 bp, Homo sapiens
  misc_feature: GYAE6OF01B90L7.14.23.C01.1.454.CMB.1.raw
  modified_base (254)..(254): a, c, t, g, unknown or other
  misc_feature (254)..(254): n is a, c, g, or t
  modified_base (376)..(376): a, c, t, g, unknown or other
  misc_feature (376)..(376): n is a, c, g, or t
  modified_base (413)..(413): a, c, t, g, unknown or other
  misc_feature (413)..(413): n is a, c, g, or t
  modified_base (478)..(478): a, c, t, g, unknown or other
  misc_feature (478)..(478): n is a, c, g, or t
  modified_base (683)..(683): a, c, t, g, unknown or other
  misc_feature (683)..(683): n is a, c, g, or t
  modified_base (700)..(700): a, c, t, g, unknown or other
  misc_feature (700)..(700): n is a, c, g, or t
tcagcgtctagtaccacgaccggtgctcgatttagtacacgtgattagggattgggggagaactgctcagttaggacccagacggaaccagtggaacgccccagcgcagtcttcctcttcctcctgctactcgtggcctcccagtactaccacgtaggaagaaatggtagagtgaacgcagtcctccacgcccaccgttggtctggtcgtaccaccgggaaagggtaaacgccgtcccctacccgttcgtaccncgaccggacgggtccagtcgaggtagtacgtaagaactactaacgttacgcgtacgaccagacaaccgaccgtggccgtagccctaccggatcctcctgatacgttgcgtcacctacgaccncggacggtccagttcgccgccagtaccggtgtaccgnggtaccgcgtagggttcggtaggacggtacggtactaccgtttaccaccgtccttaaccggaacngacccggacgtctaccgtacgtcgtacgtaccgttcgaaggtttacgtttaggttacttcgtttaaagttttaagtaccgtttgtaacctaggttaattaaccttaacgtaacggtaaccgttccggtttaccgtacccgggttacggttacgggtacccggaaggtaaaccgggtccggttaaggaaacgtacgaacgtaacgnggttcgacgtcgtaacncgtacgtacttctactcgtccgtaccg

SEQ ID NO: 185235 - DNA, 767 bp, Homo sapiens
  misc_feature: GYAE6OF01C8Z6V.14.23.C01.1.454.CMB.1.raw
  modified_base (210)..(210): a, c, t, g, unknown or other
  misc_feature (210)..(210): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggcctcccagactaccactggaagaaatgtgatgacgcagtctccagccaccctgtctgtagtctaccgaagggggaaanacgcccaccctctccctgcgacgggcagtcaagtagtgtaagaacgtctaacgttacgccgtacggtaaccgagacgaacggtaaaccgtcggacccgtaggccctacccgaggtccctcctacacgttcgtagtcggtcactacctcccgaccggacgggtccacggttcggtccgtaccccgagtacccgtaggttcgaacggttcgacggtagggttcgggtcgtagggaacgtacggtacgttacaccgttcctacccgtacctactacgtacgacccgacgtacccgtgtaccgtacggttacgttaggtaaaacttttcgttttcgggtaactttaaggtttttaattttaacgttcgtacgtaacgtaacgtttagttaaacgttaacgttaaccgtcgggttacccggttgtaccgggttaccggttaccgggacggtaacgggtaaccgtagggtaaacggtaacgtaaccggtaaaacgtacggtttcggagtaccgttacgggaccctaaccgttaacggttcctttacgtcccgtttcgtacccg

SEQ ID NO: 185236 - DNA, 133 bp, Homo sapiens
  misc_feature: GYAE6OF01A9CZG.14.23.C01.1.454.CMB.1.raw
  modified_base (130)..(133): a, c, t, g, unknown or other
  misc_feature (130)..(133): n is a, c, g, or t
tcagcgtctagtaccacgaccggtgctcgatttagtacacgtgattagggattgggcacagcggccctgggctgcctggtcaaggactacttccgtactagacgctgagcgggctggcaaggcgcatagnnnn

SEQ ID NO: 185237 - DNA, 919 bp, Homo sapiens
  misc_feature: GYAE6OF01AU4UL.14.23.C01.1.454.CMB.1.raw
  modified_base (892)..(892): a, c, t, g, unknown or other
  misc_feature (892)..(892): n is a, c, g, or t
  modified_base (903)..(903): a, c, t, g, unknown or other
  misc_feature (903)..(903): n is a, c, g, or t
tcagcgtctagtaccacgaccggtgctcgatttagtacacgtgattagggattgggggaggaactgctcagttaggacccagacggaaccatggaacgccccagcgcagcttctcttcctcctgctactctggctcccagactaccactggagaaatagtgatgacgcagtcctccacgcccaccctgtcgttcgtcgttaccgtaccggaaagggggaaaacaccgccccctaccccgttccgttcccgtacggaccggaccggggaccctaacgggttccgaaggttaaggtttacggttaaacggaaaccgtacccgttaaaacgttttccggaccccgtttacggggaaacccaaggtaacccaaaccggtaaacccgtccgggaacccgtacgggcccctacccgaggtccccttaccgtactacgttaccgtagtcgggttaccaccgaaccgtccccgaaccgggaccgggtcccgtacggttccgggtacccgtaccccgaacggttacccggttagggttccgtaaggggtcggtaccgggttaggggttcggggtaccgacggggtaacgtaacggtttaccgttaccctaccgttaccctaccgaaccgtacgtaccgacggacccgtaccgtccgtacgtccggttaagttacgtaacggttaacgtttacgttttacggttaacttttaagtttttacgttacgttacggacgttagtacgttaaaacggtttaattaaccgtttaccgggtccgttaccggttccgggtacgggttacccgttaacgggaaccgtaaacgggggtaaccgtaacgggttaccgaaaacgttacggtaaaccggtacgttacgggtagtacccgtacgtacctaacgtnttacccggttntacccgttctaccccg

SEQ ID NO: 185238 - DNA, 648 bp, Homo sapiens
  misc_feature: GYAE6OF01DV93G.14.23.C01.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (440)..(440): a, c, t, g, unknown or other
  misc_feature (440)..(440): n is a, c, g, or t
tcagcgtctagtaccacgaccggtgctcgatttagtacacgtgattagggattgggggaggaactgctcagttaggacccagacggaaccatggaagccccagcgcagcttctcttcctcctgcctactctggctcccagataccactggagaaatagtgatgacgcagtctccagccaccctgtctgtgtctccaggggaanagccaccctntcctgcagggccagtcagagtgttagaagcaacgttagcctggtaccagtcagaacctggccaggctccaggctcctacattctagttcggtgcctacgtcccaccgagggccctacgttggtccgtaccccgagcccgtaagggtttaccaggttcggaccgtaggtcggggttaccgtaggggaactaaggtacggttacccacgttcctacacccagttaccgngacctacgtccttagactagttctgaacgttatttgcttaagttttattattgttacagtactaagtaactaagttaacgtcggtaccgttccggtaggtacccggttacgccggaagggacccgtaaagggtcgaaacttacgaaaccggttaactacgggtacggaccgtagaccctaccgtacttcgtactttccgtcttacccg

SEQ ID NO: 185239 - DNA, 677 bp, Homo sapiens
  misc_feature: GYAE6OF01BCPB6.14.23.C01.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (317)..(317): a, c, t, g, unknown or other
  misc_feature (317)..(317): n is a, c, g, or t
tcagcgtctagtaccacgaccggtgctcgatttagtacacgtgattagggattgggggaggaactgctcagttaggacccagacggaaccatggaacgccccagcgcagcttctcttcctcctgctactctggctccagataccagtggagaatagtgatgacgcagtctccagcccacctgtctgtgtctcgagggaancgccacctctcncgcgagggccagcagagtgtagacgcaacgttagccgtacggtaccacgcaacgtaaacctcggaccacggcctaccgaggcctcctcgacttcgtagtcggtcnctacctacccgaccggacggccacggttcggtccgtcccgacgtcgtacggttcgaggtcgcggtagggttcgggcggtaggacgtggtacgttcacctcgtacaaccgtacgtccgaacggtcgaccgtccgttgacgttacggtacgttaggttaagtttatttcggtaagtttttaacgttttattagttacgtacgtagttaactaagtttaactaacgttaccggttaccggtccgttacggtaccgggttaccggttaccggaaccggtaacggtaacggtacgggttacgaaaacgtacgaaacggtacgtggtacgacgtacaccgttacctagttcctcttcgtccgtacc

SEQ ID NO: 185240 - DNA, 671 bp, Homo sapiens
  misc_feature: GYAE6OF01EYD62.14.23.C01.1.454.CMB.1.raw
  modified_base (204)..(204): a, c, t, g, unknown or other
  misc_feature (204)..(204): n is a, c, g, or t
  modified_base (279)..(279): a, c, t, g, unknown or other
  misc_feature (279)..(279): n is a, c, g, or t
  modified_base (297)..(297): a, c, t, g, unknown or other
  misc_feature (297)..(297): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgtagaagcaacttgcctggtaccagcagaaacctggccaggtcncccaggccttcccatacntctagtcgtcgctactacccaccggaccggacctacgtcggttccgtacccgaccgaccggtacgtacgtacggtcggacgtacgggtcggtacggtacgggacgtaaggtacgttactacttccgtaccgaccgtactacgtacgacgacgtaccgtacgacgtacgtacgtacgtaagtttacgtttcgtacgttagtttactttacgtttacgtacgtacgtacgtaacgttaacgttaacgttacgtacgtaccgttaccggtacggttaccggttaccggtaccggtaaccggtaaccggtaacggtaacgtaacgtaacgtaacgtaacggtaggtacgtcgacgtacctactacttcgtcgtcgtac

SEQ ID NO: 185241 - DNA, 813 bp, Homo sapiens
  misc_feature: GYAE6OF01C0BIX.14.23.C01.1.454.CMB.1.raw
  modified_base (339)..(339): a, c, t, g, unknown or other
  misc_feature (339)..(339): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctccagactaccacgtggaagaaatagtgatgacgcagtctccagcccaccctgtctgtcgtactccgaaggggaaacacgcccacccgtctccgtgaccgagggccagtcgaagtgtgtaagactctaacttagcctaggacagccgaacgaaacctcggaccacggtcctacccgaggtccctacctctattctaagttgggtcnctaacctacccgaacccgaggggaccctaacggttcgggtcccgtacccgaaccgtccccgtaagggttccaacggtcggacggttaggggttcgggtacccggttagggaacttaacggaaccggtttcccacttcccttaaccaaccgtacgttacgaccgaccgtaacggtccccttacggaccgttaacggtacccgttaaaggttaacgtttaacggtttttacgtaccgtttaagttttttaacggttttactttacggtaacgttaagtaccgtttaaagtttaaacgtaaaccgtttaaacggttcccgggttaaccgttccgggtttacgggtaccggtttaccggacgggttaaaccgggtaaccggtaaacggtaccggtaaagtaaccgaaaaaggttccgtaggtcggtaccctagggacccttactacgttacgttaaccggttccctcgtttaaccccg

SEQ ID NO: 185242 - DNA, 769 bp, Homo sapiens
  misc_feature: GYAE6OF01DEMOP.14.23.C01.1.454.CMB.1.raw
  modified_base (158)..(158): a, c, t, g, unknown or other
  misc_feature (158)..(158): n is a, c, g, or t
  modified_base (165)..(165): a, c, t, g, unknown or other
  misc_feature (165)..(165): n is a, c, g, or t
  modified_base (223)..(223): a, c, t, g, unknown or other
  misc_feature (223)..(223): n is a, c, g, or t
  modified_base (503)..(503): a, c, t, g, unknown or other
  misc_feature (503)..(503): n is a, c, g, or t
  modified_base (562)..(562): a, c, t, g, unknown or other
  misc_feature (562)..(562): n is a, c, g, or t
tcagcgtctagtaccacgaccggtgctcgatttagtacacgtgattagggattgggggaggaactgctcagttaggacccagacggaaccatggaacgccccagcgcagctttctcttcctcctgctactcgtcggcctccagactaccacgtggaanaaatagngatcgaccgctagtccaccacgcccaccgtgtcgtgtcgttccacggaaggggaaacncgacccctacccgtctccgtgaccggacgggtacctagtacgaagtagttaggtaagacgaaccttaacgtacgaccgtacggtaacaacgacgtaaacgaaccgtcggaccgtacggtccctacccgtagtccctaccgtactacgttacgttaggtgtacgacctacgtaccccgaacggaccggtcctacggttcggtccacccgacgtaccggtaggttaccagggtcggtcgttaaggggttccgggtagtacgggtaacacggtttacttaccncgttaccgacctactaacgacgacgacgtacgcgtacgactagtacgtagtaacgtttntttacggatttattttagtacgttcgtacaacgtacgttaaagttaacgtaacgttacggtccgtaccgttacggtcggttaacccggttacggacggaaaccgggttaaaccggtaaggaaacgtaaccgtaaaccgtaaacggtagttcggtaacgtcgaaccgtaccttaactcgttaccgttacgttcccttaccggtacccg

SEQ ID NO: 185243 - DNA, 994 bp, Homo sapiens
  misc_feature: GYAE6OF01DE7P7.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctcctgctactctggcctcccagactaccactggaagaaatgtgatgacgcagtcctccagccaccctgtctgtgtctaccgaaggggaacacgcccacccgttctcctggccgacgggccagtcgaggtagttagttaagaagtcctaaagttcgccgttacggtaaccagaccaacgtaacccgtggacctaacggccctacccgacggtacccttccgtactacgttccgttaaggttcggtccgtaaccaccgttaccccgaccgggtaacgggtaccctaacggtttcccgggtaccgtacccccgtaaacggtcccggttagggtttaccgacggggttcggtaaccgggttaaggggtttccgggggtaccggtacggggtaaaccgtaacggtttacccgtttaacccggaaccgtttccccttaaacccgtaaacccgtaaacgttcccggaaaggtacccgtaaccggtccgtaacgtaccggtagttaacgtttaccggtaaagtttttacgttttacgggttaaccgttttaagttttttaagtttacgttttaccgggtaacgttaacggttaaccgtttaaaagtttaacggtttaaacccggtttaacccggtttccggggtttaaccccggtttacccggggtttaccgggtttaaacccgggtttaacccggggtaaacccggggtaaaccgggttaaaaaccgggttaacggggttaaaaccggtaaaaacgtttaaaccccggggaaaaacgtttaccgggttaaccgggttcggttaaacccgtttaccggaaacccttacccggttaacgtttaccccggtttttacgttaccccgttttccgtttaaacccccgg

SEQ ID NO: 185244 - DNA, 853 bp, Homo sapiens
  misc_feature: GYAE6OF01AKMLJ.14.23.C01.1.454.CMB.1.raw
  modified_base (207)..(207): a, c, t, g, unknown or other
  misc_feature (207)..(207): n is a, c, g, or t
  modified_base (238)..(238): a, c, t, g, unknown or other
  misc_feature (238)..(238): n is a, c, g, or t
  modified_base (326)..(326): a, c, t, g, unknown or other
  misc_feature (326)..(326): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagactaccactggagaaatagtgatgacgcagtctccagcccaccctgtctgtgtcctccgaaggggaancgcccaccctctcctgcgagggccagtcagngtgtagaagcaacgttgcctaggtaccagaccaaggtaaaccctgggaccacggcctacccgaggtcctcctcacttctagtcggtcnctactcccgaccgacgggaccctacggtcggtcctccccgaggtcccgttaggttccgtaggtcggacgtacggggttcggggtaccggttacgggggaacctaggggttacgtttacccgaaccttcccgtaaccgtaacccctagtaccggaacgaccgtaccggtcccgtacggaccgtaaccgggttacgttaacgggtaaacggttttcgtttttaacgggacctttttaaacggtttttaacgtttacgttttacggttaccgtaacggttaccgtttaagtttaaactttaaaccggttaacccggttccgggttaccccgtttaaccggggttaccgggttaacccggtttacccggggaaaccccggtaaaacggggttaaccccggtaaagggttaaaacccgggtaaaacttaacccgggtaaaaacggttacccgggttacggtaacgggacccttaccggacccgttaacccgttacgttacccggttaccgtttaacgttcccgttaaccccg

SEQ ID NO: 185245 - DNA, 935 bp, Homo sapiens
  misc_feature: GYAE6OF01DL58N.14.23.C01.1.454.CMB.1.raw
  modified_base (153)..(153): a, c, t, g, unknown or other
  misc_feature (153)..(153): n is a, c, g, or t
  modified_base (206)..(206): a, c, t, g, unknown or other
  misc_feature (206)..(206): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagactaccactggaanaaatagtgatgacgcagtcctcagccacctgtctgtgtctaccgaaggggaancgcccaccctctcctgcgacgggcagtcgagtagtagtagagacctaagtacgcctacggaaaccaacgtacgaaaccgtcgggaacctacggtacctcccgaggtccctacccgtactacttccgtaggtcggtccaccgtaccgtaccccgtaaccggaccgggtacccctaggttccgggtacctaccccgaacgggtcccgttaaacgggttccgtacggtacggtaccgttaggggttcgggtaacggtcgggtaactagttaaccggtctacccgtccttaaccgaccgttaacgtcgacggtacccgaaccggttccctagtaccgttagttaccggttaaaggttacgtttaacgtttttcggaaaccgtttttagtttttaacggtttacccgggtttacgtaaaccgttaacgggtttaaacgttaaacggttttaaaacgttttaacccgttaacccgggggtcccgttaacccccggtttacggggggtttaacccgggttaaccccggggtttaaccggggaaacccggttaacggggaaaacccggggtttaaaggttaaaaccgggtaaacccgttaaaacgggtaaacccggttccggggttaagggttacccgggtaaacccctacgggttaaccccgaaacgttttcccccgggttaaacttttccccgggttttaaacctacccggggtttaccccgtttaaaccccccg

SEQ ID NO: 185246 - DNA, 783 bp, Homo sapiens
  misc_feature: GYAE6OF01CEF8W.14.23.C01.1.454.CMB.1.raw
  modified_base (202)..(202): a, c, t, g, unknown or other
  misc_feature (202)..(202): n is a, c, g, or t
tcagcgtctagtaccacgaccggtgctcgatttagtacacgtgattagggattgggggaggaactgctcagttaggacccagacggaaccatggaagcccagcgcagcttctcttcctcctgctactctggctccagataccactggaagaaatagtgatgacgcagtctccagccacctgtctgtgtctcgaaggggaacncgcccacctctcctgacgacgggccaagtcgaagtagttagttaagaagtctaacgtttacgccttacgggaaccagacgaacgaaaccgtcggaccgaggtccctacccgaggtcccttcctactacttacgtacggtgggtactaccaccgtacccgaaccggtaccgggacctacggttcgggtcccgtacccgacggtaccgttaggttacgaacgggttcggacgtacgggttgggaccgtaggggaacctagggtacttacgtacctctaaccgacgtactcgacgacgtacgtccgtaggtactacggttacgtaaggttaacgtttcgtttaggtacttttaagttttagttacgtttacgtacgtaacggttacttaaacgttaaacgttaaccgtttaacgggcccggttaccggtttaccggggttggttaacccgggttaccgggaaacggtaaacgggtaaccggtaagggttaaaccggtaaacgtaaccggtaaaccggtaggttacggtacggttccgtaacgacccgttaacttacgttaccggtttcttccgtttactacccg

SEQ ID NO: 185247 - DNA, 583 bp, Homo sapiens
  misc_feature: GYAE6OF01C1JIM.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctcctgctactctggctcccagataccaccggagaaattgtgttgacacagtctccactcaccctgtctttgtctccgaaggggaaagagcccaccctctcctgcagggccagtcagagtgtacaacaccaacttagccttggttcagcagaagcctggccaggcctcccaggctcctcatgtatgatcgacactcccgaacgacggggcccacggcaactccccaagccaaggttcaggtcgcgagtcgggtctgggacagtaccttcaacctctcaaccatccagcacgacctagagtctagtaatagtttagacttagtttattactagtcagtcgaggcgggactacgttcggccgtcttcgtaccgtttcggggacgggggacgagggtcggtaagttacgaaacgaacgtggtggactcgacgacctactcgttcgtacttacacgttccgtcccgtacc

SEQ ID NO: 185248 - DNA, 690 bp, Homo sapiens
  misc_feature: GYAE6OF01C56NR.14.23.C01.1.454.CMB.1.raw
  modified_base (159)..(159): a, c, t, g, unknown or other
  misc_feature (159)..(159): n is a, c, g, or t
  modified_base (226)..(226): a, c, t, g, unknown or other
  misc_feature (226)..(226): n is a, c, g, or t
  modified_base (241)..(241): a, c, t, g, unknown or other
  misc_feature (241)..(241): n is a, c, g, or t
  modified_base (300)..(300): a, c, t, g, unknown or other
  misc_feature (300)..(300): n is a, c, g, or t
  modified_base (509)..(509): a, c, t, g, unknown or other
  misc_feature (509)..(509): n is a, c, g, or t
tcagcgtctagtaccacgaccggtgctcgatttagtacacgtgattagggattgggggaggaactgctcagttaggacccagacggaaccatggaagccccaagcgcagtcttctcttcctcctgcttactctggcctcccagacttaccacgtggaanaaattagtgatgacgcagtcctccacgccctaccttgtctgtacgtcgtaccggaaggggaactacncccctaccgtctccngcgaggccagtcgagtagtagtagacgtctaactcgccgttagacacgacaacgtaacncgacgacgctccgagtcctaccgatagtcgtaaggtcggataccactacggaccggacgggtactccggttggtccctaccgacgtccgtacggttcgaggtcggtacgtgggttcgggacgtcggacgttaacggtccttaccctaccgttcccgtaacgactaacgtaccgcgaaccgtcgccgtacgactagtcgtaataacgttnttacgtacgtttatttagtttactgttactacgtagtacttaacgtactacgttccggtacggtacggtacggttaccggtacggtaaccggtacggtaacggtaacggtttaacggaaacctaggaaacgtcggtaacgcggtacgacgtcgtaccgttcttagtccgtccttgtacccg

SEQ ID NO: 185249 - DNA, 735 bp, Homo sapiens
  misc_feature: GYAE6OF01CLKZ6.14.23.C01.1.454.CMB.1.raw
  modified_base (364)..(364): a, c, t, g, unknown or other
  misc_feature (364)..(364): n is a, c, g, or t
tcagcgtctagtaccacgaccggtgctcgatttagtacacgtgattagggattgggggaggaactgctcagttaggacccagacggaaccatggaacgccccagcgcagcttctcttcctctgctactctggcctcccagataccacgtggaagaaatggtgatgacgcagttcctccacgcccacctgtctgtgtcctaccggaggggaaccgcccaccctctccgtgcgacgggccaggtcaggtgttgtaagaacgtactaacgttacgccgttacgggtaacacgtaccgaaacggtaaacccggtcggacccgaccgggtccctacccgaggtccctaccgtacattcgtaggtcggtnacccgacctaccgaccggacggtacctcggttcggtcccgaccgagtccgttaggtaccgtggggaccggtcgtacggggttcggtacggtacggggaactacggtcgttacccgacctttccgaccctacgtcgtacgaccgaccgtcgacgtcggtaactggttaactaggtaatttcgttacgtctttaacggtttattaggtacgactaagtactagtaaacttcgtaacggtccgtaccggttaggacgggttacgtaccggtagaaaccgggtgtaacgggtaaacgtaactaaccggtaacgtgtcggttaacgccgtaaaccgtaccggtaaccttcgtagtttcccgtcgtacccttcccgg

SEQ ID NO: 185250 - DNA, 660 bp, Homo sapiens
  misc_feature: GYAE6OF01A78CN.14.23.C01.1.454.CMB.1.raw
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtcctccgaggggaaancgcccaccctctccnggcagggccagtcagtagtgttagaagctaacttacgcctggtaccaggacaagaaacccgtggaccaaggcctcccgaggcctcccgtctactctagtggtcgcactcccgaaccggtacggggccctaacgttcgggtccgtaccccgagtcccgtaggttcagggtcggacgtagggtcggggtcctggggaactaaggtacgttacacccgtcgtacgaacctgtcaagtccacgtaccgtgacctaagtctaggtaacttagttttaggctttagtttatacgtttgactagataattaagtaactacgtcggtccgttaccgggtaggttcccggttaacggacccggtaaaggggtaaccgaagggtaagaaacgttaccgaaaacgtcggtcggaggtcgtacgactacctagttctcgttcctcgtaccg

SEQ ID NO: 185251 - DNA, 943 bp, Homo sapiens
  misc_feature: GYAE6OF01EXJPB.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctcctgctactctggctaccagataccacgtggaagaatagtagatacgacgctagtcctccagccctaccgtgtctggtcgtactaccgggaaggggaactaccgacccctaccgttctaccgtgaccgtacgggcctagtacgaagttaaggtacgttaagacgtacctaacgttacggacccttacggtaccaaggaaccgaaacggaaacccgttacgggaccaaccgggtacctacccgggaggacccctttaccccggtactaacggtttacgtacggtacgggactacccgtaaccgtacccggaacccgggaccggtacccggacgttaccgggtccccggtacctaccgggtaaccgttaagggttacccgtaaggggtggtaaccggtcgggtttacgggtaaccggtacgggggtaacttaacgggttacctaaccggtttccaacccgtttccgaaaaccgttaaccgacggggtaacctaacccggtacggtacccgttaacgaccggttttaacggtaccggttaaacggttaaacgtttaggtttaaccgtttaggtttaatttttacggtacgttttacgtaacgtaccgttaagaaaccgtttaagtaaaccgtttacgtaccgggtaccggttaccgggttaccggttacgggtaacccgtaaaggggtaacccgtaaacgggtaacgggtaaacccggtaaagttaaacccggaaacccgttaaaggtacccgggttaaacgtacccggttaaggaacccgttaaccgtacgggtttaccttacggggtacctttaccggtaaaccc

SEQ ID NO: 185252 - DNA, 930 bp, Homo sapiens
  misc_feature: GYAE6OF01AV5JK.14.23.C01.1.454.CMB.1.raw
  modified_base (164)..(164): a, c, t, g, unknown or other
  misc_feature (164)..(164): n is a, c, g, or t
  modified_base (213)..(213): a, c, t, g, unknown or other
  misc_feature (213)..(213): n is a, c, g, or t
tcagcgtctagtaccacgaccggtgctcgatttagtacacgtgattagggattgggggaggaactgctcagttaggacccagacggaaccatggaagcccccagcgcagcttctcttccctcctgcctactctggcctcccagactaccactggagaaattagngatgacgcagtctccagccacctgtctgtcgtcctaccgaggggaaacncgcccaccctcgtacctgccgacggggcccaggtccaggtcgttaggttaagacgctaacctttacggccttacgggtaacccagaccgaaagaaacccgtcggggacccaacgggtccctacccgaacggggtccttacccgtccctaagttaccgttacggttcgggaccgtacccgtaacccgtacccggaaaccccggtacgggggtaccccctaacgggttaccgggtttacccggtaacccccctaacgggtccccggtttaaacgggtttccggtaacggggtccggggtaccctacggggggtttacggggccggttaacggggaacctaacgggttacgtttcccgaaacccttccgttaaaccgaccccgtaagtacccgacggtaccgtaccggtacccgtacggtccgttacggtacccgttcggttaaacgttacgtttacgtaacgtttacggtttttacgttaacgttttacgtacctacggtacgttaacgttaacgttaaaccgttaaccgttccggtaccggttaccggttaaccgggttaccgtaacccggggttaaccggaaaccgggttaacccggtaaagggttaccggaaaaaaccggttccggtaaaaccggttaacggttacgggtacggttaccggtaacggacccgtaaccgttacgttaccggtacgtttacccgttacgttaccccgg

SEQ ID NO: 185253 - DNA, 610 bp, Homo sapiens
  misc_feature: GYAE6OF01BD0FM.14.23.C01.1.454.CMB.1.raw
  modified_base (206)..(206): a, c, t, g, unknown or other
  misc_feature (206)..(206): n is a, c, g, or t
  modified_base (240)..(240): a, c, t, g, unknown or other
  misc_feature (240)..(240): n is a, c, g, or t
  modified_base (321)..(321): a, c, t, g, unknown or other
  misc_feature (321)..(321): n is a, c, g, or t
  modified_base (371)..(371): a, c, t, g, unknown or other
  misc_feature (371)..(371): n is a, c, g, or t
  modified_base (475)..(475): a, c, t, g, unknown or other
  misc_feature (475)..(475): n is a, c, g, or t
tcagcgtctagtaccacgaccggtgctcgatttagtacacgtgattagggatttgggggaggaactgctcagttaggacccagacggaaccatggaagccccagcgcagcttctcttcctcctgctactctggctcccagactaccactggagaaatagtgatgacgcagtctccacgccaccctgtcctgtgtctcgaggggaanacgccaccctctcctgccgaggggccagtcaggngtgttagaagctaacgtgcctaggtaccagacagaaccgtcggaccaggcctccgacggtcctacctcactctagtggtcncacgtaccaccgacgggcctacggtcgtccgtcccgacgccgtaggtacncggtcggactacgggtgggtccgtagggacctaggtacgttccactctactacctcacgtagcctacgcctagctagtctagattactttgacttagtttattntagtctagatagtaataagtacgtcggtccgtcgtcggtacgtaccggacgtacgggaactaaggttagaaaccgtacgtaaacggtctagggcgtcgtacgaccgtacctatacggtccttacgtcgttacccg

SEQ ID NO: 185254 - DNA, 849 bp, Homo sapiens
  misc_feature: GYAE6OF01EDLQZ.14.23.C01.1.454.CMB.1.raw
  modified_base (211)..(211): a, c, t, g, unknown or other
  misc_feature (211)..(211): n is a, c, g, or t
tcagcgtctagtaccacgaccggtgctcgatttagtacacgtgattagggattgggggaggaactgctcagttaggacccagacggaaccatggaagccccagcgcagcttctcttcctctgctactctggctcccagataccatggaagaaatgtgatgacgcagtctaccagtcccaccctgtcctgtcgtctaccggaaggggaaacncgcccaccctgtcctgacgacgggccagtcgagtagtagtaagactacaacttagcctagaaccagcaacgaaaccgtcggaccacggcctaccgaggccttaccgtacattccgtaagtcgggtataccactacccgaaccggtacgggtcctaacggttggtaccgtacccgaacggtcccgtaaagggttcaacgggtcggtaaccggtaggggttcgggggttaacgtcgggtaaaccgtagggttaaccttttacccgaaccctttaccgttaaaccgaacccgttaacgttacgaaacgtaccggtaacgtacccggttcgaaaccggtttacgtaccgttaaaggttaaacgtttacgttttttaccggaacgttttaacggttttaactttaaacggttacgtaacccgtaaggttaaccgtaaaggtttaaacttaaacgtaacccggtttaccgggtacccctttaaccgggttacggtttaaaccggtcgggaaaccccgggttaaagggaacccggtaaacgggtttaaagaaaacccggttaacgtaaaaccgtagggttacggtaggacgtacggtaaaccctacgttacgttacccttaacggttacctacggtttaaccccg

SEQ ID NO: 185255 - DNA, 952 bp, Homo sapiens
  misc_feature: GYAE6OF01B8IBB.14.23.C01.1.454.CMB.1.raw
tcagcgtctagtaccacgaccggtgctcgatttagtacacgtgattagggattgggggaggaactgctcagttaggacccagacggaaccatggaagcccagcgcagcttctcttcctcctgctactctggctcccagactaccacgtaggagaaatagtgatgacgcacgtctccacgcccaccctgtctgtgtcctaccggaaggggaaagacgccctaccctcctccgtcgcgtacgggcctagtcgaggtaggttacggttaaggaacgacgtaacgttacggccgttacgggtaaccacgaccgaaaccggtaaacccgtcggacccacggtccctacccggacggtcccttccgtactacgttctaggttcgggtacgcctaacccgttaccccgaaccgggtacccggggcctaaccgggttccgggttacccggtacccccgtaaccggtaccccggttagggttacccggtaagggttcggggtaacggtttacgggggttcggggtaccggggttaagggaccgtacggttaacgtcccgtaccctttaaccgtccctaaaccgtcgtaccggaacgtcccggtaacgcccgttaggtaccctaacggtttacggttaacggtttaaagttttccggttttagttaactttttaaaggtttttacgttaacgttttacgaacggttacgtttaaacgttaacgggtttaaattaacggtttaacccggtacccggtaaccccggggttttccgggttaaccggggtaacccgggttacccccggggtaaacgggtaaaaccggggtaaccggttaaaccggggttaaaaccggaacgtttaaaacccgggtaaacggttaacggtttccggggtaagtaaccccgccggttaaacccgtaccgttcgttaaccctttacgtttcccgttacccgtttacccc

SEQ ID NO: 185256 - DNA, 1064 bp, Homo sapiens
  misc_feature: GYAE6OF01ECSN1.14.23.C01.1.454.CMB.1.raw
  modified_base (226)..(226): a, c, t, g, unknown or other
  misc_feature (226)..(226): n is a, c, g, or t
tcagcgtctagtaccacgaccggtgctcgatttagtacacgtgattagggattgggggaggaactgctcagttaggacccagacggaaccatggaagccccagcgcagcttctcttcctcctgcttactcgtggctaccctagactaccacgtggaagtaataggtcgatgacgcagtcctccacgccctacccgttggtcctgtacgtccgtaccgaaggggaanacgcccaccttccgtcctaggccgacgggccagtaccgaggtagttacggttaagacgtactaacgttcgaccgttacggtaaccaaggtaccgaaacggtaaacccgtcgggaccaacgggtccctaacccggtacggtacccctccgttacgacgtttactacggttcgggtacgacctacctaacccggcgggtaccggacccgtacggttggtaccctaccccacgttaccggtaggttcgaagggttcggtacgtacggggtttcggggtaaccggtagggtaaaccctagggttaccgttaccgtaccttacccggtaaccttaaccgaccgttacggaacgtaccctaccgggtaccgttacgtaccggttaaccgtacggttaaacggttaaacggttttacgttttacggtaccttttttaaacggtttttaaagtttcccgtttacgggtaaccgttaaacggttaaccggtttaaaacgttttaaaaaacggttaacggttttaaaccccgggtaacccgggttttaacccccgggttaccgggggtttaaccgggggttttaaaccccgggttaaccccggggtaaaacccgggggttaaaaccggggttaaaaacccggggtaaaaacccgggggtttaaaccggaaaaaacccggggttttaaacccggttaaaaaaacccggggtttaacgggttaacccggggttaaacggggttacccccgttaaaccccggttaaaccccggggttaaaaccttttaaccccggtttaaccccggtttttacccgggttaaaccttttacccccggtttaaacccccggg

SEQ ID NO: 185257 - DNA, 773 bp, Homo sapiens
  misc_feature: GYAE6OF01D3ZNL.14.23.C01.1.454.CMB.1.raw
  modified_base (267)..(267): a, c, t, g, unknown or other
  misc_feature (267)..(267): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtctccagcccaccctgtctgtgtctccgaggggaaagcgcccaccctctcctgcgagggccagtcagagttgttagagctaacttcgccgtaggaccngacaacgaacccgtggccacggccctccgacggtcctccctctacttctagtcggtcgccactcccgaaccgacgggtcccacgttcgggtacctaccccgagtcccgtaaggttccagggtcggtaccgagggttcgggtccgaggggactaaggtcgttccaccgttcctaccgtaacccagtaccgaggccctacggcccttaggcccttaaggtacttaaggtaatttcggttttacgtaccgtttaaaggttttttcgttaagttttaccgtacgtaacggtacctttaaaggtttaactttaacgttaaacccggttcccgggtaccccgttttaccgggttaacgggtttacccgggttacccgggaacccgggtaaacggggtaaccggtaaaggttaaaccgggtaaaaccgtaaccggtaaacggttacgtttaggggtcccgacgttcggaacccttaacgtacttccggttaactttccccgtagttacccccg

SEQ ID NO: 185258 - DNA, 834 bp, Homo sapiens
  misc_feature: GYAE6OF01E24IM.14.23.C01.1.454.CMB.1.raw
  modified_base (208)..(208): a, c, t, g, unknown or other
  misc_feature (208)..(208): n is a, c, g, or t
tcagcgtctagtaccacgaccggtgctcgatttagtacacgtgattagggattgggggaggaacttggctcagttaggacccagacggaaccatggaagccccagcgcagcttctcttcctcctgctactctggctcccagataccactggagaaatagtgatgacgcagtctaccagcccaccctgtctgtgtctccgaggggaaancgccaccctctcctgccagggcccagtcagagttgttacgaagctaacttagcctggtaaccaacagaaacctggccacggcctcccgaggcctcctcgactctagtggtcgactacgtcccgaccgacgggccctaacgtcgggttccgtaccccgtaggacccgtagggttaccaggttcggaccgtagggtcgggtacgtacggggaactaggtacgtttaccgaccgttcctaccgaaccacgttacgacggtaccgtaacggccccgttaggaccgttacgttaacgttaacgggtaacgtttaagtttttcggaaccttttaagtttttaaacgtttagtttacggacgttaacggtacgttaacgttaaacttaaacggttacccggttacgggtaccccgtttaccggggttacgggttaaacccggtttacccggggaaccccgggtaaagggggttaaacccggtaacgggggttaacgggtaaaaaacccgttacccgggtaaaaacccggttacgggtttcggtaacgggggttaccctaccgggtaaacccgtaaccccttacgggttaccctttaccggtttacccttttacccgttccgtttaccccccgg

SEQ ID NO: 185259 - DNA, 807 bp, Homo sapiens
  misc_feature: GYAE6OF01AYD01.14.23.C01.1.454.CMB.1.raw
  modified_base (207)..(207): a, c, t, g, unknown or other
  misc_feature (207)..(207): n is a, c, g, or t
  modified_base (780)..(780): a, c, t, g, unknown or other
  misc_feature (780)..(780): n is a, c, g, or t
  modified_base (790)..(790): a, c, t, g, unknown or other
  misc_feature (790)..(790): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccacgccaccctgtctgtcgtctaccgaggggaaancgccgaccctctcctgacgacggcaggcagtagtgttaagaacgactaacgttacgccgtacggtaaccaaacgtaacggaaaccgttcggacccgtacgggttcccacccggtacggtcccttaccctagtacttacgttacggtacggttaccacctacccgtaaccccggaccggtaccgggtacccttacggttcgggttaccccgtacccggaacggtaccgtaagggtttcgaacggtcggtacggtaggggtcggtacggtacgggacgtaaacggttccgttaccgtacccttaccgaaccgttaacgacttaccgacgtaccgaccgtcccgtaggaccgttacggtaccgtaaagggttaaccgtttagtttaccggatttttaaacgtttacttttaccggacgttaccgtaggtaacgtttaagtttaaccttaaacgtaccggttccggttacccgtacggggttacggtaccgttaccgggaacggtaacgtaacggtaaagttaacgaaacgtacggtaacgggttcagggttcggtactaccgtaaccctaacgttntaccgtttancccgtgtacccgtcccg

SEQ ID NO: 185260 - DNA, 772 bp, Homo sapiens
  misc_feature: GYAE6OF01DHD23.14.23.C01.1.454.CMB.1.raw
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggcctcccagactaccacgtaggaagtaaataggtgatggacgcacgtcctaccacgcccaccctgtcctgtgtccgtaccggaaggggaaanccgccctacccgtctccgngacgacgggcctagtaccaggtagtgtaagaacgtctaacgttcgccgtaggaccagacgaacgaaccgtcggacgacggcctacccgaggtccctaccgtcgacttaccgtaggtcggtacgtacctaccgtcccgaaccgaacggaccccgtacggtcgggtacccacccgtacggacgtaccgggtttcgacggggtacgaccggttaggtacggggtaggtacgggaccgtaacggtacgtttacccaaaccgttcccgtaactaacccggtacgaccgaacggtccgtaccggtcctacggaccgttagtaccgtttaaggtaacggtttgttttacgtacgtttaagtttaccgttaagtttcgtaacgtacgtaagttaagttaacttaacgtacgtccggtaccgttacggtaccggtacgttaaccggacgggtaacgaacgggtaaggtacgtaaacgtaacggaaccgtagtacggtacggtacgtacgaccgtacgtctagttctccgtaagtccccg

SEQ ID NO: 185261 - DNA, 889 bp, Homo sapiens
  misc_feature: GYAE6OF01DZ5DK.14.23.C01.1.454.CMB.1.raw
  modified_base (158)..(158): a, c, t, g, unknown or other
  misc_feature (158)..(158): n is a, c, g, or t
  modified_base (232)..(232): a, c, t, g, unknown or other
  misc_feature (232)..(232): n is a, c, g, or t
tcagcgtctagtaccacgaccggtgctcgatttagtacacgtgattagggattgggggaggaactgctcagttaggacccagacggaaccatggaacgccccagcgcagtcttctcttcctcctgcctactctggcctccagactaccacgtaggaanaaatagtgagtagacgctagtcctccgacgtccctaccgtgttcgtgtcgttccgtaccggaagggggtaaacncgacccctacccttctacccgtgaccggtacgggccagttaccgaaggtagtttaggtaacgacgtacttaacgttacgccgtacgaaccacgtaacgaacgtaaccgtcggacccgacggtacctacccggaacgtcctaccgtaactacgttaccgttaggtacggacgtaccgtaccgtaccgtaacccgggacggtaccgtcgttacggggtacccctaccggactaccgggtcgtacgtacgggtggtaccgggttaggtcgggtacggtaggacgttaacggttcgttaccacgtcctaacctaccgtaagtaccgacgtaacccgtgtaccccgttagtaccggttaagttacgttaaggttaaacgttttacgttaacgttttacggttttaacggtttttaactttccggttaacgttaacgtaacgttaaaccgtttaacttaagttaaacccggttaccggttaccggttaaccggttccgggtttaacgggtaacccggttacggtaaaccggtaacgggtaaaccggttaaggtaaacccgtaaacggtaaacgttaacccggtaagggttaggtaccggttaaccggaccttaaacgttaccgttacgtttaccggtttaacttcccttaaccggttaccccg

SEQ ID NO: 185262 - DNA, 888 bp, Homo sapiens
  misc_feature: GYAE6OF01AJU3W.14.23.C01.1.454.CMB.1.raw
  modified_base (429)..(429): a, c, t, g, unknown or other
  misc_feature (429)..(429): n is a, c, g, or t
  modified_base (572)..(572): a, c, t, g, unknown or other
  misc_feature (572)..(572): n is a, c, g, or t
tcagcgtctagtaccacgaccggtgctcgatttagtacacgtgattagggattgggggaggaactgctcagttaggacccagacggaaccatggaagccccagcgcagcttcctcttccctcctgcctactctggcctcccagtactaccgtactaggaagtaaacgttgtagatcgaccgcctagtcctcccgacgccctacccttgtcttcgtacgtccgtccgaaaggggaactaccgtcccctaccttccgtaccgtcggacgacgggtacccagttccgaaggtacggttagtaaaggaacgccttaaaacggtttaccggcccgttaacggttaaccgacgaaccgaaggttaaacccgtcgaccggtaaccggcccttaaccggcggtacctccgttacctaattcccggttagttcggccncgtaaccctccggaaccggccggtaccacgtttcggaccgaaccccgtccgtaacgtcgtaaccgtggtcggaaccgtgggtttccgggacggttcccggaaaaggttcgtaccgtttaaccctcccgtaccggttaaacccnccgtaacgtttcgaacccgttcccggaacctttcccggtaacgttaccggtaaccgtttagttaacgtaacgttttaaggttctttaaccgggtttaacggtttttaatttacgtccgttttaacacgggttaacctttaagttaaccgtaacggtttacccgtccggtacgtttaccgggtacccggttaacgttaccggtaaccggtaaacggtccgggtaaagttaaaccggtaaccgtaaacgtaaacccgggtaattcgggtacgtaaccgttcacgttaacctattacccgtcggttatttcccgaaacg

SEQ ID NO: 185263 - DNA, 768 bp, Homo sapiens
  misc_feature: GYAE6OF01BMS23.14.23.C01.1.454.CMB.1.raw
  modified_base (205)..(205): a, c, t, g, unknown or other
  misc_feature (205)..(205): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctaccgaggggaaanacgcccaccctctcctggcgagggcccagtcaggtagttgttaagaacgctaactttcggcctaggtaccagacaacggtaaacccgtgggacccaggccctacccgaggtcccttccgtctacttacgtagtcggggtacacctactcccgaacgtacgggccctaggtcggtccgtcccagtccgtaggtcagggtcgcgagggtgggtcgtagggactagtacgttccgacctctaccgaacctagtaccaggtccacgtccgtacgcgttaacgttcgtaaggttaacgtttacgttttacggtacttttaagttttaagtttcggtttacggtactaagttaacgtaagttaaactttaaccgttaacggttccggtacccgtttaccggggtcgggttaacccgggttaccgggaaccggtaaaacggggtaccggtaaaggggttaaccggaaaacgttaacccggaaaacggttacggttacgggtcccgggtaaccttacggacccgttaaacccgttacgtttacccgttacgtttcccttacccgttacccg

SEQ ID NO: 185264 - DNA, 748 bp, Homo sapiens
  misc_feature: GYAE6OF01CV1AT.14.23.C01.1.454.CMB.1.raw
  modified_base (211)..(211): a, c, t, g, unknown or other
  misc_feature (211)..(211): n is a, c, g, or t
  modified_base (251)..(251): a, c, t, g, unknown or other
  misc_feature (251)..(251): n is a, c, g, or t
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
  modified_base (277)..(277): a, c, t, g, unknown or other
  misc_feature (277)..(277): n is a, c, g, or t
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (306)..(306): a, c, t, g, unknown or other
  misc_feature (306)..(306): n is a, c, g, or t
  modified_base (319)..(319): a, c, t, g, unknown or other
  misc_feature (319)..(319): n is a, c, g, or t
  modified_base (326)..(326): a, c, t, g, unknown or other
  misc_feature (326)..(326): n is a, c, g, or t
tcagcgtctagtaccacgaccggtgctcgatttagtacacgtgattagggattgggggaggaactgctcagttaggacccagacggaaccatgggagccccagcgcagcttctcttcctcctgctactctggcctcccagataccactggaagaaatagtgatgacgcagtctccagcccaccctgtctgtcgtctaccggaggggaaacncgccctaccctctccgtgcagggccagtcagtgtgtaganctaactgctagacngcagaaccngcngcnccgngctctnctctagtcgtnctacnccgacgcggtccngtggtcncccgaggtccgtaggtacaggtcggacgtagggttcggggtcgtacggggaactacggtacgttcccaccttaccgtaccaaaccgttacgtaccggtaacggacccgtaccgtacccgttcggtaacctacgggttacccgttaaagggttaaacgttttacgtttttaccggtaacgttttaaggttttttaacgttacgtttacggttaccgtaaacgttaacgttaaacgtttaacttaaacgttacccgggtttccggtaccccggttttacgggtacggggtttaaccccggttaccggggaacggttaaaaccggggtacccggttaaaaggggtaaccgtaaaaccgtaccggtaaaaccgtcgttagggtaccgcttaccggactaccgtattactcgttcctacgttacccg

SEQ ID NO: 185265 - DNA, 836 bp, Homo sapiens
  misc_feature: GYAE6OF01A27KM.14.23.C01.1.454.CMB.1.raw
  modified_base (171)..(171): a, c, t, g, unknown or other
  misc_feature (171)..(171): n is a, c, g, or t
  modified_base (204)..(204): a, c, t, g, unknown or other
  misc_feature (204)..(204): n is a, c, g, or t
  modified_base (264)..(264): a, c, t, g, unknown or other
  misc_feature (264)..(264): n is a, c, g, or t
tcagcgtctagtaccacgaccggtgctcgatttagtacacgtgattagggagttgggggaggaactgctcagttaggaccagacggaccatggaacgcccagcgcagtcttcgtcttcctcgtcgtactactcgtggcctacccagactaccgacgtggaagaaattggtnagtgacgtcacgtcctaccacgcctacccgttntcgtcgtcgtacctccggaagggaacgcgtacccacctcgtaccgtggacgtacgggacngtacgtagtaggttcggttaaggactaaccaacgttttaccgacgttacggactacgacgaaccggtaaccgtacggacccgtaaggtccctaccggtacggttcctaccgacgtacttacgttacgtcggttacctccgtaacctacccgacgggtaaccggtccgttaacggtcccggttaccgacccgtacggtaccgtacggttacgacgggtagaccggtcggtacgggttcgacgtcgtaacgtcggtacctacgtacgtaccgaacgtcggacgtacgtccggtaactcggtaactcggtacgttacgtaagttacgttattaaccgttacgtttaggtttactttaagttcgtacgttacgtaacttaacggtttaacgtaacggtttacgtaacccgggttccgtaccgggttacgttaccgggtaacccggtaccgggtaacggtaaccggtaacggtaaccggtaaaccgttaaaccggtaacgggtacccggttaacgtcgggtacgtacccgtccgtaaaccgttccgttaccgtttacgtaaccgttcgttaaccccg

SEQ ID NO: 185266 - DNA, 785 bp, Homo sapiens
  misc_feature: GYAE6OF01A2JF6.14.23.C01.1.454.CMB.1.raw
  modified_base (208)..(208): a, c, t, g, unknown or other
  misc_feature (208)..(208): n is a, c, g, or t
  modified_base (223)..(223): a, c, t, g, unknown or other
  misc_feature (223)..(223): n is a, c, g, or t
  modified_base (309)..(309): a, c, t, g, unknown or other
  misc_feature (309)..(309): n is a, c, g, or t
  modified_base (381)..(381): a, c, t, g, unknown or other
  misc_feature (381)..(381): n is a, c, g, or t
  modified_base (446)..(446): a, c, t, g, unknown or other
  misc_feature (446)..(446): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaattagtgaatgacgcagtctccagcccaccctgtctgtgtctccgaggggaaacncgcccaccctctccngcagggccagtcagacgtgttagaacgtcaacttcgcctggtaccagcgaacgaaaccgtggaccgaggcctccgacggactcctnacttcgtagtggtcgctacgtccgaccgtacgggaccctaccgtggtccgtaccccgagaccgtggttacgnggtcggcgtacgggtcggtcgtcggtacgacgtacgttcacctctaccgacctacgacacgtacncgtcctgacgtacgttacgtacgtaagtttacgtttacgacgtttaggtttttacttagtttcgtacgtaacggttactaaacgttaaacttaacgttaacggttcccgggttaacccgtttaccggggttaaaccggggttaccccgtttaaacccgggggtaacccggtaaacgggggttaaaccccgttaagggggttaaaacccgttaaaaccgtaaacccgggttaaaacggtaccccggttttaggggtacggttaacccgtaccggggttacccctaaacccggtttcgttaccccggtttattttaccccgtttaaacccggtttcccccg

SEQ ID NO: 185267 - DNA, 873 bp, Homo sapiens
  misc_feature: GYAE6OF01A0IHN.14.23.C01.1.454.CMB.1.raw
  modified_base (176)..(176): a, c, t, g, unknown or other
  misc_feature (176)..(176): n is a, c, g, or t
  modified_base (206)..(206): a, c, t, g, unknown or other
  misc_feature (206)..(206): n is a, c, g, or t
  modified_base (867)..(867): a, c, t, g, unknown or other
  misc_feature (867)..(867): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggcctcccagataccactggagaaatagtgatgacgcagtctccancccaccctgtctgtgtctccgaaggggaanacgcccaccctctccgtgcgaggccagtcagtaggttagtagaagtctaacgttcgccgttacggtaccacgtaccgaacggtaaacccgtgggacccgtaagggtccctaccccggaagggtcccttacccctaaggtacttaccttaaggttccgggtagaccctaaccgttacccccggacccggtacccggggtaccctacggttccgggttaccgtaaccccccgttggaccccgggtttaagggtttccgaacggttccgggggtacgttaaccggggttcgggggttacccggtagggggtaacccttaacgggtaacggttttaccccaagttacccgtaccgaacccgtttacgtacgaccgtacgtaccggtaccttagggacccgttaacggttaccggtaaagtttaacggtttacgttttaccgtaacggttttaaacggtttttaccggttagtttttacggtaaccggtaagttaacccggttaaagtttaacccgttaaacgtttaaccccggttccgggttacccgtttaccggggtaccggtttacccggttaacccgggaacggtaacgggtacgtaacggggtaaacgtaaccgtaacgaacgttacggtagtgtcactacgtctacgttgtctaccgttntaaccc

SEQ ID NO: 185268 - DNA, 704 bp, Homo sapiens
  misc_feature: GYAE6OF01DXBHX.14.23.C01.1.454.CMB.1.raw
  modified_base (347)..(347): a, c, t, g, unknown or other
  misc_feature (347)..(347): n is a, c, g, or t
  modified_base (491)..(491): a, c, t, g, unknown or other
  misc_feature (491)..(491): n is a, c, g, or t
  modified_base (510)..(510): a, c, t, g, unknown or other
  misc_feature (510)..(510): n is a, c, g, or t
tcagcgtctagtaccacgaccggtgctcgattttagtacacgtgattagggattggggggaggaactgctcagttaggacccagacggaaccatggaagccccagcgcagcttctcttcctcctgctactctggctcccagactaccactggaagaaatagtgatgacgcagtcctccacgcccaccctgtctgtcgtctaccggaaggggaaagcgcccctaccctctccgtgcgacggggccaggtcaagtagttaggttaagaactactaacttacggccgttacggtaccacgaccaacggaaacccgtgggacccacgggccctacccgacggtcccttccnccgtattcttaggtcggtacgacctaccgtaccccgaaccggacgggccctacggttcgggtaccctaccccgagacccggttaggttcgaggtcggcggtagggtcgggtcgtagggactaggtactccacgttccaccactntacgagtccgacgtccgtnaccgttaggtacttaggtaagtttctttacgtatttacgttttaattcgtacgtctagtacttaatacttaacgttacgccgttccggtaggttcggaccggttcgacggaacgggtacgtaagggtaacgtaaactacgaaacggttgtacgtcggacctccgactaccgttctacgtttctcttccgtaccg

SEQ ID NO: 185269 - DNA, 765 bp, Homo sapiens
  misc_feature: GYAE6OF01EDQLV.14.23.C01.1.454.CMB.1.raw
  modified_base (201)..(201): a, c, t, g, unknown or other
  misc_feature (201)..(201): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctccagataccactggagaaatagtgatgacgcagtctccagccacctgtctgtgtctccgaggggaancgccctacctctcctgcgacggccagtcagtagtgtagaacgctaacttcggccttggttacaggtacaaggtaacgtcctgggcccagggcctacccgacggtcccttaccgtactagttagtactgtacgtcgacctaccgtaccccgacggaccgggtcccaacccgggctaccgtaccccggagtcccgtagggttaccacggtcgggactacgggtcgggtacgtacggggaacctaggtaccttacctacggtaccctaccacgtactccgaacgtacctacggtaccttaaggtaccgtttacgtaacgggtaaagttcgtttttacggaaccgttttaagttttaccgtacgttcgtaccgtagggtaccgggtaacgggtcccgggacttaaccgggtttccgggacccgttacgttaccggggttacccgggttaccggggggaacccggggaacgtaaggggttacgggaaacgtttacccggaaacggttacggtcggtcgaaccgtcggtacccttacgacggttccccttaggttcccttgttacccccg

SEQ ID NO: 185270 - DNA, 883 bp, Homo sapiens
  misc_feature: GYAE6OF01A87PD.14.23.C01.1.454.CMB.1.raw
  modified_base (152)..(152): a, c, t, g, unknown or other
  misc_feature (152)..(152): n is a, c, g, or t
  modified_base (509)..(509): a, c, t, g, unknown or other
  misc_feature (509)..(509): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccacgtgganaaattaggtgatggacgcagttctaccacgccctaccctgtctcggtacgtcctaccgaagggggaaacacgaccccacccgttctcccgtaggccgtacggggacctaggtccaggtacgtttacggttaaggaactacctaacgttttaccggccgttacgggtaacccacggtacgtaaacggaaacccgttcgggaccgaacgggtcccctacccgagggttacccttacccgtactaacgttacctaaggttcgggttacgacgtaccttacccggaaccggacgggtaccccgtaacggggttccggtaccggtttaccccgaacggttacccgttacgggttttaaccgnggggttaccgggttaccggtaggggtttaccggggttacgggttaacggggaaccgtaaacggttttccggtttaacccttaccgggtacctttaacccgaccttaaccggttacgacggtaccgaccgtaccgttcgacgtaccgtgttaaggtaacgtttacgtttgtaacgttttagttttaacgtttgttacgtacgtacgttaacgtaagtttataaccgtaacgggttccgttaccgttcggtacgggttacgtaccggggtacgaaccgggtaccgtaaagggtaaaccgtaacgttaacggaaacgttcgtacgggtcgtacggtccgtaactaccgtacttacggttctaaccgttcgttacccg

SEQ ID NO: 185271 - DNA, 648 bp, Homo sapiens
  misc_feature: GYAE6OF01C1675.14.23.C01.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (316)..(316): a, c, t, g, unknown or other
  misc_feature (316)..(316): n is a, c, g, or t
  modified_base (335)..(335): a, c, t, g, unknown or other
  misc_feature (335)..(335): n is a, c, g, or t
  modified_base (465)..(465): a, c, t, g, unknown or other
  misc_feature (465)..(465): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaancgcccaccctctctgcagggccagtcagagtgtagaagcaacttagcctaggtaccagcaagaaccgtggccaggcctccaggctcctcatctagnggtnctactccaaccgngggccacgtggtcgtcccngcctaaggttcaggtcggcagggttcgggtctcggggaacaggtcgttacactcgtccaccgtatccagccgagcctgctagtctaggtaatagttttcacgttagtttttaattaagtttgtacgtagngtaaagttaattaaacttaacgtccgggtcccttaccgggttcgggtacgtttacgggacccgaaacgggtaaccggtaaggtaaacggggttaaacaacgtaaaaccggtaaacgtttaggtcccggtacgttcgggtaccctaactacccgttacgtttcggttacctttcgttaaccccg

SEQ ID NO: 185272 - DNA, 832 bp, Homo sapiens
  misc_feature: GYAE6OF01BVK4U.14.23.C01.1.454.CMB.1.raw
  modified_base (206)..(206): a, c, t, g, unknown or other
  misc_feature (206)..(206): n is a, c, g, or t
  modified_base (222)..(222): a, c, t, g, unknown or other
  misc_feature (222)..(222): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggcctcccagactaccactggagaaatagtgatgacgcagtctccagccaccctgtctgtgtctaccgaggggaancgcccaccctctccgngcgacggcctagtcagtgtgttaagacgtactaacgttagccgttaggaccagacgaacgaaaccgtcggacccgtacggccctacccgacggtccttaccctactcttacgtacgtgggtcgacctaccttaccccgaccggtacggtccctaacggttcgggtccgtaccccgacggtaccggttacggtaccgtaaggtcggcgtacgggttcggggttccgtagggtaacgtaacgttcggtttacctaccggttacctacctacgtaacttcgaccgttacgaccgtcccgtagtccttacgttcgttaaacgttaggtttaacttttccgggtattttaccgtttttaagttacgtttccgtaacttaacgggtactttaaacgttaaactttaaccgttaaccggttcccgggttacccggtttacgggtaccgggtttacgggtaccggggtaaccgtaaacgggggtaaccccggtaaaagggtttaccgggtaaaacgtaacccggtaaaaccggttcggttacgggttacgaccccgttacggtaaccccgttaacgttcccggttaccgtttaccgttcgtttaacccgttaccccgg

SEQ ID NO: 185273 - DNA, 871 bp, Homo sapiens
  misc_feature: GYAE6OF01C06UI.14.23.C01.1.454.CMB.1.raw
tcagcgtctagtaccacgaccggtgctcgatttagtacacgtgattagggattggggggaggaactgctcagttaggacccagacggaaccatggaagccccagcgcagtcttcctcttcctctgcttactctggacctcccaagactaccacgtaggaagtaaatagtgacgtacgacgactacgtcctaccacggtaccctaccgtgtacgttgtacggttccgtaccgggaagggggaaactacggcccccttacccctcttccccggagaccggaacggggtacctaacgtacgtaagggtaggtttaagtaacgggaacttaccgtaaacgtttaccggtaccgttaaccgggaacaaaccggtccgtaaaacggtaaaccccggtcgggaacccgtaacggccccgttaccgtaaccggtccccttacctacttaccgtacggttacggtccggtaacgtcccgtaaccttaccccgggaacccgggtcggtaccgtacggttcccggtcccgtacccgaggttaaccccggtagggttacctacgggtccggtaaacggggttcggggtcggtaaccgggtggtaaaacgtcccgtttaaggttacccaccgtttacacctaaacggtccgaacggtacgacgtaaccggtccgtacgtacggtaacttcgttaagttaagttcgttagttactttaaacgttttctagtccggtataccgtagtaacttaacgtacgtaacgtccgttacggtcgggtactacgggacggtaacgtaacgggtacaacgggtaactaagaaccgtaacggttctacggtcgaccgtcgttacttactacggttacacggttcctaacgtcccg

SEQ ID NO: 185274 - DNA, 834 bp, Homo sapiens
  misc_feature: GYAE6OF01BEGSU.14.23.C01.1.454.CMB.1.raw
tcagcgtctagtaccacgaccggtgctcgatttagtacacgtgattagggagttgggggaggaactgctcagttaggacccagacggaaccatggaagccccagcgcagccttctcttcctcctgcctactctggcctcccagactaccactggagaaatagtgatgacgcagtctccacgccctacctgtcctgtcgtcctaccgaggggaaagcgccctaccctctccgtgacgacgggccagtacagtagttacgttaaggaacgtctaacgttacgccgtacggtaccacgactaacggaaccgtcgggaccacggtcctacccgaggtcctcctacgactcgtaacgtcgggtcaccaccttacccgaccggtaccgggtaccctaacgtcgggtacccgtaccccgaggtacccggtacggttccgaacggtggtacgtggggtacgggttcggacggggaacgtacggttaccgttacctaaccgtccgtaccgaacctaacgtccgaacggtcccaccgtacccgttaggcccttaacggttaccgtaaaggtaacgttttaggtttccgtaagtttttaacgtttttagttaacgtttaccggtaacgtacggttaactaaaggtttaacttaaccgttaaccgggttccggttaaccggttaccgggtttacggggttaaccccgtaacgggacccggtaaaaccggggtacggttaaacggttaaccggtaaaccggtaaaccggtaaaccggttacgggtacgtacggtacccggtacaacccgtctttacggtaaccgtcttttacccgtcgttaccccgg

SEQ ID NO: 185275 - DNA, 794 bp, Homo sapiens
  misc_feature: GYAE6OF01EYJEZ.14.23.C01.1.454.CMB.1.raw
tcagcgtctagtaccacgaccggtgctcgatttagtacacgtgattagggatttgggggaggaactgctcagttaggacccagacggaaccatggaagccccagcgcagcttctcttcctcctgctactctggcctcccagactaccacgtggaagaaatagtgatgacgcagtcctccacgcccaccctgtctgtcgtctaccggaaggggaaacgacgaccccaccctctccgtgccgacgggccgagtcaggtaggtagttaagaacgtacctaacgttacgtccgtacggtaccacgaccgtaaacgaacccgtcggacccgacggtccctacccgacggtccctaccgtctacgttcgttagtcgggtacgtaccaccgtcccgaaccgggaccggtacccgtacggttacggttcccggtacccgaccgtccggtacggttaccgtagggtcggacgttgggtcgggtacggacgggactacggtacgtacctacgtcctaccgacactacgacgtccgaccgtcgtacgacgttactaggtacgttaaggtttattttaccggaccgttttaagttttaacgtacgtcgtaccggtacggtaccctaggtaacccgttaacccgtaccggtccccggttacctacggttacccgtacccgttaccgttacccgggttccgggttaaccgggggaccggttaaaccgggacggtaacgggtacgtaaaggaacccgtaaggaaacccgttggacggttccgaacgttacccgacctacgtcgttaccg

SEQ ID NO: 185276 - DNA, 766 bp, Homo sapiens
  misc_feature: GYAE6OF01C7LCV.14.23.C01.1.454.CMB.1.raw
  modified_base (221)..(221): a, c, t, g, unknown or other
  misc_feature (221)..(221): n is a, c, g, or t
  modified_base (423)..(423): a, c, t, g, unknown or other
  misc_feature (423)..(423): n is a, c, g, or t
  modified_base (746)..(746): a, c, t, g, unknown or other
  misc_feature (746)..(746): n is a, c, g, or t
  modified_base (751)..(751): a, c, t, g, unknown or other
  misc_feature (751)..(751): n is a, c, g, or t
  modified_base (762)..(762): a, c, t, g, unknown or other
  misc_feature (762)..(762): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctcggcctccagactaccacgtggaagaaatggtgatgacgcactccgtccacgccctacccttgtctgtacgtcctaaccgagggggaaacncgcccctaccctccgtccgtggccgacgggaccagtcgaaggtaggtagtaaggactactaacgttcgccgttacggaccagacgaacgtaaccgtcggccgaccggtccgtacccgcggtcccttctaactacggttaccttaaggttcggtacgaccttaaccgccccgaaacccggcgggtaaccccaacggggtttcncccgtcccgaacggtccggtaacggtttcggtaacggcggtaacggttaggggtacgggtcgttagggggaaccttaggtacccgtttacctaccttaccgtacctaaactttccgcggactaccggtaacctccgtacgttaccgtacggttaacctaaggtttaaccgtttagtttacgtttacgtttaaagtttttaggttacgtttcgttaacagtaccgttaataacgtttaataaccgtccggttacgtacggtacggtacgtacggacggtaacgaacggaagtacgtaacgaacgtaaacgtgtacggtgctacngtacngtctcgtactntacc

SEQ ID NO: 185277 - DNA, 724 bp, Homo sapiens
  misc_feature: GYAE6OF01DBS1O.14.23.C01.1.454.CMB.1.raw
  modified_base (702)..(702): a, c, t, g, unknown or other
  misc_feature (702)..(702): n is a, c, g, or t
  modified_base (710)..(710): a, c, t, g, unknown or other
  misc_feature (710)..(710): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctacctctggctcccagataccactggaagaaatagtgatgacgcagtctccagcccaccctgtctgtcgtctaccgaaggggaaacacgcccaccctctcctcgcacgggccagtacaggtacgttaggttagaagcgtaacgttacggccctaggtaaccaaaccgaagaacccgtcggacccgaacggccctcccgaaggcccttccctacctatccgtaagttggtacgcctactaccccgaccgaccgggacctacgtcggtcgtcccgacgtcccgtaggttcaggtcggtcgtacggtcgggggtacgtacgggacgtaggttaccgttccgtaccttccgtacccaaccgtccgttacgaaccgaccgtaaccgtcccgttgaccgttacggttacgttaagggttaacgtttagttttacggtacgtttaagttttaagtttcgtttacgtaccggtattaccgttaagtttaataacgttacgtcgttaccgtaccgttaggaccggtacgtacccggaaggtaccggaggtaacgtaaacacgtaacgtcgtggcgacgtgactactnttacgttntacctgtcctcccg

SEQ ID NO: 185278 - DNA, 731 bp, Homo sapiens
  misc_feature: GYAE6OF01AZ201.14.23.C01.1.454.CMB.1.raw
  modified_base (170)..(170): a, c, t, g, unknown or other
  misc_feature (170)..(170): n is a, c, g, or t
  modified_base (364)..(364): a, c, t, g, unknown or other
  misc_feature (364)..(364): n is a, c, g, or t
  modified_base (413)..(413): a, c, t, g, unknown or other
  misc_feature (413)..(413): n is a, c, g, or t
tcagcgtctagtaccacgaccggtgctcgatttagtacacgtgattagggattgggggaggaactgctcagttaggacccagacggaaccatggaagccccagcggcagcttcttcttccgtcctgctactctggcctcccagataccactggagaaatgtgatgaccgnagtctccagccaccctgtctgtagtcctcgaagggggaaacacgccaaccctgttcctagcacgggactagtcgaagtagttaggttaacgaagtcaacctttacgccgttacggtaaccaggaccaaacgaaacctaggacccacgggccctacccgacggtcctaccgttccaagttacgttactcgggtanacctaacctaccggaacccgtacgggacccctaaggtccgggtttaccncccccgaaggaccggttaaccgggtttacaacggttacgggaacctaggggttttccgggacggttacggggaacctaaaggggtcctttacaccgttacctacctaaccgacgactacgaccgtagcccttaggacttagcgtaaaggaacttaagtttgaccttagtttaattctttggtacaacgtactaagttaataaccttaacggcgtcccgtacggtggtacgacgggtacacggtaacgtagacggtaaacacgtaaaccgtagtacggtgtactccgacgtaaccacgttattccgttactccttaccg

SEQ ID NO: 185279 - DNA, 736 bp, Homo sapiens
  misc_feature: GYAE6OF01A3TNJ.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatgtgatgacgcagtctccagccacctgtctgtcgtctccgaggggaaancgcccaccctctcctggcagggccagtcagtagtgtagagactaacgttcgcctaggtaccagtaccaaggaaccgtcggaccacggcctacccgaggacccttccgtctatcgtagtcggtcactactcccgaccggacgggtcctacggttcggtaccgtaccccgacgtacccgtagggttccgaggttacggacgtacggggttcggggtaccgtagggggtaactacgggtacggtttccaaccttccgtaccaaccgtctaccggacgtaccacggtccgtacgtacgtacgtacgtaaggttaacgtttgtttacggtacttttaggttttacttacgtttggtactacggtaacgttaacgttaagttaaccgttacggttaccgggtaccgttcggggtaacgttacccgggttaccggaacggtaacgggaaccggtagggtaaccgtaaacgtacgtaaaccggtgtacggggtcacggtacgaccgtaccgtatttacccgtacttccgttaccgtacccg

SEQ ID NO: 185280 - DNA, 719 bp, Homo sapiens
  misc_feature: GYAE6OF01AXC5W.14.23.C01.1.454.CMB.1.raw
  modified_base (337)..(337): a, c, t, g, unknown or other
  misc_feature (337)..(337): n is a, c, g, or t
tcagcgtctagtaccacgaccggtgctcgatttagtacacgtgattagggattggggggaggaactgctcagttaggacccagacggaaccatggaagccccagcgcagcttctcttcctcctgctactctggctcccagataccactggagaaatagtgatgacgcagtctccagccacctgtctgtgtctaccggaaggggaacgcgcccaccctctccgtgcgacgggccagtcgagtagtagttaagacgctaacgttcggccttacggtaaccaggacaacggaaccgtcggaccacggtcctcccgagtcctcctactatctagtcggacncactcccgacgacggcctacgtcggtcacccgagccgtaaggtcgaggtcggacgtggtcggggtctagggacaggtacgttccactcctacacatcgactcgacgtcgtgactacggtactaaggttaagtttacttttaggaacgttttaacgttttaagtttacgtacgttacgaaccgttagttaaacgttaacttaaacggttaccgttccgggtacccgtttaccggggtaaggtttcccgggtaaccggtaaccgggaaacggggtaccgggtaaaggttaaaccggaaacttaaaccgggaacgttagggtcggttacggaccgtacgtacccgtaaccgtacgtttaccgtttagttacccgttcgtaccccg

SEQ ID NO: 185281 - DNA, 504 bp, Homo sapiens
  misc_feature: GYAE6OF02H2HHG.14.23.C01.1.454.CMB.1.raw
  modified_base (501)..(501): a, c, t, g, unknown or other
  misc_feature (501)..(501): n is a, c, g, or t
tcagcgtctagtaccacgaccggtgctcgatttagtacacgtgattagggattggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagtattttgctagtttattattgtcagcagtataataactggcctcgtggacgttcggccaagggaccaaggtggaaatcgaaacgaactgtggctgcaccatctgtctntac

SEQ ID NO: 185282 - DNA, 504 bp, Homo sapiens
  misc_feature: GYAE6OF02HWJCE.14.23.C01.1.454.CMB.1.raw
  modified_base (202)..(202): a, c, t, g, unknown or other
  misc_feature (202)..(202): n is a, c, g, or t
tcagcgtctagtaccacgaccggtgctcgatttagtacacgtgattagggattggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctggggacagagttcactctcaccatcagcagcctgcagtctgaagtattttgctagtttattattgtcagcagtataataactggcctcgtggacgttcggcaagggaccaaggtggaatacgaaacgaactgtgactgcaccatctgtcttcac

SEQ ID NO: 185283 - DNA, 522 bp, Homo sapiens
  misc_feature: GYAE6OF02GT4VQ.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtgcatcccaccgagggccacgtggtcgtcccagccaggttcagtggcaggtgggtctggggacaggagttcacttctcaccatcagcagcctgcagtctgaagtattttgctagtttattattgtcagtctagtataataactggtcctcgtggacgttcggaccaagggaccaagggtagaaatacgaaacgactaggtggactgacacatctgtctctacg

SEQ ID NO: 185284 - DNA, 533 bp, Homo sapiens
  misc_feature: GYAE6OF02IUD9V.14.23.C01.1.454.CMB.1.raw
  modified_base (203)..(203): a, c, t, g, unknown or other
  misc_feature (203)..(203): n is a, c, g, or t
  modified_base (529)..(529): a, c, t, g, unknown or other
  misc_feature (529)..(529): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtatccagccaccctgtctgtgtctccaggggaaanagccaccctctcctgcagggccagtcagagtgttagaagcaacttagcctggtaccagcagaacctggccaggctcccaggctcctcatctatggtgcatccaccagggccactggtcgtcccagccaggttcagtgcagtgggctgggacagagttcactctcaccatcagcagcctgcagtctgaagtattttgctagtttattattgtcagctagtataataactgccttcggtaggtaccgttcggaccgtaaagggaccgtaaggtacgaaagtacgaaacgtaacgtaggtcgtacgtagaccaccgtatcgtacgtctntacg

SEQ ID NO: 185285 - DNA, 496 bp, Homo sapiens
  misc_feature: GYAE6OF02GCVBJ.14.23.C01.1.454.CMB.1.raw
  modified_base (203)..(203): a, c, t, g, unknown or other
  misc_feature (203)..(203): n is a, c, g, or t
  modified_base (493)..(493): a, c, t, g, unknown or other
  misc_feature (493)..(493): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtgcatcccaccagggccactggtgtcccatccaggttcagtggcagtgggtctgggacagagttcactctcaccatcagcagcctgcagtctgaagtattttgctagtttattattgtcagcagtataatactgcctcgtgacgttcgacaaggaccaggtgaatcgaaacgactgtgctgacacatctgtctntac

SEQ ID NO: 185286 - DNA, 504 bp, Homo sapiens
  misc_feature: GYAE6OF02JERGE.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctggggacaggagttcactctcaccatcagcagcctgcagtctgaagtattttgctagtttattattgtcagcagtatataactgtcctcgtggacgttcggaccaagggaccaggtgaatcgaaacgtactgtggctgacacatctgtctctac

SEQ ID NO: 185287 - DNA, 494 bp, Homo sapiens
  misc_feature: GYAE6OF02FE0KM.14.23.C01.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtncatccaccagggccactggtgtcccagccaggttcagtggcagtgggtctgggacagagttcactctcaccatcagcagcctgcagtctgaagtattttgctagtttatattgtcagcagtataataactggcctcgtgtacgttcgcgaaggcaaggtgaatcgaaacgatgtgctgcacatctgtctctac

SEQ ID NO: 185288 - DNA, 538 bp, Homo sapiens
  misc_feature: GYAE6OF02G3SKL.14.23.C01.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctccaggctcctcatctatggtncatccaccgagggccacgtggtcgtcccagccaggttcaggtggcaggtgggtctgggacaggtagttcactctcaccatcagcagcctgcagtctagaagtatttgctagtttattattgtctagctagtataataacgtggtcctcgtaggtacgttcggaccgaagggaccgtaagggtacgaacgtacgaaacgacgttaggtaggtctagacctactatcgtcgttactctac

SEQ ID NO: 185289 - DNA, 513 bp, Homo sapiens
  misc_feature: GYAE6OF02GFCNB.14.23.C01.1.454.CMB.1.raw
  modified_base (203)..(203): a, c, t, g, unknown or other
  misc_feature (203)..(203): n is a, c, g, or t
  modified_base (509)..(509): a, c, t, g, unknown or other
  misc_feature (509)..(509): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtgcatccacagggccactggtgtcccagccaggttcagtggcagtggtctgggacagagttcactctcaccatcagcagcctgcagtctgaagtatttgctagtttattattgtcagtcagttaataataactggtacctcgtggtacgttcgaccgaacggacaaggtaggaatacgaaacgaactggtcgctagacaccatctgtctntacg

SEQ ID NO: 185290 - DNA, 519 bp, Homo sapiens
  misc_feature: GYAE6OF02IL9QA.14.23.C01.1.454.CMB.1.raw
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
  modified_base (355)..(355): a, c, t, g, unknown or other
  misc_feature (355)..(355): n is a, c, g, or t
  modified_base (376)..(376): a, c, t, g, unknown or other
  misc_feature (376)..(376): n is a, c, g, or t
  modified_base (435)..(435): a, c, t, g, unknown or other
  misc_feature (435)..(435): n is a, c, g, or t
  modified_base (441)..(441): a, c, t, g, unknown or other
  misc_feature (441)..(441): n is a, c, g, or t
  modified_base (499)..(499): a, c, t, g, unknown or other
  misc_feature (499)..(499): n is a, c, g, or t
tcagcgtctagtaccacgaccggtgctcgatttagtacacgtgattagggattgggggagggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggcaggctccaggcctcctcatctatggtncatcccaccagggccacgtggtcgtcccagccaggttccagtggcagtgggtcnggggacaggagttcaacttcncaaccatcagcagcctgcagtctagaagtcttttgctagtttattattgtcagcagtanaatacngctcgtgacgttcgtacaacggacaacggtagaagtaacgaactaactaggtagacgnacgaccatcgtgtctactac

SEQ ID NO: 185291 - DNA, 521 bp, Homo sapiens
  misc_feature: GYAE6OF02FWSDQ.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtgcatcccaccagggccactggtcgtcccagccaggttcagtggcagtgggtctggggacaggagttcactctcaccatcagcagcctgcagtctgaagtattttgctagtttattattgtcagctagtataataactggcctcgtgacgttcggaccgaagggaccaaggtaggaaatacgaaacgtaacgtggtaggctgaccacatctcgttcttctac

SEQ ID NO: 185292 - DNA, 576 bp, Homo sapiens
  misc_feature: GYAE6OF02G4GT8.14.23.C01.1.454.CMB.1.raw
  modified_base (205)..(205): a, c, t, g, unknown or other
  misc_feature (205)..(205): n is a, c, g, or t
  modified_base (306)..(306): a, c, t, g, unknown or other
  misc_feature (306)..(306): n is a, c, g, or t
  modified_base (422)..(422): a, c, t, g, unknown or other
  misc_feature (422)..(422): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanacgccaccctctcctgcagggccagtcagagtgttagaagcaacttagcctggtaccagcagaaacctggaccaggctcccaggcctcctcatctatggtncatcccaccgagggccacgtggtctccccagcccgtaggttcaggtcggctaggtcggggtctggggacaggtagttcacttctacaccatcagcacgcctgctagtctaggaatnttttgacttagtttattagttgtactagtctaagttaataacgtaacgttggaccttccggtaggtaccgttcggaccggtaaagggaccgtaagggtacggaaactacgaaacgtaacgtggtcggtactgacacagttcgtcgttcttgtac

SEQ ID NO: 185293 - DNA, 511 bp, Homo sapiens
  misc_feature: GYAE6OF02GXIK2.14.23.C01.1.454.CMB.1.raw
  modified_base (203)..(203): a, c, t, g, unknown or other
  misc_feature (203)..(203): n is a, c, g, or t
  modified_base (508)..(508): a, c, t, g, unknown or other
  misc_feature (508)..(508): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtgcatcccaccagggccactggtgtcccagccaggttcagtggcagtgggtctgggacagagttcactctcaccatcagcagcctgcagtctgaagtattttgctagtttattattgtcagcagtataataactgcctcgtggtacgttcggcgaacgggaccgaaggtagaatacgaaacgaacgtagtggctgcaccatctgtcttntac

SEQ ID NO: 185294 - DNA, 498 bp, Homo sapiens
  misc_feature: GYAE6OF02HM5E2.14.23.C01.1.454.CMB.1.raw
  modified_base (299)..(299): a, c, t, g, unknown or other
  misc_feature (299)..(299): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaacctggccaggctccaggctcctcatctatggtncatccaccgagggccactggtcgtcccagccaggttcagtgcagtgggctgggacagagttcactctcaccatcagcagcctgcagtctgaagtattttgactagtttatttattgtctagctagtataatactgcctcgtgtacgttcggcaaggacaggtagaatcgaaacgactggtagctgcacatctgtctctc

SEQ ID NO: 185295 - DNA, 507 bp, Homo sapiens
  misc_feature: GYAE6OF02IPJ8V.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtcgtcccagccaggttcagtggcagtgggtctgggacagagttcactctcaccatcagcagcctgcagtctgaagtattttgctagtttattattgtcagcagtataataactggcctcgtgacgttcggacaagggaccaaggtagaatacgaaacgaactggtgctgacactatctgttctctac

SEQ ID NO: 185296 - DNA, 514 bp, Homo sapiens
  misc_feature: GYAE6OF02I5ALT.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtgcatccaccagggccactggtcgtcccagccaggttcagtgcagtgggtctgggacagagttcactctcaccatcagcagcctgcagtctgaagtattttgctagtttattattgtacagtcagtataataactggcctcgtgacgttcggacctaagggaccgtaaggtacgaatacgaaacgaactagtgctgacacatctcgttcttctac

SEQ ID NO: 185297 - DNA, 677 bp, Homo sapiens
  misc_feature: GYAE6OF02J3Q7N.14.23.C01.1.454.CMB.1.raw
  modified_base (202)..(202): a, c, t, g, unknown or other
  misc_feature (202)..(202): n is a, c, g, or t
  modified_base (304)..(304): a, c, t, g, unknown or other
  misc_feature (304)..(304): n is a, c, g, or t
  modified_base (310)..(310): a, c, t, g, unknown or other
  misc_feature (310)..(310): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccacctgtctgtgtctccaggggaaancgccaccctctcctgcagggccagtcagagtgttagaacgcaacttgcctggtaccagcagaacctggccaggcctcccaggcctcctcattctatggtacnctaacncccgaaccgaggggccctacgttgggtaccgtaccccgaggtcccgtaagggtttccagggtcggcgtagggttcgggtctaggggactagggtactttccaaccgttctaccaccgtactccgaaggccacgtccgtacggctaacgttcgtaggtaagttacgttttcgactttaagttttatacgttcgtacgacgttactaaggtttaataacgtacgttcgggtacccttacgggttacgggttaccgttaccggaacgaaccgggtacgtaaaggttacgaaacgttcccggaaacgttccgtggttaacggccgttaggaccctaccgtacctttacgtaccggtttccttacggtaccc

SEQ ID NO: 185298 - DNA, 516 bp, Homo sapiens
  misc_feature: GYAE6OF02G6GK3.14.23.C01.1.454.CMB.1.raw
  modified_base (204)..(204): a, c, t, g, unknown or other
  misc_feature (204)..(204): n is a, c, g, or t
  modified_base (513)..(513): a, c, t, g, unknown or other
  misc_feature (513)..(513): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagaagcaacttagcctggtaccagcagaaacctggccaggctcccaggctcctcatctatggtgcatcccaccagggccactggtcgtcccagccaggttcagtggcagtgggtctgggacaggagttcactctcaccatcagcacgcctgcagtctgaagtattttgctagtttattattgtcagctagtataatactgtcctcgtggtacgttcggacgaaggacgaaggtagaacgtacgaaacgaactggtgcgtagcacgatctgtcttntac

SEQ ID NO: 185299 - DNA, 653 bp, Homo sapiens
  misc_feature: GYAE6OF02F51Z2.14.23.C01.1.454.CMB.1.raw
  modified_base (203)..(203): a, c, t, g, unknown or other
  misc_feature (203)..(203): n is a, c, g, or t
  modified_base (416)..(416): a, c, t, g, unknown or other
  misc_feature (416)..(416): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggaccagcaagaaacctggccaggctcccaggctcctcatctagtggtgcatcccacgagggccacgtggtctccccagcccaggttccaggtcggcaggtgggtctggggacaggtacgttcactctccaaccatcgagcacgcctgctagtctagtaagtnttttgacttagttttattagtttgtactagtactaagttaattaaacgttaacgttcgggtacccttccgggttacgggttaccggtttaccgggtaacccggtaaacggggtaaccgtaaaggggttacgggtaaaacgttaaccggtaaaaaccggtaaccgttacgggtacgggtaccgttacggacccgtaacccgttaacgttccgttacggtttacccgttaccgttaccg

SEQ ID NO: 185300 - DNA, 554 bp, Homo sapiens
  misc_feature: GYAE6OF02F8B9U.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtgcatccaccagggccactggtcgtcccagccaggttcagtggcaggtgggtctgggacaggagttcactctcaccatcagcagcctgcagtctagaagtatttgctagtttattattgtcagtctagtattaataactcggccttccggtggtaccgttcggaccgtaagggacctaagggtacggaaagtaccgaaaacggtaacgttaggtcggtacgtaggaccaccgtacgttctcgttacttactaccg

SEQ ID NO: 185301 - DNA, 523 bp, Homo sapiens
  misc_feature: GYAE6OF02HYMC1.14.23.C01.1.454.CMB.1.raw
  modified_base (502)..(502): a, c, t, g, unknown or other
  misc_feature (502)..(502): n is a, c, g, or t
  modified_base (520)..(520): a, c, t, g, unknown or other
  misc_feature (520)..(520): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggcccactggtcgtcccagccaggttcagtggcagtgggtctgggacagagttcactctcaccatcagcagcctgcagtctagaagtattttgactagtttaattattgtcagctagtataaataacgtggtcctccgtggaccgtttcgggaccaaagggaccaaggtaggaaatacgaaacgtaactgnggtctgcacatctgtctntac

SEQ ID NO: 185302 - DNA, 564 bp, Homo sapiens
  misc_feature: GYAE6OF02GH9PM.14.23.C01.1.454.CMB.1.raw
  modified_base (203)..(203): a, c, t, g, unknown or other
  misc_feature (203)..(203): n is a, c, g, or t
  modified_base (377)..(377): a, c, t, g, unknown or other
  misc_feature (377)..(377): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtgcatccaccagggccacgtggtctcccagccaggttcagtggcaggtgggtctgggacaggagttcactctcacctntcagcagcctgcagtctgaagtatttgctagtttattattgtcagtctagtattaataactcggtaccttcggtaggtacgttcggaccgtaaagggacccgtaagggtacgaaacgtacgaaaacggtaacgttaggtacggtacgtagacctaaccgtattccgttacggttccttccgtaaccg

SEQ ID NO: 185303 - DNA, 523 bp, Homo sapiens
  misc_feature: GYAE6OF02H3SIY.14.23.C01.1.454.CMB.1.raw
  modified_base (203)..(203): a, c, t, g, unknown or other
  misc_feature (203)..(203): n is a, c, g, or t
  modified_base (404)..(404): a, c, t, g, unknown or other
  misc_feature (404)..(404): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagcccaccctctcctgcagggccagtcagagtgttagaagcaacttagcctggtaccagcagaaacctggccaggctcccaggctcctcatctatggtgcatcccaccagggcccacgtggtctcccagccaggttcaggtggcaggtgggtctgggacaggagttcactctcaccatcagcagcctgcagtctagaagtnttttgcttagtttattattgtacagcagtaataataactgcctcggtggacgttcggaccgaagggaccaaggtacgaaatcgaaacgtactggtacgctgacacatcgtagtctctac

SEQ ID NO: 185304 - DNA, 577 bp, Homo sapiens
  misc_feature: GYAE6OF02HWQLG.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatcccaccagggccacgtggtcgtcccagcccaggttcagtggcaggtgggtctgggacagtagttcactctcaccatcagcagcctgcagtctagaagtattttgcttagtttatttattgtacagtctaagttaataaattaacgtcggtccttccggtgggtaccgtttcgggaccgtaaacggggtacctaagggtacggtaaataccgaaaacggtaaccgttaggtcggtacgtggaccaaccgtattccgttacgttccttcgtaacc

SEQ ID NO: 185305 - DNA, 525 bp, Homo sapiens
  misc_feature: GYAE6OF02FZ1HM.14.23.C01.1.454.CMB.1.raw
  modified_base (203)..(203): a, c, t, g, unknown or other
  misc_feature (203)..(203): n is a, c, g, or t
  modified_base (520)..(520): a, c, t, g, unknown or other
  misc_feature (520)..(520): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtgcactccaccagggccactggtcgtcccagccaggttcaggtggcaggtgggtctgggacaggtagttcactctcaccatcagcagcctgcagtctagaagttatttgctagtttattattgtcagctagtaataatacgtcgtcctcgtggtacgttcggaccgaaggaccgaaggtagaatacgaaacgactgtaggctacgcacctatctgttcctntaccg

SEQ ID NO: 185306 - DNA, 692 bp, Homo sapiens
  misc_feature: GYAE6OF02H007D.14.23.C01.1.454.CMB.1.raw
  modified_base (205)..(205): a, c, t, g, unknown or other
  misc_feature (205)..(205): n is a, c, g, or t
tcagcgtctagtaccacgaccggtgctcgatttagtacacgtgattagggattgggggagggaacgtgctcagttaggaccagacggaaccatggaagcccagcgcagcttctcttcctctgctactctggctcccagataccactggagaaatagtgatgacgcagtctccagccaccctgtctgtgtctaccgagggggaaangcccacctctcctgcagggccagtcagagtgtagaagcaacttagccttggtaccagaccaaggaaacctggaccaggcctcccaggcctcctcactctacgtggtcactactccaccgagggccacgttggtcgcccaggcctaggttcaggtcggcgtaggtgggggtctgggggaacacggagtttccaacttcgtccgaacctacgttcgacgacgtcgaccttcgcacgttcgtagtaaacgtctttttggaccttaagttttaacgtttattcgttacgaagtacgtaaagtttaataaaacttaccggttcggtacccgtttcggtaacgggttaccgttaccgggtacggaaacggggtaccgaaaggggttaccggtaaacgttaaccgaaacggttaaaccggttcgggtagggttaacccaccggtaccgttaacccggtaacgttttaccggtcgtttacccggtttactaaccg

SEQ ID NO: 185307 - DNA, 503 bp, Homo sapiens
  misc_feature: GYAE6OF02FSN3L.14.23.C01.1.454.CMB.1.raw
  modified_base (500)..(500): a, c, t, g, unknown or other
  misc_feature (500)..(500): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatcccaccagggccactggtgtcccagccaggttcagtggcagtgggtctggggacagagttcactctcaccatcagcagcctgcagtctgaagtattttgctagttttattattgtcagtcagtataatactggcctcgtggacgttcggcaagggaccaggtgaatcaaacgactgtagctgcacatcgtgtcttntac

SEQ ID NO: 185308 - DNA, 536 bp, Homo sapiens
  misc_feature: GYAE6OF02HWOYQ.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangcccacctctcctgcagggccagtcagagtgttagaagcaacttagcctggtaccagcagaaacctggccaggctccaggctcctcatctatggtgcatccaccgagggccacgtggtcgtcccagccaggttcaggtggcagtgggtctgggacagagttcactctcacatcagcagcctgcagtctgaagtattttgactagtttattattgtcagctagtataataacgtcgccgttcgtggtacgttcggaccgaagggaccgaagggtacgaaatacgaaacgtacgtggtacggtacgtgaccaccgtacttcgtacgttctatacg

SEQ ID NO: 185309 - DNA, 509 bp, Homo sapiens
  misc_feature: GYAE6OF02INYWD.14.23.C01.1.454.CMB.1.raw
  modified_base (203)..(203): a, c, t, g, unknown or other
  misc_feature (203)..(203): n is a, c, g, or t
  modified_base (420)..(420): a, c, t, g, unknown or other
  misc_feature (420)..(420): n is a, c, g, or t
  modified_base (506)..(506): a, c, t, g, unknown or other
  misc_feature (506)..(506): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagcccaccctctcctgcagggccagtcagagtgttagaagcaacttagcctggtaccagcagaaacctggccaggctccaggctcctcatctatggtgcatccaccagggccagtggtgtcccagccaggttcagtggcagtgggtctgggacagagttcactctcaccatcagcagcctgcagtctgaagtattttgctagtttattattgtcagnagtataataactgcctcgtgtacgttcggccgaagggaccaaggtagaatacgaaacgtaactgtacgctagcactatctcgtctntac

SEQ ID NO: 185310 - DNA, 638 bp, Homo sapiens
  misc_feature: GYAE6OF02GFVUX.14.23.C01.1.454.CMB.1.raw
  modified_base (204)..(204): a, c, t, g, unknown or other
  misc_feature (204)..(204): n is a, c, g, or t
  modified_base (307)..(307): a, c, t, g, unknown or other
  misc_feature (307)..(307): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagaagcaacttagcctggtaccagcaagaaacctggccaggctccccgaggcctcctcattctatggtncactccacgagggccacgtggtctcccagcctaggttcaggtcggctagggtcgggtcgtggggacaggtacgtttccaaccttcctaccaacctatcacgcacgcctgcagtctagaagtattttgacttaagtttattatttgtctagtactaagttaattaataacgttcggtacccttccggtacgggtaccgttccggaaccggtaaaggggaacccgtaagggttacggtaaacgttaaccggtaaaaccggtaacggttacggttacggtaccgttacggacccgtaacccgtagttccgttaccggttacctttccgtaaccg

SEQ ID NO: 185311 - DNA, 528 bp, Homo sapiens
  misc_feature: GYAE6OF02HF2JK.14.23.C01.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
tcagcgtctagtaccacgaccggtgctcgatttagtacacgtgattagggatttggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtncatcccaccagggccatggtctcccagccaggttcaggtgcagtgggctgggacaggagttcacttctcaccatcagcagcctgcagtctgaagtattttgctagtttattattgtacagtcagttaataataactcggccttcggtgtacgttcggacgaaggaccgaaggtagaatacgaaacggaactggtaggactagacaccgtattcgtagtccttctacg

SEQ ID NO: 185312 - DNA, 505 bp, Homo sapiens
  misc_feature: GYAE6OF02GI26C.14.23.C01.1.454.CMB.1.raw
  modified_base (322)..(322): a, c, t, g, unknown or other
  misc_feature (322)..(322): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtntcccagccaggttcaggtggcagtgggtctgggacagagttcactctcaccatcagcacgcctgcagtctgaagtattttgctagtttattattgtcagctagtataataactgtcctcgtgtacgttcggcgaagggacaggtgaagtacgaaacgactgtgcgtgcacatctgtcttctac

SEQ ID NO: 185313 - DNA, 519 bp, Homo sapiens
  misc_feature: GYAE6OF02FW7RH.14.23.C01.1.454.CMB.1.raw
  modified_base (203)..(203): a, c, t, g, unknown or other
  misc_feature (203)..(203): n is a, c, g, or t
  modified_base (515)..(515): a, c, t, g, unknown or other
  misc_feature (515)..(515): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagtattttgctagtttattattgtcagtcagtataataactgtcctccgtggtacgttcggaccgaagggaccgaaggtagaaacgtacgaaacgaactagtggactgacacatctcgtcttntacg

SEQ ID NO: 185314 - DNA, 547 bp, Homo sapiens
  misc_feature: GYAE6OF02G2BI9.14.23.C01.1.454.CMB.1.raw
  modified_base (203)..(203): a, c, t, g, unknown or other
  misc_feature (203)..(203): n is a, c, g, or t
  modified_base (393)..(393): a, c, t, g, unknown or other
  misc_feature (393)..(393): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtgcatccaccgagggccacgtggtcgtcccagcccaggttcaggtggcaggtgggtctgggacaggagttcactctcaccatcagcagcctgcngtctgagtatttgctagtttatatttgtcagtctagtaataattaactcggcctccggtggaccgttcggaccgtaagggaccaagggtaggaaactacgaaaccggtaactaggtaggccttaggacctaccgagttacctgtccttctaccg

SEQ ID NO: 185315 - DNA, 546 bp, Homo sapiens
  misc_feature: GYAE6OF02F9RPO.14.23.C01.1.454.CMB.1.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagaagcaacttagcctggtaccagcaagaacctggccaggctcccgaggcctcctcatctagtggtncatcccaccgagggccacgtggtcgtcccagccctaggttcaggtggcaggtgggtctggggacaggtagttcactctcacctatccgagcacgcctgcagtctagaagttatttgcttagtttattattgtactagctaagttaataataacgtcgtccttcggtggtacgttcggaccgaagggaccgaaggtagaactacgaaacgtagtggtacgctacgccacattctcgttctctac

SEQ ID NO: 185316 - DNA, 534 bp, Homo sapiens
  misc_feature: GYAE6OF02HI8V9.14.23.C01.1.454.CMB.1.raw
  modified_base (396)..(396): a, c, t, g, unknown or other
  misc_feature (396)..(396): n is a, c, g, or t
  modified_base (407)..(407): a, c, t, g, unknown or other
  misc_feature (407)..(407): n is a, c, g, or t
  modified_base (519)..(519): a, c, t, g, unknown or other
  misc_feature (519)..(519): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctccaggctcctcatctatggtgcatccaccgagggcccactggtcgtcccagccgaggttcaggtggcgaggtgggtctggggacaggtagttcactctcacccatcagcagcctgcngtctagaagtntttgctagtttattattgtcagtctaagttaataattaactggccttcggtggtacgttcggaccgaagggaccgaagggtaggaaataccgaaagactggtcgactgcacnttcgtcgtcttctac

SEQ ID NO: 185317 - DNA, 597 bp, Homo sapiens
  misc_feature: GYAE6OF02HQS99.14.23.C01.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
  modified_base (404)..(404): a, c, t, g, unknown or other
  misc_feature (404)..(404): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagaagcaacttagcctggtaccagcagaaacctggccaggcctcccaggctcctcatctatggtncatccaccagggccagtggtcgtcccagcctaggttcagtggcaggtgggtctgggacaggagttcactctccacctatcagcacgcctgcagtctagaagtntttgctagtttattattgtcagtctagttataaagttaacgtcggtacccttccggtaggtaccggtttccgggaccgaaacggggtacccgtaagggttacggtaaacgtaccgaaaacggtaaccgttaggtacggtaccgttacggacccgtaaccgtacgttccgtttacggttcctttacgtaacccg

SEQ ID NO: 185318 - DNA, 511 bp, Homo sapiens
  misc_feature: GYAE6OF02GQ90M.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctggggacagagttcactctcaccatcagcagcctgcagtctgaagtattttgctagtttattattgtcagcagtataataactgcctcgtggtacgttcggaccgaagggaccgaaggtgaatacgaaacgaactgtcggctgcaccatctcgtcttctac

SEQ ID NO: 185319 - DNA, 589 bp, Homo sapiens
  misc_feature: GYAE6OF02HTOFJ.14.23.C01.1.454.CMB.1.raw
  modified_base (204)..(204): a, c, t, g, unknown or other
  misc_feature (204)..(204): n is a, c, g, or t
  modified_base (292)..(292): a, c, t, g, unknown or other
  misc_feature (292)..(292): n is a, c, g, or t
  modified_base (411)..(411): a, c, t, g, unknown or other
  misc_feature (411)..(411): n is a, c, g, or t
tcagcgtctagtaccacgaccggtgctcgatttagtacacgtgattagggattgggggaggaactgctcagttaggacccagacggaaccatggaagccccagcgcagcttctcctcctcctgctactctggctcccagataccactggagaaatagtgatgacgcagtctccagccaccctgtctgtgtctccgaggggaaanagcccaccctctcctgcagggccagtcagagtgttagaagcaacttgcctggtaccagcagaaacctggccaggctcccaggctcctnatctatggtgcatccaccgagggccacgtggtcgtcccagcccaggttccaggtcggcaggtcgggtctggggacaggtagttcactctcaccatcagcacgcctgcagtctagaagtnttttgcttagtttattattgtcagtcagttataaactaacgtcggtacccttcggtacggtaccgtttccgggaccgtaaaggggaccgtaagggtacggtaaactaccgaaaacggtaacgttaggtacgggtactacggaccgtaccctagttccgtacggttaccttacgtaccg

SEQ ID NO: 185320 - DNA, 532 bp, Homo sapiens
  misc_feature: GYAE6OF02GA8A8.14.23.C01.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
  modified_base (404)..(404): a, c, t, g, unknown or other
  misc_feature (404)..(404): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagaagcaacttagcctggtaccagcagaacctggccaggctcccaggctcctcatctatggtncatcccaccgagggccacgtggtcgtcccagccaggttcaggtcggcaggtgggtctggggacaggtattcactctcacctatcagcagcctgcagtctgaagtntttgacttagtttattattgtctagtctagtaataatacgtcggccttcggtggtacgttcggacgaacgggacgtaaggtagaactacgtaaacgacgtgtcggactgacacctatctctcttctac

SEQ ID NO: 185321 - DNA, 582 bp, Homo sapiens
  misc_feature: GYAE6OF02HB969.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctccaggctcctcatctatggtgcatccaccagggccacgtggtcgtcccagccaggttcagtggcaggtgggtctgggacaggagttcactctcaccatcagcagcctgcagtctaggtaacgtattttgcttaagtttatttatttgtactagtactaagttaataaattaacgtcggtccttacggtacgggtacgttcgggaccgtaaacggggtaccgtaagggtacggtaaacgtaccgtaaaacggtaacgtaggtacggtaccgtagaccgacctagtcctaggttccttactaccg

SEQ ID NO: 185322 - DNA, 521 bp, Homo sapiens
  misc_feature: GYAE6OF02GXXV8.14.23.C01.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtncatccaccagggccacgtggtcgtcccatccaggttcagtggcagtgggtctgggacagagttcactctcaccatcagcagcctgcagtctagaagtatttgactagtttattattgtcagctagtataataactggcctcggtgtacgttcggaccgaagggaccgtaaggtagaactacgaaacgaactggtaggtctagacactatctgttctctac

SEQ ID NO: 185323 - DNA, 519 bp, Homo sapiens
  misc_feature: GYAE6OF02IZ4BV.14.23.C01.1.454.CMB.1.raw
  modified_base (515)..(515): a, c, t, g, unknown or other
  misc_feature (515)..(515): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggcccactggtcgtcccagccaggttcagtggcagtgggtctgggacaggagttcactctcaccatcagcagcctgcagtctgaagtattttgctagtttattattgtcagtcagtataataacgtgcctcgtggtacgttcggccaagggacgaaggtagaatacaaacgtaactggtacgcgtgacactactctagttcttntacc

SEQ ID NO: 185324 - DNA, 562 bp, Homo sapiens
  misc_feature: GYAE6OF02GY308.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctccaggctcctcatctatggtgcatccaccagggccactggtctcccagccaggttcagtggcagtggctgggacagagttcactctcaccatcagcacgctgcagtctagaagtattttgacttagtttaattagttgtacagtctaagttaattaaataacgttggtaccgttccggtaggtaccgtttcggaccgaaacgggtaaccgaagggtaggaaacgtaacgaaaccgtaacgtaggtacggtacgtacgacgacctagtactcgttacttctacg

SEQ ID NO: 185325 - DNA, 602 bp, Homo sapiens
  misc_feature: GYAE6OF02JC6LP.14.23.C01.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaacctggccaggctccaggctcctcatctatggtncatccacaggccatggtctcccagccaggttcagtcggctaggtgggtctgggacagtagttcacgtctcaccatcagcagcctgctagtctagtaagtattttgacttagttttacttagttgtactagtactagttaattaagttaacgtcggtacccttaccggttcgggtaaccggttccgggaacccgtaacggggtaacccgtaaaggggtacgtaaagtaccgtaaaacggtaacgttaggtacggtacctacggtacctaacccgtagttacccgtcgttaccctttactaaccg

SEQ ID NO: 185326 - DNA, 785 bp, Homo sapiens
  misc_feature: GYAE6OF02JS41L.14.23.C01.1.454.CMB.1.raw
  modified_base (200)..(200): a, c, t, g, unknown or other
  misc_feature (200)..(200): n is a, c, g, or t
  modified_base (370)..(370): a, c, t, g, unknown or other
  misc_feature (370)..(370): n is a, c, g, or t
tcagcgtctagtaccacgaccggtgctcgatttagtacacgtgattaggattggggagggaacgtgctcagttaggaccagacggaaccatggaagcccagcgcagcttctcttcctcctgctactctgctcccagataccactggagaaatagtgatgacgcagtctccagccaccctgtcctgtgtctccaggggaanacgccaccctctcctgcagggccagtcagagtagttagaagccaacttaggcctggtaccagtcaacgaaacctggccaaggcctcccaggcctacctcacgttcctagtgggactaccacgttcccaaccgtcgggggacccctacgttacggggttcgttaacccccnggtacccccgtagggtttaccaggtttccggccggtaacggttcgggggtctacgggggacaacggttcgggttttaccaccttttcgaccctaaccggtaatcccgtaagggaccacggttccccgtaggtaccccgaggtttcccgtaggtaaacgggttacgtttttacggaccgttaagtttttaagtttaccgtttacgggtacccttaaggaccgttaaggtttaacgttaaacttaaacgttccgggttacccgttaccggtttacgggttaacccgttacgggtacccgtaaacggggttaacttaccgggtaagggtaaaccttaccgggtaaaacgtaccggtttagtaccggggtactacggtccgaacccttaggttacccttcggttaccgttacttaccgg

SEQ ID NO: 185327 - DNA, 549 bp, Homo sapiens
  misc_feature: GYAE6OF02H347R.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagcccaccctctcctgcagggccagtcagagtgttagaagcaacttagcctggtaccagcagaaacctggccaggctcccaggctcctcatctatggtgcatcccaccagggccactggtcgtcccagccaggttcagtggcaggtgggtctggggacaggtagttcacgtctcaccatccagcacgcctgcagtctgaagtattttgactagttgttattactcgtacagcagttataggttagttcctaaccgtactacgttttggaccgtaggggaccgtacgggttggtagacgtaacaaacgtacgtgtacggctcggaccaccgtatcttcgttcttacc

SEQ ID NO: 185328 - DNA, 497 bp, Homo sapiens
  misc_feature: GYAE6OF02G44JY.14.23.C01.1.454.CMB.1.raw
  modified_base (203)..(203): a, c, t, g, unknown or other
  misc_feature (203)..(203): n is a, c, g, or t
  modified_base (344)..(344): a, c, t, g, unknown or other
  misc_feature (344)..(344): n is a, c, g, or t
  modified_base (389)..(389): a, c, t, g, unknown or other
  misc_feature (389)..(389): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtgcatccaccagggccactggtcgtcccagccaggttcagtggcngtaagggtctgggacagagttcactctcaccatcagcagcctgcngtctgaagtattttgctagtttattattgtcagtcagtataatactgctcgtgacgttcgcaaggacaggtgaatacgaacgtacgtgtgctgcacatctgtctctac

SEQ ID NO: 185329 - DNA, 521 bp, Homo sapiens
  misc_feature: GYAE6OF02GLM4B.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtgcatccaccagggccacgtggtcgtcccagccaggttcagtggcagtggtctgggacagagttcactctcaccatcagcagcctgcagtctgaagtattttgctagtttattattgtctagctagtataataacgtgccttcgtggtacgttcggaccgtaagggaccgtaaggtagaaactacgaaacgaactggtaggctgcacatcgtgttctctacg

SEQ ID NO: 185330 - DNA, 628 bp, Homo sapiens
  misc_feature: GYAE6OF02I33YH.14.23.C01.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtncactccaccagggccacgtggtcgtcccagccaggttcagtcggcagtcgggtctggggacaggacgttcactctcacctatcgagcacgcctgcagttctaggtaagttacgttttcgcttagttttactttagtttcgtctagtctaagttaacttaacttaacgttcgggtaccttccggttacgggttaccgttaccgggacccgtaaacggggtaccgtaacgggtacggtaaacgtaacggaaaccggttaaccggttaggttacgggtaccgttacgggacctaacccgtacgttacccgtcggttaccttacgtacccg

SEQ ID NO: 185331 - DNA, 518 bp, Homo sapiens
  misc_feature: GYAE6OF02FT5JR.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagagcaacttagcctggtaccagcagaaacctggccaggctcccaggctcctcatctatggtgcatccaccagggccactggtcgtcccagccaggttcagtggcagtgggtctgggacagagttcactctcaccatcagcagcctgcagtctagaagtattttgctagtttattattgtcagctagtataataacgtggccttcggtggtacgttcggaccgaagggaccaaggtgaaatacgaaacgaactaggtggctgcaccatcgtgttcttctac

SEQ ID NO: 185332 - DNA, 533 bp, Homo sapiens
  misc_feature: GYAE6OF02GVT2Q.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtatccaggggaaagagccaccctctcctgcagggccagtcagagtgttagaagcaacttagcctggtaccagcagaacctggccaggctcccaggctcctcatctatggtgcatccaccagggccactggtcgtcccagccaggttcagtggcagtgggtctgggacagagttcactctcaccatcagcagcctgcagtctgaagtattttgctagtttattattgtctagtctagttataataacgtggtcctccggtggtaccgtttcggaccgaagggaccgaagggtaggaaacgtacgaaacggtaacttggtggctgacaccgtatctgttcttctac

SEQ ID NO: 185333 - DNA, 578 bp, Homo sapiens
  misc_feature: GYAE6OF02HNYL8.14.23.C01.1.454.CMB.1.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (412)..(412): a, c, t, g, unknown or other
  misc_feature (412)..(412): n is a, c, g, or t
tcagcgtctagtaccacgaccggtgctcgatttagtacacgtgatttgggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctccnatctatggtgcatcccaccgagggccacgtggtcgtcccagccagggttcaggtggcaggtgggtctggggacaggagttcacttctcacctatccagcacgcctgctagtctagtaacgtnttttcgcttaagttttatttattcgttcagtactaagttaataatacgtcggtcccttacggtcggtaccgttccggacgaacgggacctaagggtacgaaactaccgtaaaacggtacgttggtacggccgtagacctaaccgtattcgtacgttcttactaccg

SEQ ID NO: 185334 - DNA, 687 bp, Homo sapiens
  misc_feature: GYAE6OF02H4B0M.14.23.C01.1.454.CMB.1.raw
  modified_base (207)..(207): a, c, t, g, unknown or other
  misc_feature (207)..(207): n is a, c, g, or t
  modified_base (307)..(307): a, c, t, g, unknown or other
  misc_feature (307)..(307): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtcctccagcccaccctgtctgtgtctccgaggggaaancgcccaccctctcctgcagggccagtcagagtgttagaagcaacttgcctggaccagcagaaacctggccaggcctcccgaggcctcctcatctattggngcactcccaccgagggcccacgttgggtcctaccccgaggcccgtaagggttcacgggttcggccgtagggttcggggtctggggaacaggtacgttcacgtcctaccaaccatcgaagtccaacggtccttaggacctaggttcgtaggtaaacgttcgttttcggactttaagttttactttagttcgtacctagtactaagttaacttaaacgttaccgtccgggtacccgttccgggttacgggttaccgttccgggaaccgaaacggggtacccgtaaagggtacggtaaaaccgtaccggaaaacggtaccgttggtaccggtactaccggtaccaacccgtagttacccgtttcggttacccttacgtacccg

SEQ ID NO: 185335 - DNA, 617 bp, Homo sapiens
  misc_feature: GYAE6OF02GY5TR.14.23.C01.1.454.CMB.1.raw
  modified_base (302)..(302): a, c, t, g, unknown or other
  misc_feature (302)..(302): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggcctcctcatctatggtncatcccgaccagggccacgtggtcgtcccatccgaggtttcagtcggcaggttgggtcgtggggacaggtagttcacttctacacccatccagcagccctgcagttctagaacgtattttgcttaggttttatttagtttgtactagtctaagttaataagttaaccgttcggtacccttcggttaggtaccggtttaccggaccgtaaacgggaccgtaaagggtacggtaaaacgttaccgaaaacggtaacgttcgggtacggaccgttacgaccgtaacgtacgttaccgttacgtttccttacgttaccg

SEQ ID NO: 185336 - DNA, 523 bp, Homo sapiens
  misc_feature: GYAE6OF02F4QJ8.14.23.C01.1.454.CMB.1.raw
  modified_base (203)..(203): a, c, t, g, unknown or other
  misc_feature (203)..(203): n is a, c, g, or t
  modified_base (403)..(403): a, c, t, g, unknown or other
  misc_feature (403)..(403): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtgcatccaccagggccacgtggtctcccagccaggttcaggtggcaggtgggtctggggacaggagttcactctccacctatcagcagcctgcagtctgaagtntttgacttagtttattattgtcagtctagttataatactggtcctcggtggtacgttcggacgaagggacgaaggtagaaactacgaaacgacgtggtcgctgacacatctcgtctctac

SEQ ID NO: 185337 - DNA, 510 bp, Homo sapiens
  misc_feature: GYAE6OF02GAWUJ.14.23.C01.1.454.CMB.1.raw
  modified_base (203)..(203): a, c, t, g, unknown or other
  misc_feature (203)..(203): n is a, c, g, or t
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaacctggccaggctccaggctcncatctatggtncatcccagacgggccaccggcatcccagccaggttcagtgcagcgggtctgggacagacttcactctcaccatcagcagcctagagtctgaagtatttgactagtttattactgtcagcaggcgggacagttggccgctcgtacgtttcgggcggggacagggtgagtacgaacgacgtggtgcgtgcacatcgtgtcttctactcctcccg

SEQ ID NO: 185338 - DNA, 602 bp, Homo sapiens
  misc_feature: GYAE6OF02IATKG.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctctccctcctgctactctggctcccagataccactggagaaatagtgatgacgcagtctccagccaccctgtctgtgtctccaggggaaagagcccaccctctcctgcagggccagtcagagtgttagaagctaacttagcctggtaccagcaagaaacctggccaggctcccaggcctcctcatctatggtcgcatcccacgacgggccacgtggtcgtcccagccaggttcaggtcggcaggttcgggtctaggggacaggagttccactctacacctatcagcagcctgcagtctgaagtattttgcttagtttatttattgtcagtcaagttattaaacttaacgtggtaccctcggttagggtacgtttccgggacctaaacgggaccgtaagggtagaaacgttacgaaaaccggtaacgttacgggtacgggaccttaggacctacccgtaagttacccgtttggtttaccctttgtaacccg

SEQ ID NO: 185339 - DNA, 531 bp, Homo sapiens
  misc_feature: GYAE6OF02GPUJL.14.23.C01.1.454.CMB.1.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (399)..(399): a, c, t, g, unknown or other
  misc_feature (399)..(399): n is a, c, g, or t
  modified_base (516)..(516): a, c, t, g, unknown or other
  misc_feature (516)..(516): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaacctggccaggctccaggctcctnatctatggtncatccaccagggccactggtcgtcccaggccaggttcagtggcagtgggtctgggacagagttcacttctcaccctatcagcagcctgcagtctgaagtnttttgctagtttatagttgtcagcagttactaataactcggccttccggtgtacgtttcggaccgtaagggaccaaggtaggaaactacgtaaaccgaatgtacggtctagacaccntactcgtacttctac

SEQ ID NO: 185340 - DNA, 577 bp, Homo sapiens
  misc_feature: GYAE6OF02JJM3C.14.23.C01.1.454.CMB.1.raw
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
  modified_base (445)..(445): a, c, t, g, unknown or other
  misc_feature (445)..(445): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccacgtggagaatagtgatgacgcagtctccagccacctgtctgtgtctaccgaggggaaanagccaccctctcctgcagggccagtcagagtgttagaagcaacttagcctggtaccagcaagaaacctggaccaggcctccaggctcctcatctatggtncactccaaccgagggccacgtggtcgtcccagcccgtaggttcaggtggccagggttgggtctaggggacaggtagttcactcgtacaccatcgagcagcctagcacgtctagaatagttttgacttagtttattatttgntagtcagttataagtactgtacctacggttcggtacttcggacgtaagggaccaagggtcggtaaactacgaaacggtacgttaggtacggtacgttaggacctaccgtaagttccgtacgttctactaacg

SEQ ID NO: 185341 - DNA, 547 bp, Homo sapiens
  misc_feature: GYAE6OF02I852W.14.23.C01.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggcctcccaggctcctcatctatggtncatccaccagggccactggtctcccagccaggttcagtggcagtgggtctgggacagtgttcactctcaccatcagcacgcctgcagtctagtaagtatttgcttagtttattattgtcagtctagtaataataacgtggtacctccggtggtaccgttcggccgaaagggacctaagggtagaaactaccgaaacggtacgtggtacggcgtagactaccgtagttcgtcgttaccttctaccg

SEQ ID NO: 185342 - DNA, 594 bp, Homo sapiens
  misc_feature: GYAE6OF02HG12S.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggatttggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctccaggcctcctcatctatggtgcatcccaccgagggcccactggtcgtcccagccaggttcaggtcggcaggtgggtctggggacaggagttcactctcacatcagcacgcctgcagtctagaagtatttgctagtttattagttcgtactagctagttaattaattaacgttcggtacccttaccggttaggtaccggtttcgggacccgtaaagggacccgaaagggttacgggaaacgttaccgaaaaccggtaacgttgggtacggtacgttagaccaacccgtagttaccgtggtttaccttactaaccg

SEQ ID NO: 185343 - DNA, 554 bp, Homo sapiens
  misc_feature: GYAE6OF02HDJIO.14.23.C01.1.454.CMB.1.raw
  modified_base (203)..(203): a, c, t, g, unknown or other
  misc_feature (203)..(203): n is a, c, g, or t
  modified_base (351)..(351): a, c, t, g, unknown or other
  misc_feature (351)..(351): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtgcatcccacgagggccaccggcactcccagccaggttcagtggcagcggtntgggacagacttcactctccacatcagcacgcctagagtctagaagtatttgctagtttattactgtcagcaggcgggctaagttcggccgtcgtcgtacgtttcggggccgggggacgtaagggtcggtacgttacgaaacggtaacgtcggtacggtcgtcggaccgaccgtagttccgtgttccttctacttccttcccg

SEQ ID NO: 185344 - DNA, 512 bp, Homo sapiens
  misc_feature: GYAE6OF02GFSGW.14.23.C01.1.454.CMB.1.raw
  modified_base (203)..(203): a, c, t, g, unknown or other
  misc_feature (203)..(203): n is a, c, g, or t
  modified_base (385)..(385): a, c, t, g, unknown or other
  misc_feature (385)..(385): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtgcatccaccagggccacgtggtcgtcccagccaggttcagtgcagtggtctgggacagagtcactctcaccatcagcagcctgcngtctgaagtactttgctagtttattattgtcagctagtataatactgctcgtgtacgttcgacgtaaggaccaaggtagaatacgaaacgtactaggtcgacgtgacaccgtatctgtcttactacg

SEQ ID NO: 185345 - DNA, 519 bp, Homo sapiens
  misc_feature: GYAE6OF02IGX31.14.23.C01.1.454.CMB.1.raw
  modified_base (204)..(204): a, c, t, g, unknown or other
  misc_feature (204)..(204): n is a, c, g, or t
  modified_base (298)..(298): a, c, t, g, unknown or other
  misc_feature (298)..(298): n is a, c, g, or t
  modified_base (362)..(362): a, c, t, g, unknown or other
  misc_feature (362)..(362): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccagggggaaangccaccctctcctgcagggccagtcagagtgttagaagcaaacttgcctggtaccagcagaaacctggccagctccaggctctcatctatggtncatccacaggccatggtctcccagccaggttcagtggcagtgggtctgggacagagttcactcncacatcagcagcctgcagtctagaagtattttgcttagttttattattgtacagctagtaataataactggccttcggtagacgttcggacaaggaccgaaggtaggaaactacgaaaacgtactggtagctagccaacgtatcgtattctactacg

SEQ ID NO: 185346 - DNA, 606 bp, Homo sapiens
  misc_feature: GYAE6OF02F7OYA.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaacctggccaggctcccaggctcctcatctatggtgcatccaccgagggccacgtggtctcccagcctaggttcaggtcggcaggtgggtctggggacaggtacgttcacgttctacaccatcgagcacgcctgcagtcagaagttattttgacttagttttattagttgtctagtactaagttaattaacgtacgtcggtacccgttcggtacgggtaccgttccggaccgaaacgggtacccgtaagggtacggtaaacgtaccggaaaaccggtacgttacggtacggtccgtacggacccgtaaccgtacgttccgttacgtttaccgttacctaccg

SEQ ID NO: 185347 - DNA, 539 bp, Homo sapiens
  misc_feature: GYAE6OF02IL7EU.14.23.C01.1.454.CMB.1.raw
  modified_base (203)..(203): a, c, t, g, unknown or other
  misc_feature (203)..(203): n is a, c, g, or t
  modified_base (362)..(362): a, c, t, g, unknown or other
  misc_feature (362)..(362): n is a, c, g, or t
  modified_base (399)..(399): a, c, t, g, unknown or other
  misc_feature (399)..(399): n is a, c, g, or t
  modified_base (522)..(522): a, c, t, g, unknown or other
  misc_feature (522)..(522): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtgcatcccaccagggccacgtggtgtcccagcccaggttcagtggcagtgggtctgggacagngttcactctcaccatcagcagcctgcagtctagagtnttttgctagtttattattgtcagtctagttataattaactggacccttccggttggtaccgttcggaccgaacgggtaccaacgggtaggaaactacgaaacgtacgtggtagcgtgacaccnttcctgttccttctacg

SEQ ID NO: 185348 - DNA, 585 bp, Homo sapiens
  misc_feature: GYAE6OF02JRS9A.14.23.C01.1.454.CMB.1.raw
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (318)..(318): a, c, t, g, unknown or other
  misc_feature (318)..(318): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccacctgtctgtgtctccaggggaaangccacctntcctgcagggccagtcagagtgttagaagcaacttagcctaggtaccaacagaaacctggccaggctccaggctcctnatctanggtgcatccacagggccactggtntcccagccaggttcagtggcaggtggtctgggacagacgttcaactctacgaccagtcagtcacgcctgcgacgtctagaagtacttttcgccttaagtttacttaagttgtcgaagtctagttattaattaacgtcggtccttccggttaggtaccggtttcggaccgtaaacgggaccgtaagggtacggaacgtacgtaaacggaaccgttaggtacgtacgtacgtacaccgattacgttacgtccgtttacacgtttacccg

SEQ ID NO: 185349 - DNA, 131 bp, Homo sapiens; identical to SEQ ID NO: 185024
  misc_feature: GYAE6OF02FMQIK.14.23.C01.1.454.CMB.1.raw
  modified_base (130)..(131): a, c, t, g, unknown or other
  misc_feature (130)..(131): n is a, c, g, or t

SEQ ID NO: 185350 - DNA, 692 bp, Homo sapiens
  misc_feature: GYAE6OF02HX9FO.14.23.C01.1.454.CMB.1.raw
  modified_base (206)..(206): a, c, t, g, unknown or other
  misc_feature (206)..(206): n is a, c, g, or t
tcagcgtctagtaccacgaccggtgctcgatttagtacacgtgattagggattggggggtagggaactgctcagttaggacccagacggaaccatggaagccccacgcgcagcttctcttcctcctgctactctggctcccagataccactggagaaatagtgatgacgcagtctccagccaccctgtctgtgtctccgagggaanagccaccctctcctgcaggccagtcagagtgttagaagcaacttagcctgaccagcagaaacctggccaggcctcccgaggcctccgtcactctagttcggtgctacgtccgaaccgacggggcccacgttgggtccgtccccaggtcccgaggtttcaacgggttggcgtaggtcgggtcgtgggactaggtacgttacaccgttactccgaacctcgtacgacgactaccggccgtacgtccgtaagttccgtaggtaagttacttttcggtacctttaaggttttacgttagtttacttacgtaacgtactaagtttaataacgttaacccgttcggtacccgttccgggttaggaccggtttaccgggaaccggtaacgggaccgtaagggtacgtaaacgtaccggtaaagtaaccggttggtaccggtaccgtcgtacccgaccggttacgttaccgttacttccgttacccgttacccg

SEQ ID NO: 185351 - DNA, 542 bp, Homo sapiens
  misc_feature: GYAE6OF02G5R64.14.23.C01.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (304)..(304): a, c, t, g, unknown or other
  misc_feature (304)..(304): n is a, c, g, or t
  modified_base (383)..(383): a, c, t, g, unknown or other
  misc_feature (383)..(383): n is a, c, g, or t
  modified_base (396)..(396): a, c, t, g, unknown or other
  misc_feature (396)..(396): n is a, c, g, or t
tcagcgtctagtaccacgaccggtgctcgatttagtacacgtgattagggattgggggagggaactgctcagttaggacccagacggaaccatggaagccccagcgccagcttctcttcctcctgctactctggctcccagataccactggagaaatagtgatgacgcagtctccagccaccctgtctgtgtctccaggggaaanagccaccctntcctgcagggccagtcagagtgttaagaagcaaacttagcctggtaccagcagaaacctggccaggctcccaggctctcatctatggtncatccacaggccatgtcgtccagccaggttcagtggcagtcgggtctgggacagagttcactctcaccatcagcagctncagtctagaagtnttttagcttagtttattattgtcagtacagttaataactaactgccttcggtgacgtttccgaaacgtaacgggacaacgggttagaaacgtaccgaaaacgaacgttagaggtcgtagaccgacgtattctacgttctactaccg

SEQ ID NO: 185352 - DNA, 569 bp, Homo sapiens
  misc_feature: GYAE6OF02GO3KK.14.23.C01.1.454.CMB.1.raw
  modified_base (301)..(301): a, c, t, g, unknown or other
  misc_feature (301)..(301): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtncactccaccagggcccactggtcgtcccagccaggttcagtcggcaggtgggtctggggacaggtagttccactctacacctatcagcagtccctgcagtctagaagttattttcgacttagtttattatttgtacagctaagtaattaataacgtggtacccttcggttcggtacgttccggacgaaacgggaccgtaagggtagaaacgtacgaaaacgtacgtaggtggtacctggacccactagttcctaggttcctactaccg

SEQ ID NO: 185353 - DNA, 578 bp, Homo sapiens
  misc_feature: GYAE6OF02GVKWS.14.23.C01.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
  modified_base (416)..(416): a, c, t, g, unknown or other
  misc_feature (416)..(416): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagagcaacttagcctggtaccagcagaaacctggccaggcctcccgaggctcctcatctatggtncatccaccgagggccacgtggtctcccagcctaggttcaggtcggactaggtcgggtctaggggacaggtacgttcactctaccactatcagcacgcctgctagtctagaagtntttgcttagtttatattgtcagctagttataacgtacgtcggtccttccggtggtaccgttcggaccgaaagggtcccgtaagggtacggaaactacgaaacggtaacgttcgggtacgtacgtcggacctaacctacgttcgtcggttaccttacgtaccg

SEQ ID NO: 185354 - DNA, 598 bp, Homo sapiens
  misc_feature: GYAE6OF02G8L2X.14.23.C01.1.454.CMB.1.raw
  modified_base (204)..(204): a, c, t, g, unknown or other
  misc_feature (204)..(204): n is a, c, g, or t
  modified_base (300)..(300): a, c, t, g, unknown or other
  misc_feature (300)..(300): n is a, c, g, or t
tcagcgtctagtaccacgaccggtgctcgatttagtacacgtgattagggatttggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagaagcaacttagcctggtaccagcagaacctggccaggctcccaggctcctcatctatggtncatccacgagggccactggtctcccagccaggttcaggtgcagtgggtctgggacagagttcactctcaccatcagcacgcctgctagtctgaatgttttcgacttagtttatttatttgtacgagtactaagttaactaaagttaacgttcggacccttccggtacgggttaccggtttccggaccgtaaacggggtacccgtaagggtacggtaaaacgttaccggaaaacggtaacgttaggtacggaccgtagtaccgaaccgtacgttccgttacggttcctttacctacccg

SEQ ID NO: 185355 - DNA, 593 bp, Homo sapiens
  misc_feature: GYAE6OF02FUBUL.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaacctggccaggctccagctctcatctatggtgcatccaccacgggccactcggtcgtccccagcctaggttccaggtggactaggttcgggtctagggggactaggtacgttcaaccttctcacctatcagccagccctagctagtctggtaatattttgactagttttactatttcgtcagtctaagttattaaataacgtcggtaccgttcggtggtaccgtttccggaccgtaaagggacctaagggttagaaacgttaccgaaaacggtaacgttcggtaaggtacgtaggaaccaccgttaattccgtcgttacttacgtacc

SEQ ID NO: 185356 - DNA, 539 bp, Homo sapiens
  misc_feature: GYAE6OF02I0UCQ.14.23.C01.1.454.CMB.1.raw
  modified_base (260)..(260): a, c, t, g, unknown or other
  misc_feature (260)..(260): n is a, c, g, or t
  modified_base (293)..(293): a, c, t, g, unknown or other
  misc_feature (293)..(293): n is a, c, g, or t
  modified_base (422)..(422): a, c, t, g, unknown or other
  misc_feature (422)..(422): n is a, c, g, or t
  modified_base (428)..(428): a, c, t, g, unknown or other
  misc_feature (428)..(428): n is a, c, g, or t
tcagcgtctagtaccacgaccggtgctcgatttagtacacgtgattagggattgggggaggaactgctcagttaggacccagacggaaccatggaagccccagcgcagcttctcttcctctgctactctggctcccagataccactggagaaatagtgatgacgcagtctccagccaccctgtctgtgtctccaggggaaagcgccaccctctcctgcgaggcccaggtccagagtgttagaagtcaaacttgacctggnaaccaagcagaaaacctggccaggctcccaggntcctcatctatggtgcagtccaccagggccactggtgtcccagccaggttcagtggcagtgggtctgggacagagttcgactctcaccatcagcagcctgcagtctgaagattttgcagtttatagttngtcagncagtagtaataactggtcctcggtggacgttcggtaccgtaacggacgtaacggtacggaaagtacgtaaacgtaacgtagtacggtacgtcgacgtaccgtacgtactcg

SEQ ID NO: 185357 - DNA, 652 bp, Homo sapiens
  misc_feature: GYAE6OF02JZNOR.14.23.C01.1.454.CMB.1.raw
  modified_base (206)..(206): a, c, t, g, unknown or other
  misc_feature (206)..(206): n is a, c, g, or t
  modified_base (263)..(263): a, c, t, g, unknown or other
  misc_feature (263)..(263): n is a, c, g, or t
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
  modified_base (317)..(317): a, c, t, g, unknown or other
  misc_feature (317)..(317): n is a, c, g, or t
tcagcgtctagtaccacgaccggtgctcgatttagtacacgtgattagggattgggggagggaactgctcagttaggacccagacggaaccatggaagccccagcgcagcttctcttcctcctgctactctggctcccagataccactggagaaatagtgatgacgcagtctccagcccaccctgtctgtagtctccaggggaaangcccaccctctcctgcagggcccagtcagagtgttagaagcaacttagcctggaccngcagaacctggccaggcctcccaggccttcctnatctanggtcacactcccacncgggccacttgggctcccagccctggttcaggtcggactagggtcgggtctggggacctaggtagttccacttccgtacgaccctagtacgaacggctacggtaccgttcgaccgtagtccgtagtaaacgttacggttttcgacgttaagttttaacgtttattcggtactaacgtcctaaaggtttataaacgtttaccgtcggttaaccccgtggttacggtaacggttcccggacgtaaacgggtacccgaaggttacggtaactaaccgtaaacggtacgttaggtacggtaccgcgtaacgtcccaagttccgacgtttactccgtacg

SEQ ID NO: 185358 - DNA, 554 bp, Homo sapiens
  misc_feature: GYAE6OF02FIWD1.14.23.C01.1.454.CMB.1.raw
  modified_base (204)..(204): a, c, t, g, unknown or other
  misc_feature (204)..(204): n is a, c, g, or t
  modified_base (306)..(306): a, c, t, g, unknown or other
  misc_feature (306)..(306): n is a, c, g, or t
tcagcgtctagtaccacgaccggtgctcgatttagtacacgtgattagggatttggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagagcaacttagcctggtaccagcagaaacctggccaggcctcccgaggcctccctcattctatggtncatcccaccagggccactggtcgtcccagcccaggttcaggtggctaggtcgggtcgtggggactaggacgttcacgttctacacctatcagcacgcctgctagtctagaagtagtttgcttagtttattattgtctagtctagtaataatacgtcgtcctcggtaggtacgttcggacgaacgggacaggtagaagtacgaaacgacgttagtaggactagacctacgtagttcgtcgttctctacg

SEQ ID NO: 185359 - DNA, 605 bp, Homo sapiens
  misc_feature: GYAE6OF02IKS98.14.23.C01.1.454.CMB.1.raw
  modified_base (204)..(204): a, c, t, g, unknown or other
  misc_feature (204)..(204): n is a, c, g, or t
  modified_base (396)..(396): a, c, t, g, unknown or other
  misc_feature (396)..(396): n is a, c, g, or t
tcagcgtctagtaccacgaccggtgctcgatttagtacacgtgattagggattggggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttgcctggtaccagcagaacctggccaggcctcccgaggcctcctcatctagtggtgcatcccacgacggccacgtggtctccccgagtccgaggttcagtggcaggtgggctgggactaggtactcactctacacatcagccagtccngcagtctagaagtacttttgactagtttatttacttgtacagctaagtaataaacttaacgtcgccttacggtcggtaccgttacggaccgtaaacgggtaccgtaagggtacggaaaacgtacgaaaaaccggttaaactcgggttaacggtacccgtaggtaccccgtaaccgtaacgttccgtttacggttccctttacgtaaccc

SEQ ID NO: 185360 - DNA, 528 bp, Homo sapiens
  misc_feature: GYAE6OF02GEGAG.14.23.C01.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
  modified_base (322)..(322): a, c, t, g, unknown or other
  misc_feature (322)..(322): n is a, c, g, or t
  modified_base (358)..(358): a, c, t, g, unknown or other
  misc_feature (358)..(358): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatctatggtncatccaccagggccactggtntcccagccaggttcagtgcagtgggtctgggacagngttcactctcaccatcagcacgcctgcagtctgaagtattttgctagtttattattgtcagctagtataatactcggcctcgtggtacgttcggaccgtaagggaccgaggtaggaaatacgaaacgtacgtaggtacgtcttacgactactactcgtacgttctactcc

SEQ ID NO: 185361 - DNA, 600 bp, Homo sapiens
  misc_feature: GYAE6OF02H4UW5.14.23.C01.1.454.CMB.1.raw
  modified_base (203)..(203): a, c, t, g, unknown or other
  misc_feature (203)..(203): n is a, c, g, or t
  modified_base (418)..(418): a, c, t, g, unknown or other
  misc_feature (418)..(418): n is a, c, g, or t
  modified_base (595)..(595): a, c, t, g, unknown or other
  misc_feature (595)..(595): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggcctcccgaggcctcctcatctagtggtgcactcccaccgagggcccacgtggtcgtcccagccaggttcaggtggctaggtgggtctggggacaggtacgttcactctacgaccatcagcacgcctgcagtctaggaattnttttgcttaagtttatttagttgtactagtctaagttaataaacttacgtacggtcccgttccggtgggttaaccgtttccggaaccggaaacgggtaaccgtaaagggttacgggaaaactaccgaaaacggtaacgttgggtacggcttacgacctaccgattccgtgttccttntaacc

SEQ ID NO: 185362 - DNA, 568 bp, Homo sapiens
  misc_feature: GYAE6OF02IDOJS.14.23.C01.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (259)..(259): a, c, t, g, unknown or other
  misc_feature (259)..(259): n is a, c, g, or t
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
  modified_base (407)..(407): a, c, t, g, unknown or other
  misc_feature (407)..(407): n is a, c, g, or t
  modified_base (433)..(433): a, c, t, g, unknown or other
  misc_feature (433)..(433): n is a, c, g, or t
  modified_base (545)..(545): a, c, t, g, unknown or other
  misc_feature (545)..(545): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtctccagccaccctgtctgtgtctccgaggggaaangccaccctntcctgcagggccagtcagagtgttagagcaacttagcctggtacngcagaacctggccagctccagctctnatcatggtnctatcccacgaggccacgtggtcgtcccagccctaggttccaggtcggctaggtcgggtctgggacagtacgttcactctccactagtcagcagcctgcagtcgtagaagttntttgacttagttttattatgtcagtnattaataagtactggtacccttcggtggtaccgttccggacgtaaacgggtaaccgtagggtacgtaaactccggaaaacggtacgttggtacggaccttagacctaaccgnttaccgttagttcccttataccg

SEQ ID NO: 185363 - DNA, 551 bp, Homo sapiens
  misc_feature: GYAE6OF02GGKFA.14.23.C01.1.454.CMB.1.raw
  modified_base (204)..(204): a, c, t, g, unknown or other
  misc_feature (204)..(204): n is a, c, g, or t
  modified_base (436)..(436): a, c, t, g, unknown or other
  misc_feature (436)..(436): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagaagcaacttagcctggtaccagcaagaaacctggccaggcctcccaggcctcctcatctagtggtgcactcccaccgacgggccacgtggtctcccagcccaggttcagtcggcaggtgggtctgggacagtcgttcacttctcaccatcagcagcctgctagtctagaattatttgactagttttatagttgctanctaagttaataatactcggtccttcggtggtaccgttcggaccgtaaagggaccaagggtagaaactaccgaaacgtacgtggtacgctaggccacgtatcgtgttcttacgtac

SEQ ID NO: 185364 - DNA, 556 bp, Homo sapiens
  misc_feature: GYAE6OF02H5AFG.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggctcctcatcatggtgcatcccacacgggcccagtggtcgtcccagcccaggttcagtggcaggtgggtctgggacagtagttccatctcaccatcagcagcctgcagtctagagtatttgacttagtttatttagttgtctaagtcaagttaattaaacttaacgtcggtccctaccggttggaccggtttcggacctaaacggggccaaaggttggaaactacggaaacgtactggtacgactgacctaccgattcgttcgtccttctcg

SEQ ID NO: 185365 - DNA, 620 bp, Homo sapiens
  misc_feature: GYAE6OF02JB0T0.14.23.C01.1.454.CMB.1.raw
  modified_base (443)..(443): a, c, t, g, unknown or other
  misc_feature (443)..(443): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtgttagaagcaacttagcctaggtaccaacacgaaacctggccaggcctccgaggcctcctcatctagtgggtcgcactcccaccgacgggcccacgtcgggtcgtccccagcccgtagggttccaggtcggacgtagggttcggggtctaggggaccaggtacgttcacttctcaacctatcagcacgtcctgcgagtctagaagttntttggacttagttttattattgtcaagtctagttaataagtacgtcggtcccttacggtagggttaccgttcggaccggaaacgggtaacctaagggtacgaattaccgaaacggtaacgtggtacggccgtaggaccctaacgtcttaccgttacggtaccttacgtacttccccg

SEQ ID NO: 185366 - DNA, 616 bp, Homo sapiens
  misc_feature: GYAE6OF02GBI8Z.14.23.C01.1.454.CMB.1.raw
  modified_base (204)..(204): a, c, t, g, unknown or other
  misc_feature (204)..(204): n is a, c, g, or t
  modified_base (299)..(299): a, c, t, g, unknown or other
  misc_feature (299)..(299): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgtagagcaacttgcctggtaccagcaagaacctggccaggctcccaggcctcctcatctatggtncactccaccgagggcccacgtggtctcccagcctaggttcaggtcggacagggttgggtcgtggggacaggtacgttcacttctacacctatcacgcacgtcctgctagtctagaagtattttgacttagttttattattgtacagtctaagttaattaattaacgtcggtacccgttccggtacgggtaccgtttccgggacccgtaaacggggaccgtaaaggggtacggtaaactaccggtaaaaccggtaacgttacgggtacggtaccgttaggacctaaccgtacttccgttcggttacccttactacccg

SEQ ID NO: 185367 - DNA, 542 bp, Homo sapiens
  misc_feature: GYAE6OF02GP36Z.14.23.C01.1.454.CMB.1.raw
  modified_base (204)..(204): a, c, t, g, unknown or other
  misc_feature (204)..(204): n is a, c, g, or t
  modified_base (428)..(428): a, c, t, g, unknown or other
  misc_feature (428)..(428): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagngccaccctctcctgcagggccagtcagagtgttagaagcaacttagcctggtaccagcagaaacctggccaggctcccaggctcctcatctatggtgcatcccaccgaggccacgtggtcgtcccagccgaggttcaggtggcaggtggggtctggggacaggtagttcactctcaccatcagcagcctgcagtctgaagtattttcgctagtttattattgtnagtcagttataataactcggtcctcgtaggtacgttcggaccgaacggacgaagggtagaactacgaaacgtaacgtggtacggactacgacacgtatacgtcgttctactacg

SEQ ID NO: 185368 - DNA, 715 bp, Homo sapiens
  misc_feature: GYAE6OF02ICIYT.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaancgccaccctctccctgacgacgggcctagtcaaggtagttgttaagaacgacctaaaccgttgcccgttaggaccagaccgtaaagaaaaccgtgggaccgaacggtcctaccccgaggtccctcctacaacttcctaagtcggtcacaactccccgaaccggaggccaccggttggtccgcccaagcccgtaagggttcctaaggccggacgtacgggttgggtccgtagggactaggtacgttcacgttcaccacctatcgagcacgtcctgaccgtagttcctaggaaacgtttgtttcggacttaaggttttaatttgttcgtacgaatctaaagttattaaacgttaacgtcgtcccgttacggtacggtaccggttccggaccgaaacggggaaccttaaaggggaacgtaaactaaccggtaaaaccgtacggttacggtaacggttccgaacggttacccaaccggtaaactttcccggttaacgttccgttttaaccgtcccg

SEQ ID NO: 185369 - DNA, 559 bp, Homo sapiens
  misc_feature: GYAE6OF02IWB8S.14.23.C01.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctcaggggaanagccaccctntcctgcagggccagtcagagtgttagaagcaacttagcctggtaccagcagaaacctggccaggctcccaggctcctcatctatggtgcatcccaccagggccactggtcgtcccagccaggttcaggtggcagtgggtctgggacagtagttcactctcaccatcagcacgcctgcagtctgaagtattttcgctagtttattattgtcagtctagtataagtaactcggtacctccgtagggtaccgtttccggaccgtaaacggggtaccaagggtacggaaactacgaaaacggtaaccgtaggtacggtacgtcggtacaccgtagtacgtgtaccttatacc

SEQ ID NO: 185370 - DNA, 635 bp, Homo sapiens
  misc_feature: GYAE6OF02JG140.14.23.C01.1.454.CMB.1.raw
  modified_base (301)..(301): a, c, t, g, unknown or other
  misc_feature (301)..(301): n is a, c, g, or t
  modified_base (386)..(386): a, c, t, g, unknown or other
  misc_feature (386)..(386): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtncactcccacacggggcccaccggcactccccagccaggttccaggtggcaggtcgggtctggggacaggacttcactctccaccntcagcacgaccctagacgtctagaagtatttgactagttttattacgttgtactagctaggcggggtactaaggttcggacccgtcgttaccgtaccggttttccgggggacccggggggtaaccgtaaacgggggttcgggtaacggtttaccgaaaccgggtaacgttgggtacggtaccggttacggacccgtaaccgtacgttcgttacggtttccgtttaccgtaccttcccggttacccccgg

SEQ ID NO: 185371 - DNA, 604 bp, Homo sapiens
  misc_feature: GYAE6OF02JYHEO.14.23.C01.1.454.CMB.1.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagagcaacttagcctggtaccagcaagaacctggccaggctccaggctcctnatctatggtncatcccacgagggccactggtctcccagcctaggttcaggtcgacgtaggtcgggtactaggggactaggtacgttcaacgttctaccgacctagttccagaccacgtcccgtagaccgtacgtctagaacgttattttcgacttagtttattattgtacagtctaagttaataacgttaactggtccgttacggtacgggtaccgttcggacccgaacgggtaccgtaagggtacgtaacgtaacgaaacggtaactcgggtacgtacgttagaccgtaccgacttaccgtcgttactctaccg

SEQ ID NO: 185372 - DNA, 652 bp, Homo sapiens
  misc_feature: GYAE6OF02HD4WG.14.23.C01.1.454.CMB.1.raw
  modified_base (203)..(203): a, c, t, g, unknown or other
  misc_feature (203)..(203): n is a, c, g, or t
  modified_base (306)..(306): a, c, t, g, unknown or other
  misc_feature (306)..(306): n is a, c, g, or t
  modified_base (425)..(425): a, c, t, g, unknown or other
  misc_feature (425)..(425): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagcccaccctctcctgcagggccagtcagagtgttagaagcaacttagcctggtaccagcaagaaacctggaccaggctcccaggcctcctcatctagtggtncatccacgacgggccacgtggtcgtcccatcccgaggttcaggtcggactaggttcgggtctaggggacaggtacgtttcacgtctacaccatcagcacgtcctgcagtctagaagttntttgacttagttttattagttgtctaagtctaagttaacttaaacgtaaccgttcgggtacccgttaccgggttacgggtaccggtttaccgggaacccgtaaacgggggtaacccgtaaaggggttacggtaaaacttaacccggaaaacggtaaccggttagggtacggtaccgttacggaccctaccggtaagtttccgttacggtttaccttacgttaacccg

SEQ ID NO: 185373 - DNA, 581 bp, Homo sapiens
  misc_feature: GYAE6OF02IPNYW.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctcctactactctggctcccagataccactggagaaatagtgatgacgcagtctccagccaccctgtctgtgtctccaggggaaagagccaccctctcctgcagggccagtcagagtgttagaagcaacttagcctggtttcagcagaagcctggccaggctcccaggctcctcatgtatgatgcatcccagacgggccaccggcatcccagccaggttcagtggcagcgggtctgggacagacttcactcgcaccatccagcaagccgtagacgtctagaagtattttgacttagtttattactgtcagtcaggcgggctaagttcggcccgtcttaccgtacgttttccggggaccgggggtaaccgtaaggggttacgggacggttaccgaaacggtaaccgttacggtacgggtctacggtaccgaccgtacttccgtagttcctttactacgttccccg

SEQ ID NO: 185374 - DNA, 587 bp, Homo sapiens
  misc_feature: GYAE6OF02I7T7W.14.23.C01.1.454.CMB.1.raw
  modified_base (203)..(203): a, c, t, g, unknown or other
  misc_feature (203)..(203): n is a, c, g, or t
  modified_base (393)..(393): a, c, t, g, unknown or other
  misc_feature (393)..(393): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
  modified_base (433)..(433): a, c, t, g, unknown or other
  misc_feature (433)..(433): n is a, c, g, or t
  modified_base (555)..(555): a, c, t, g, unknown or other
  misc_feature (555)..(555): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagcccaccctctcctgcagggccagtcagagtgttagagcaacttgcctggtaccagcagaacctggccaggcctcccaggctcctcattctatggtcgcactccacgagggcccagtcggtcgtccccagcccgtaggttcaggtcggcgtaggtgggtctaggggacagtacgttcacttctccactntcngtcgancctgcagtctagagttattgctagtttattnttagtcagctaggcgggtatagttcggacgtcgtcgtaccggttcgggacgggggtaacctacggggttaggtacggttacgtaaacggtacgttcggtacggcgtacggtaccgaccgttnttaccgttcgtacctttaccgactttccccgg

SEQ ID NO: 185375 - DNA, 607 bp, Homo sapiens
  misc_feature: GYAE6OF02G9Q3I.14.23.C01.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagaagcaacttagcctggtaccagcagaaacctggccaggctcccaggctcctcatctatggtncactcccaccagggccacgtggtcgtcccatcccgaggttcaggtggctaggttgggtctaggggactaggtacgttccactcctcacctatcagcacgcctgcagtctagtaagttattttgacttagttttatttatttgtactagtactagttaattaataaccgttcggtaccttccggtaggtaccgtttacgggaccgtaaacgggaaccgtaagggtacgtaaacgtaaccgaaaacggtaaccgttaggtacggtaccgtagaccgtaaccgtattaccggttagttaccttactaccg

SEQ ID NO: 185376 - DNA, 627 bp, Homo sapiens
  misc_feature: GYAE6OF02HMOBT.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccaacagaaacctggccaggctcccaggctcctcatctatggtgcatccaccagggccacgtggtcgtcccagcctaggttcagtggcaggtgggtctgggacaggagttcactctcaccatcagcagcctgctagtctagaagtattttggacgtttagtttatttagttcgtacgtagtacgtaagttaacttaagttaaccggtcggtacccgttacgggttacgggttacccggttccgggaaccgggtaaacgggtaaaccggtaagggtaacggtaacgttaaccggaaacggttaacgtacgggtacggtaccgtacgtacccacgttactccgtttaccgttacttaccgtaccttccccgg

SEQ ID NO: 185377 - DNA, 552 bp, Homo sapiens
  misc_feature: GYAE6OF02HCZ5F.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaaacctggccaggctcccaggcctctcatctatggtgcatccaccgagggccacgtggtcgtcccagccaggttcaggtggcaggtgggtctgggacaggtacgttcactctcaccatcagcacgcctgctagtctagaagtattttgacttagtttaatttattgttcagtcagttattaagtaacgtgtaccgtcggtcggtacgttcggacgtaacggtaccgtaaggtaggaactacgaaacgacgttggtaggtctacgaccactactcgtcgttcttactac

SEQ ID NO: 185378 - DNA, 596 bp, Homo sapiens
  misc_feature: GYAE6OF02IBNVI.14.23.C01.1.454.CMB.1.raw
  modified_base (205)..(205): a, c, t, g, unknown or other
  misc_feature (205)..(205): n is a, c, g, or t
  modified_base (296)..(296): a, c, t, g, unknown or other
  misc_feature (296)..(296): n is a, c, g, or t
  modified_base (332)..(332): a, c, t, g, unknown or other
  misc_feature (332)..(332): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaancgccacctctcctgcagggccagtcagagtgtagaagctaacgttagcctggtaccagcagaaacctggccaggcctccgaggcctcctanactctatggtgctatcccacgacggcctagtggtcncccagccaggttcaggtggctaggtcgggtctgggacaggtacgttcacgtcacgaccatcgagcagctcgctagtcgtagaagttatttgactagtttttactattgactagtcaagtttactaaacgacgttcggtcccttacggtcggtacgttcccgggacaacgggtaccgaaggtaccgtaaaatccggaaaaccgttagtagggttacggaccgtacgaccgtaacgttagttaccgtttaggtccttcgttaaccc

SEQ ID NO: 185379 - DNA, 644 bp, Homo sapiens
  misc_feature: GYAE6OF02HBJA5.14.23.C01.1.454.CMB.1.raw
  modified_base (203)..(203): a, c, t, g, unknown or other
  misc_feature (203)..(203): n is a, c, g, or t
  modified_base (294)..(294): a, c, t, g, unknown or other
  misc_feature (294)..(294): n is a, c, g, or t
  modified_base (410)..(410): a, c, t, g, unknown or other
  misc_feature (410)..(410): n is a, c, g, or t
  modified_base (619)..(619): a, c, t, g, unknown or other
  misc_feature (619)..(619): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaangccaccctctcctgcagggccagtcagagtgttagaagcaacttagcctggtaccagcaagaaacctggaccaggcctcccgaggcctccncattctatgggtctcactccgaccgagggccacgtggtcgtccagccgtaggttcaggtcggcagggtcgggtacgtgggacctaggtacgttcacgttctaccaccgtatcgacncgacgccgtagcgtagtctagtaacgttattttcgactttaagttttattacgttacgtacgtagtccgtaaagtttactaaacgttaccggttcggtaccccgttggtaccgggttaccgttacggaacccggtaaagggtaaccggtaagggtacgaaacgttacggtaacggtaacgttcggacggtacgttcgaccttaaccgtnttacgtttccgtacttaccgtaccg

SEQ ID NO: 185380 - DNA, 645 bp, Homo sapiens
  misc_feature: GYAE6OF02G8HE6.14.23.C01.1.454.CMB.1.raw
  modified_base (204)..(204): a, c, t, g, unknown or other
  misc_feature (204)..(204): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcatggccagtcagagtgttagaagcaacttagcctaggtaccagcagaaacctggccaggctcccaggctcctcatctatggtgcagtcccaccgagggcccacgtggtctcccgagcctaggttcaggtcggcgtaggtcggggtctaggggactaggtacgttccacgttctaccacctatacgacgcacgccgtagcgtacgtctagtaagttagttttcgacttagttttattagtttgtactaggtacctaagttaacttaaacgttaaccgtcgggtcccgtttacccgggtagggttaccggttaccggaccggtaaacggggtaacccgtaaggggtacggtaaaactaaccggtaaaacggtacttaggttcggaccgtacgtaaccgaccttacgttccttacggttccttaaccg

SEQ ID NO: 185381 - DNA, 678 bp, Homo sapiens
  misc_feature: GYAE6OF02JB3DW.14.23.C01.1.454.CMB.1.raw
  modified_base (297)..(297): a, c, t, g, unknown or other
  misc_feature (297)..(297): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtgttagaagcaacttagcctggtaccagcaagaaacctggccaggcctacccaggcctacctnactcgtatcggtgcactcccacgacgggtccacgtggtcgacccagccgtaggttcaggtcggctaggtcgggtctacgggactaggtaccggttcaccgttactccgaaccctagtaccgagaccgacgtcccgtagctacggttctaggtaagttacttttacggcttaaggtttttactttacgttcgttacgaacgttctaaaggttaactttaaaacgtaacgttcccgggtaccgtttaccgggtaggtttaacccggttccggaaccggaaaccgggtacccgttaagggtaacggtaactaacccggtaaagtaaccggtggtaacgacgttacgaacccggtactacgttaccgtcggttactttccaaccg

SEQ ID NO: 185382 - DNA, 508 bp, Homo sapiens
  misc_feature: GYAE6OF02G836D.14.23.C01.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (321)..(321): a, c, t, g, unknown or other
  misc_feature (321)..(321): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctntcctgcagggccagtcagagtgttagaagcaacttagcctggtaccagcagaaacctggccaggctcccaggctcctcatctatggtgcatccaccagggccactggntcccagccaggttcagtggcagtggtctgggacagagttcactctcaccatcagcagcctgcagtctgaagattttgcagtttattattgtcaagcagttataataactgcctcgtgacgtttcgcaaggacgaacggtaggaagtacgaaacgaactagtaggcttagcaccatactcgtctctac

SEQ ID NO: 185383 - DNA, 568 bp, Homo sapiens
  misc_feature: GYAE6OF02JAG8U.14.23.C01.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccagggggaaanagcccaccctctcctgcagggccagtcagagtgttagaagcaacttagcctggtaccagcagaacctggccaggctcccaggctcctcatctatggtncatcccaccaggggcccacgtgggtctccccagcccaggttccaggtggcagggttggggtctggggacaggtagttcacttcctcacctatcagccacgcctgcagtctagaagtatttgctagtttattagttgtcagtcagttaataagttaactcggaccttccggtaggtaccgttcgggaccgtaacgggaccgtaagggtaggaaacgtacgaaacgtaacgtggtaggctagacaccgtatcgtcttccgttctaccg

SEQ ID NO: 185384 - DNA, 530 bp, Homo sapiens
  misc_feature: GYAE6OF02FWSNU.14.23.C01.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (298)..(298): a, c, t, g, unknown or other
  misc_feature (298)..(298): n is a, c, g, or t
  modified_base (398)..(398): a, c, t, g, unknown or other
  misc_feature (398)..(398): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctntcctgcagggccagtcagagtgttagaagcaacttagcctggtaccagcagaacctggccaggctccaggctcctcatctatggtncatccaccagggccacgtggtctcccagccaggttcagtggcaggtgggtctggggacaggtagttcactctcaccatcagcagcctgcagtctgaagtntttgctagtttattattgtcagctagtataataacgtgtacctcggtgtacgttcgaccgtaagggaccgtaaggtacgtaaactacgaaacgtaacgtaggtcggactgacactactctcgttctactacc

SEQ ID NO: 185385 - DNA, 597 bp, Homo sapiens
  misc_feature: GYAE6OF02H3RNA.14.23.C01.1.454.CMB.1.raw
  modified_base (204)..(204): a, c, t, g, unknown or other
  misc_feature (204)..(204): n is a, c, g, or t
  modified_base (303)..(303): a, c, t, g, unknown or other
  misc_feature (303)..(303): n is a, c, g, or t
  modified_base (370)..(370): a, c, t, g, unknown or other
  misc_feature (370)..(370): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagaagcaacttagcctggtaccagcagaaacctggccaggctcccaggcctcctcatctatggtnctatcccaccgacgggccacgtggtcgtacccagccctaggttcagtggcaggtcgggtctgggacnggtagttcactctcaccatcagcagcctgcagtcgtagtaagtagttttcgacttaagtttatttagtgtactagtcaagttaataagtaactcggttaccctaccggtacggtacgttaccgggaccgtaaacgggtaccgtaaggtacggaaacttaccggaaaacgtaacgttaggacggttacctaggacctaaccgtattcccgtggttaccttactacccg

SEQ ID NO: 185386 - DNA, 587 bp, Homo sapiens
  misc_feature: GYAE6OF02F7USX.14.23.C01.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
tcagcgtctagtaccacgaccggtgctcgatttagtacacgtgattagggatttggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcagaacctggccaggctcccaggctcctcatctatggtnctatcccaccgagggcccacgtggtcgtccccagcccgtaaggtttccaggttcggctaggttcggggtcctaggggaccaggtacggtttccacgttcctaccacctatccgagcacgcctgctagtcgtagaagtattttgcttagttttattattgtcagtctagttattaatacgtcggtaccgttcggtcggtacgttccggaccgtaagggaccgtaaggtacgaacgtacgaaacgtaacgtgtacggtcgtacgaccacctactcgtacgttcttctac

SEQ ID NO: 185387 - DNA, 589 bp, Homo sapiens
  misc_feature: GYAE6OF02H7ZKB.14.23.C01.1.454.CMB.1.raw
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
  modified_base (305)..(305): a, c, t, g, unknown or other
  misc_feature (305)..(305): n is a, c, g, or t
  modified_base (583)..(583): a, c, t, g, unknown or other
  misc_feature (583)..(583): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccngacagaaacctggccaggcctccgaggcctcctcatctagtggtncatcccaccagggccacgtggtcgcccagcctaggttcaggtcggctaggtgggtctggggacaggacgttcactctcacctatcacgcacgcctgcagtctagaagtactttgacttagtttatttattgtctagctaagttattaataacgtggtccttaccggtaggtaccgtttcggacgtaaacggggtaacctaagggtacggtaaacttaccgaaaccggtaacgttgggtacggtctacggacctaaccgtattccgtcgtttacccttntacccg

SEQ ID NO: 185388 - DNA, 565 bp, Homo sapiens
  misc_feature: GYAE6OF02GBAI1.14.23.C01.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
  modified_base (365)..(365): a, c, t, g, unknown or other
  misc_feature (365)..(365): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagaagcaacttagcctggtaccagcagaaacctggccaggcctcccgaggctcctcatctatggtncatcccgaccagggccactggtctcccagccaggttcaggtggcaggtgggtctgggacaggngttcacttctacacatcagcagcctgcagtctgaagtatttgacttagtttaattattcgtcagtactaaggttaattaaactaacgttcggcccgttacgtcgggttaaccgttcggacccgtaaaggggacctaaagggttacggaaactacgaaacggtaacgtcggtaggcgtagcactatccgtagttcctctac

SEQ ID NO: 185389 - DNA, 611 bp, Homo sapiens
  misc_feature: GYAE6OF02ILMGX.14.23.C01.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (266)..(266): a, c, t, g, unknown or other
  misc_feature (266)..(266): n is a, c, g, or t
  modified_base (307)..(307): a, c, t, g, unknown or other
  misc_feature (307)..(307): n is a, c, g, or t
  modified_base (318)..(318): a, c, t, g, unknown or other
  misc_feature (318)..(318): n is a, c, g, or t
  modified_base (333)..(333): a, c, t, g, unknown or other
  misc_feature (333)..(333): n is a, c, g, or t
tcagcgtctagtaccacgaccggtgctcgatttagtacacgtgattagggattggggggaggaactgctcagttaggacccagacggaaccatggaagcccccagcgcagcttctcttcctcctgctactctggctcccagataccactggagaaatgtgatgacgcagtctccagccaccctgtctgtgtctccgaggggaaangccaccctntccgtgcagggcccaggtccgagagtgttagaagcaacttgcctggtacccngcagaaacctggaccaggctcccagctctcatctatggtcncacgtccacgngggccacgtggtccnccagccaggttcaggtgcgagtggtctgggactgacgttcactctacacctatcgagcacgcctacgactacgtactagaaagttcttttacgacttaggttttatttcgtttgtacctacgtctaagttataaacgtaacgtcggtaccctcgggtacggtaccgtttccgggaccgtaaacggggtaccgtaagggttcggaaacgttaccgaaaacggtaaccgtcgggtacgtccgtaggaccctaccgtagttcgtacgttccgtactacccg

SEQ ID NO: 185390 - DNA, 652 bp, Homo sapiens
  misc_feature: GYAE6OF02FLAP4.14.23.C01.1.454.CMB.1.raw
  modified_base (204)..(204): a, c, t, g, unknown or other
  misc_feature (204)..(204): n is a, c, g, or t
  modified_base (305)..(305): a, c, t, g, unknown or other
  misc_feature (305)..(305): n is a, c, g, or t
tcagcgtctagtaccacgaccggtgctcgatttagtacacgtgattagggattgggggaggaactgctcagttaggacccagacggaaccatggaagccccagcgcagcttctcttcctcctgccactctggctcccagataccactggagaaatagtgatgacgcagtctccagccaccctgtctgtgtctccgaggggaaangccaccctctcctgcagggccagtcagagtgttagaagcaacttagcctggtaccagcaagaaacctggccaggcctcccaggtcctcctcatctatggtncatccaccgagggccctacgtgggtctccccgagtcccgtaggttccaggtcggctagggtggggtctggggaactaggtacgttcactcctacacctatccagcacgcctgctagtctagaagttattttcgactttaagttttattagtttcgtacacgtactaagttaattaaacgttaacgtcgggtacccgttaccgggttagggtaacccggtttccggaacccggtaaaggggtaacccgtaagggtacggaaacgtaaccggtaaaacggtacggttagggttacggtaccgttacggacccgtaacctacgttaccgttcgttaccgttacgttaccg

SEQ ID NO: 185391 - DNA, 838 bp, Homo sapiens
  misc_feature: GYAE6OF02HCSXI.14.23.C01.1.454.CMB.1.raw
  modified_base (204)..(204): a, c, t, g, unknown or other
  misc_feature (204)..(204): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcacgggccagtcagagtgttagaagcaactagcctggtaccagcaagaaacctggccaggcctccaggcctcctcacttctagtggtcgctactcccaccgacgggccacgttcggtcgtaccccagcccgtaggttccgaggttcggaccgtaaggggtttcggggtacgtacggggaacgtaacggtacgtttaccaaccgtttccgttaccaacccgtattaccgaacggcctaaccggtcccgtaggcctaacggttaccgtagggttaaacgttgtttttcgaacgttttaaggttttttactttaacggtttcggtactaacggttacgtaaacggtttaaatttaaaaccgttaaccggttccgggttaccccgtttacggggtttaacccgggttaacccgggttttaccggggaaaacccggtaaaaccggggggttaaaccgttaaacggggggttaaacggttaaaaaccgttaaacccggggtaaaaaacccgggttaaccggtttacggggtaaccggggttacccgttaaggtaacccccggtaaaccgtttaccggtttaacccgttttaccgggttttaccctttaccggtttaacccccgg

SEQ ID NO: 185392 - DNA, 667 bp, Homo sapiens
  misc_feature: GYAE6OF02JFY3Q.14.23.C01.1.454.CMB.1.raw
  modified_base (203)..(203): a, c, t, g, unknown or other
  misc_feature (203)..(203): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (315)..(315): a, c, t, g, unknown or other
  misc_feature (315)..(315): n is a, c, g, or t
  modified_base (443)..(443): a, c, t, g, unknown or other
  misc_feature (443)..(443): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccacctgtctgtgtctccagggggaaanagccacctctcctgcagggccagtcagagtgttagaagcaacttagcctggtaccaggcaagaaaccgtgccaggctccccaggcctcctnatctatggtncactccaccgngggtcccactgggtctaccccgagtcccaggttccagttggcaggttcggctggggactaggtacgttccagttcctacgacccatacacgtcaacgtcccgtagacgtacgtcgtagtaaacggttnttttggacctttaggttttaaccgtttatttacggttccaagtacgtaaggtttaaactaagttaaacccttgggacccgtttccgggttacggtaaccggtttccggaaccggtaaacgggtaccgtaaagggttacggtaaacgtacggtaaaaccggtacggtacgggttaaggtaccgtaccgacgttacccgagtttaccgtcgttaccttacgtaccg

SEQ ID NO: 185393 - DNA, 745 bp, Homo sapiens
  misc_feature: GYAE6OF02JG4F1.14.23.C01.1.454.CMB.1.raw
  modified_base (205)..(205): a, c, t, g, unknown or other
  misc_feature (205)..(205): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaangccaccctctcctgcagggccagtcagagtgtagaagcaacttagcctggtaccagcagaacctggccaggcctcccaggcctcctcacttctagtcggtgactactacccgaccgacggggcccaccgtgggttccgtaccccgaggtccccgtagggtttccaggtcggacgtagggttcggggtccgtagggggaactaggtacgttaccaccgttccgtaccgacccgtacgttaccgacggtaccgacggtacccgtcgtaccgtacgttccgtaggtaaacgttagttttacgtacgttacgttttacgtttacgtttacgttacgtaacgtaccgtaaacggttaattaaacgttaaccgttacggtacccgtttaccgggttacgggttaccgggtttaccggtaacccggtaaacggggaccgttaaacgggtacggtaaaacgtaccggtaaaacggtaaccggttagggtaccggtacgtacggtacccgtaaccgtacgtttaccgtaaacgttccgttacgttaccg

SEQ ID NO: 185394 - DNA, 589 bp, Homo sapiens
  misc_feature: GYAE6OF02F6T3C.14.23.C01.1.454.CMB.1.raw
  modified_base (202)..(202): a, c, t, g, unknown or other
  misc_feature (202)..(202): n is a, c, g, or t
  modified_base (301)..(301): a, c, t, g, unknown or other
  misc_feature (301)..(301): n is a, c, g, or t
  modified_base (401)..(401): a, c, t, g, unknown or other
  misc_feature (401)..(401): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccacctgtctgtgtctccgaggggaangccacctctcctgcagggccagtcagagtgttagagcaacttagcctggtaccagcaagaactggaccaggcctcccaggcctcctcatctagtggtcncactccaccgagggccctacgtcgggtctaccccgagcccgtaggttcaggtggcgtaggttgggtcgtgggaacaggtagttcaactctaccgaacctntacgacgcacgcctcgcgtacgtctagaagttagtttcgacttagtttaattatttgtactagactagttaataatacgtcgtccttacggtcgtacgttcgacgaaacggaccgtaggtacgaaacgtacgtaaacgtaccgtaggtacgtacgtacgacctacgtatacgttcgtccttactaccg

SEQ ID NO: 185395 - DNA, 662 bp, Homo sapiens
  misc_feature: GYAE6OF02I3306.14.23.C01.1.454.CMB.1.raw
  modified_base (204)..(204): a, c, t, g, unknown or other
  misc_feature (204)..(204): n is a, c, g, or t
  modified_base (307)..(307): a, c, t, g, unknown or other
  misc_feature (307)..(307): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgcccaccctctcctgcgagggccagtcagagtgttagaagcaacttagcctggtaccagcacgaacctggccaggcctccgaggctcctacatctagtggtnaccactcccaccgacgggccctagtggtcctcccaggcccgtaggttccaggtcggcgaggttcgggtcgtaggggaactaggtacgttaccacgttcctacaacctagtacgacgtacgacgtccgtagacctacgttcgtagaagttacgttttcgacttaagttttattagtttagtctaacgtcgtaagttaacttaacttacgtcggtaccgttccggtacggttaccggttaccggaccggtaaacggggaccgtaagggtagtaaacgtaaccggtaaaacggtaacgttcggtacgggaccttacggacctaccggtacgttacgttacggttacctacttaacccg

SEQ ID NO: 185396 - DNA, 578 bp, Homo sapiens
  misc_feature: GYAE6OF02FMMPQ.14.23.C01.1.454.CMB.1.raw
  modified_base (201)..(201): a, c, t, g, unknown or other
  misc_feature (201)..(201): n is a, c, g, or t
  modified_base (302)..(302): a, c, t, g, unknown or other
  misc_feature (302)..(302): n is a, c, g, or t
tcagcgtctagtaccacgaccggtgctcgattagtacacgtgattagggattggggaggaactgctcagttaggacccagacggaaccatggaagccccagcgcagtttctcttcctcctgctactctggctcccagataccactggagaaatagtgatgacgcagtctccagccaccctgtctgtgtctccaggggaagngccaccctctcctgcaggccagtcagagtgtagagcaacttagcctggtaccagcagaaacctggccaggcctccccaggcctccctcatcctagtggttncatccaccagggtccacgtggtcgtcccagccaggttcaggtggcaggtgggtctgggacagacgttcactctcaccactcagcagcctgcagtctagaacgtatttacgctagtttacttagttgtactagactagtacttaactaactggtcctaccggtagaccggttccggaccgaaacgggacctaagggtacgtaactacgaaaccggtaaccgtggtacggtctacgaccgtaaccctctaccgttcgttaccttaccgtacttccccg

SEQ ID NO: 185397 - DNA, 675 bp, Homo sapiens
  misc_feature: GYAE6OF02FT1TD.14.23.C01.1.454.CMB.1.raw
  modified_base (207)..(207): a, c, t, g, unknown or other
  misc_feature (207)..(207): n is a, c, g, or t
  modified_base (237)..(237): a, c, t, g, unknown or other
  misc_feature (237)..(237): n is a, c, g, or t
  modified_base (245)..(245): a, c, t, g, unknown or other
  misc_feature (245)..(245): n is a, c, g, or t
  modified_base (297)..(297): a, c, t, g, unknown or other
  misc_feature (297)..(297): n is a, c, g, or t
  modified_base (308)..(308): a, c, t, g, unknown or other
  misc_feature (308)..(308): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatggacgcagtctccagcccaccctgtctgtgtctccgagggggaaancgccaccctctcctgcacgggccagtcagngtgtagancaacttagcctggaccagcaagaacctggaccaggcctcccgaggcctcctnatctagtggtncactcccacgcgggccagttggtcgtcccaggtcctaggttcaggtcggccgtagggttcgggtctaggggactagggtacgttccgacttccaccgaacctatcccgaacgccaccggccctaggaccgtaggttactaggtaacgtttcttttcggactttaaggttttactttagttcgtctacggtactaagtttacttaaacgtaccgtcggtcccgttacggtaggttaacccggttcgggaccggtaaacggggtacccgtaagggttaccggtaaacgtaaccgtaaacgggtaacgttcgggtacggtaccgttacggaccaccgttacgtccggtttacgttacccgttctaacccg

SEQ ID NO: 185398 - DNA, 663 bp, Homo sapiens
  misc_feature: GYAE6OF02FYLRU.14.23.C01.1.454.CMB.1.raw
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaancgccgccctctcctgcgagggccagtcagagtgtagagcaacttacgcctggaccagcaagaacctggccaggcctcccgaggcctcctcatctagtggtcnctactcccaccgacgggccacgttggtctcccgagtcccgtaggttcaggtcggacgtaggtcgggtcgtaggggactaggtacgttccacgttcctaccgaacctacgtaccgacgtcctacggtcccgtggacctacggttcgtaaggtaaacgtttcgttttcgacgttttaaggtttttatttagtttacgtacgtagtcgttaaagttaacttaaacgttacgtcgggtcccttcgggtacggtaccggttaccgaccggtaacgggtaaccgtaagggttacgaaactaccggtaaaacgtacgtaggtacggacgttcgacctacgtacgttcgttcgttacttacctccg

SEQ ID NO: 185399 - DNA, 649 bp, Homo sapiens
  misc_feature: GYAE6OF02J08AK.14.23.C01.1.454.CMB.1.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
  modified_base (309)..(309): a, c, t, g, unknown or other
  misc_feature (309)..(309): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccagggggaaangcccaccctctcctgcagggccagtcagngtgtagacgcaacttagcctaggtaccagcaagaaaccgtgggaccagggtcctcccgaggcctcctcactctagngtgcactccgaccgacggcctacgtcggtcctacccgacgtccgtaggttcaggtcgccgtacggtgggtactggggaaccaggtacgttccactcgtacgaccagtcgacgcacgcgtcgactcgtacgagtaagtatttcggacttagtttaatttacgttgtacgagtacgtaagttaagttaacttaacggttaccggtccgtttacggtacgggtttaccgtaccggtaccggaaacggggttaccgaaagggtacggtaaaccgttacggaaaccgtaacggtcggttaaggaccgttgacgtaaccgtcttacgtacgttactcccttaaccg

SEQ ID NO: 185400 - DNA, 825 bp, Homo sapiens
  misc_feature: GYAE6OF02JV5W7.14.23.C01.1.454.CMB.1.raw
  modified_base (205)..(205): a, c, t, g, unknown or other
  misc_feature (205)..(205): n is a, c, g, or t
tcagcgtctagtaccacgaccggtgctcgatttagtacacgtgattagggattgggggagggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagtgttagaagcacttagcctggtaccagcaacgaaacctggacccaggtcctaccccgagggccttccctctaacttccgtaagtcggttcgacctacttaccccgaccgaacgggggtccccaacggtttcgggtaccttccccgaattcccccgtaaggggtttccaacggggttcggaccgttaacgggggttcgggggttccgtagggggggaaacccttaacggggtaagttttccccgtaaaccgttcccgtaacccggtacccctaagttacccgaaggtaccgaacgtcccgtttacgccccggttaagttccggttaacgggtaaaacgtttcggttttttacggaaccgttttagggtttttaaattttaccggtttggttacccgtaaggtacgtaaaggttttaaactaacgtttaaaccgttcggggtaccctttaccgggttcggttaacggttaccgggtaccgaaacgggggtacccttaagggggtaactaacgttaaccggaaaaccggtaagttcgggtacggtaccgtacggacctacgaccgtttacggtccgtttacgttaaccctcg

SEQ ID NO: 185401 - DNA, 604 bp, Homo sapiens
  misc_feature: GYAE6OF02G7S8F.14.23.C01.1.454.CMB.1.raw
  modified_base (205)..(205): a, c, t, g, unknown or other
  misc_feature (205)..(205): n is a, c, g, or t
  modified_base (407)..(407): a, c, t, g, unknown or other
  misc_feature (407)..(407): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanagcccaccctctcctgcagggccagtcagagtgttagaagcaacttgcctggtaccagcaagaaacctggaccaggcctcccgaggcctcctcatctagtggtgcactcccaccgagggccacgtggtcgtcccagcccgaggttccaggtcggacgtagggtcgggtctaggggactaggtacgttcacgtcctacacctntacagcacgcctgctagtctagaagttgtttacgcttaagttttattagttcgtactagtacgtaagttaataacgtacgtcggtaccttcggtaggtaccgttaccggacgtaaacgggactaagggtacgtaactacgaaacggtactgggtacgtccgtaggacctaccgtagttccgttcgttcttactaccg

SEQ ID NO: 185402 - DNA, 695 bp, Homo sapiens
  misc_feature: GYAE6OF02GDRLU.14.23.C01.1.454.CMB.1.raw
  modified_base (540)..(540): a, c, t, g, unknown or other
  misc_feature (540)..(540): n is a, c, g, or t
  modified_base (674)..(674): a, c, t, g, unknown or other
  misc_feature (674)..(674): n is a, c, g, or t
tcagcgtctagtaccacgaccggtgctcgatttagtacacgtgattagggattgggggaggaacgtgctcagttaggacccagacggaaccatggaagcccagcgcagcttctcttcctcctgctactctggctcccagataccactggagaatagtgatgacgcagtctccagccaccctgtcctgtcgtactccgagggaacacgccaacctctcctgcacgggccaggtccaggacgttagttacgaagcctaaacgttacgccttggtaccagcaacgaaccgtggccaaggtcctccgaggtcctacccactaacgtctaagttcgggtcacctaacgttcccgaaccgacggggtaccctacggttcggtacgtccccgacggtccgtaacggttcacggtcggtacgacgggtttcgggtcggtaaggggacctaaggtggtttccaacttcgtccgaacctagtacgacgtcaacggtcctaggccaggttcagtaacggtttacttcgtacgtttagttttaatacgtttnacgtagtacgtattaacttaaacgtcgttcgactttccggagtaccggttcacggtaacggaaccgtagggttaacgaacttaaccgaaacggtaacgttggtaaaccggtcttaggaaccctacgttaccgtntccggttaccttacgttaccg

SEQ ID NO: 185403 - DNA, 939 bp, Homo sapiens
  misc_feature: GYAE6OF02HRDT5.14.23.C01.1.454.CMB.1.raw
  modified_base (205)..(205): a, c, t, g, unknown or other
  misc_feature (205)..(205): n is a, c, g, or t
  modified_base (307)..(307): a, c, t, g, unknown or other
  misc_feature (307)..(307): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanacgcccaccctctcctgcgagggccagtcagagtgttaagaagctaacttagcctaggtaccagacagaaacctggaccaggcctacccgaggtcctccctnacgttctagtggtcgcactcccaccgacgggccacgttcggtccgtaccccgaggtcccgtaagggtttccgagggttcggcgtacggggttcgggggttaccgtacgggggaactaagggtacgtttccgaaccctttcccgttaccgaacccgtagtttcccgaaccggtacggtaccggtacccgttacggtaccgtaaaccggtttcggttaacgggttaaaacggtttagtttttttacggaaccgtttttaaaggttttttaaacgtttttaacgtttacgggtttaacccgtaaaggttaccgtttaaaacggttaaacttttaaaacggttaaacccgggtttacccgggttaccccgggttttacccggggttaccggggtttaaaccccggggttttaaccccgggggtaaacccgggttaaaacccgggggggtaaacccgtaaaacggggggttttaaaccggggtaaaaccgttaaaacccgggtaaaaaaacccgggtttacgggtttaaccggggtaaccgggtttaaccggtaaccccgggtaaccccgttaaaccggttaacccggttttaccgttttacccggtttaccccgtttttacccggtttaacccccg

SEQ ID NO: 185404 - DNA, 694 bp, Homo sapiens
  misc_feature: GYAE6OF02GKE6A.14.23.C01.1.454.CMB.1.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
  modified_base (304)..(304): a, c, t, g, unknown or other
  misc_feature (304)..(304): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctcgaggggaaanagccacctctcctgcagggccagtcagagtgtagaagcaacttagcctggtaccagcaagaaacctggccaggcctacccgaggctcctnatctagtggtncatcccacgacgggccagtggtcgcccagcctaggttcaggtcggctaggttcgggtctggggaacaggtacgttcaccgttctaccaacctataccgagccgacgtcccgtggacctaggttaccgtaaggttaaggttaatttttccggaacgttttaaggttttttaaacctttagttttcgtaccgtaacgtacgttaaggtttaaacttaaaccgtttaaccgttccgggttacccgtttaccggggtacgggttaccgggtttcccgggaaaccgggtaaacggggtaaccgtaaggggttaacggaaaacgttaccggaaaacgtacggttacggtacggactacggaccctacggttatcgtttacgttccttacttacccg

SEQ ID NO: 185405 - DNA, 622 bp, Homo sapiens
  misc_feature: GYAE6OF02GSIB1.14.23.C01.1.454.CMB.1.raw
  modified_base (204)..(204): a, c, t, g, unknown or other
  misc_feature (204)..(204): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagtgttagaagcaacttagcctggtaccagcaagaaaccgtggccaggcctcccaggctcctcatctagtggtgcactccgaccgagggccacgtggtcgtcccagcctaggttcaggtcggctaggtcgggtctaggggaacagggtacgtttaccacgttccgaccaccgtactccgacgcctacgcctgctagttcagaaagttagtttcgacgtttagttttacttagttgtacagtctaagttaataacgttaacgcggttaccgttcggtacgggtaaccgttaccggaccggaaacgggtaccgtaagggtaggaaactacggaaaacgtaacgttggtacggcgtagacctacgtacgttacgtcgttacttccgtaaccg

SEQ ID NO: 185406 - DNA, 581 bp, Homo sapiens
  misc_feature: GYAE6OF02F9BJU.14.23.C01.1.454.CMB.1.raw
  modified_base (305)..(305): a, c, t, g, unknown or other
  misc_feature (305)..(305): n is a, c, g, or t
  modified_base (378)..(378): a, c, t, g, unknown or other
  misc_feature (378)..(378): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccagggaaagagccaccctctcctgcagggccagtcagagtgttagaagcaacttagcctggtaccagcagaaacctggaccaggctccccaggcctcctacatcctatggtncactccaccgagggccactggtcgtcccagccagttcagtggacaggtgggtctgggacagtagttcacttcncaccatacagcagccctgcagtcagtaagtattttcgacttagtttattagttacgtctagctaagttaattaaataaccgttcggaccgttccggtacggtaccgttcggaaccgtaaacgggaccgtaagggtacgtaaataaccggaaaacgtactaggtcgtaccgtgacccgaacgtcttacgtacgttcctactacc

SEQ ID NO: 185407 - DNA, 694 bp, Homo sapiens
  misc_feature: GYAE6OF02HI6I8.14.23.C01.1.454.CMB.1.raw
  modified_base (132)..(132): a, c, t, g, unknown or other
  misc_feature (132)..(132): n is a, c, g, or t
  modified_base (180)..(180): a, c, t, g, unknown or other
  misc_feature (180)..(180): n is a, c, g, or t
  modified_base (191)..(191): a, c, t, g, unknown or other
  misc_feature (191)..(191): n is a, c, g, or t
  modified_base (209)..(209): a, c, t, g, unknown or other
  misc_feature (209)..(209): n is a, c, g, or t
  modified_base (672)..(672): a, c, t, g, unknown or other
  misc_feature (672)..(672): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactccgntcccacgataccactggagaaataagtgatgtacgcagtctccagccnccctgtctgtntctccgagggaaaggacnccacccctctcctgcgacggccgagtcagagtgttagaacgctaacttagtcctggtacgacgcgaacgaaacccgtggaccagggacctccccgagggacctccttaccatcttgtacgggtcgtacaccgtccaaccccggagggtacccgaccttgggttccggaccccagaccccgtagggtttccgacgtggggaccctaggttcgggggttaccgttacgggggaaccaaaggttcgtttaccgtactcccgttaccaaccgtatacggcacgcgtacctacggtcacgtctaggaatttagtttcggtacttaggttttactttaagttcttcgaagttaacagttaaacgttaataccgttaccggctacgggtttacggacgttaccggaacggtaaaggaccgtaagggtagtaacgacaaacggtagtcggtagcgtacaacgtcaacgttntccgttacgttcaccgttcccg

SEQ ID NO: 185408 - DNA, 651 bp, Homo sapiens
  misc_feature: GYAE6OF02IZBBI.14.23.C01.1.454.CMB.1.raw
  modified_base (466)..(466): a, c, t, g, unknown or other
  misc_feature (466)..(466): n is a, c, g, or t
  modified_base (620)..(620): a, c, t, g, unknown or other
  misc_feature (620)..(620): n is a, c, g, or t
  modified_base (638)..(638): a, c, t, g, unknown or other
  misc_feature (638)..(638): n is a, c, g, or t
  modified_base (645)..(645): a, c, t, g, unknown or other
  misc_feature (645)..(645): n is a, c, g, or t
tcagcgtctagtaccacgaccggtgctcgatttagtacacgtgattagggattgggggagggaactgctcagttaggacccaggacggaaccatggaagccccagcgcagcttctcttcctcctgctactctggctcccagataccacgtggagaaatgtgatggacgcgagtctccagccacccttgtctgtgtctccgaggggaaagacgccaccctctcctagccagggccagtcaggtacgttgtagaagctaacttgcctaggtaccagtcaagaaacctcggaccaggcctcccgaggcctacctcgattctagtggtacgcgactcccgaccgacgggcctacgtcggtcgtcccgacggacctacgggttcgacgggttggcggtaggttcggggtcggtacgggacgagttacgttcgaccttctaccgaccatccgagccacggctcgcgtacgtntacgtaacgttcgtttacgcgtttaagtttatttacgttcgtacgaacgggtctaagttacgttaaacgttacggtcgttacccgtcggttacggtaccgtttacgggccgtaaacgggtacgtaacgggtagaacgtacggaaacgtacgtgnggtctacgactcgtactntacgttntcgtac

SEQ ID NO: 185409 - DNA, 676 bp, Homo sapiens
  misc_feature: GYAE6OF02GI72I.14.23.C01.1.454.CMB.1.raw
  modified_base (306)..(306): a, c, t, g, unknown or other
  misc_feature (306)..(306): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttagaagcaacttagcctggtaccagcaagaaacctggccaggcctcccaggcctcctcatctagtcggtnctactcccaccgagggcccacgtggtaccgtcccgagccccgtaggttccaggtggcgtagggtgggtccgtggggacaggtacgtttccacttctccgaaccctatcgagtccaggtcctgcaggttctagaagttcttttgcttaagttttacttagtttcgtacgtacgtctaaggttaaacttaagttaaccgttcggtaccccgtttaccggtacgggtacccggtttaccgggaaccgtaaacgggggtaaccctaaggggttacggtaaaactacccgggtaaaaacggtacgttacgggttaacgggacgttacggtacccgtaacttaccgtttaccgtcggttttaccctccgttaaccg

SEQ ID NO: 185410 - DNA, 745 bp, Homo sapiens
  misc_feature: GYAE6OF02IBG0Z.14.23.C01.1.454.CMB.1.raw
  modified_base (207)..(207): a, c, t, g, unknown or other
  misc_feature (207)..(207): n is a, c, g, or t
  modified_base (298)..(298): a, c, t, g, unknown or other
  misc_feature (298)..(298): n is a, c, g, or t
  modified_base (315)..(315): a, c, t, g, unknown or other
  misc_feature (315)..(315): n is a, c, g, or t
  modified_base (572)..(572): a, c, t, g, unknown or other
  misc_feature (572)..(572): n is a, c, g, or t
  modified_base (719)..(719): a, c, t, g, unknown or other
  misc_feature (719)..(719): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtctccagccacccgtgtctgtgtcctccgaggggaaancgccgcctctcctgcagggccagtcagagtgttagagctaacttagcctggtaccagcaagaaacctggacaggcctcccgaggctcctanatctatcggtcactacnccgaccgacggcccaacgttcgggtcctaccccgacggtacccgtaacggtttccgaaggttcgggaccgtaacggggttcgggggtcgttaaacgggggaaccgtaacgggtaaacggtttcccaaggtttacccccttacctaaaccccaagtacccgagggtacccaaccgggtccccttaagggccctacgggttaacctagggtaaaagtttccgttttagtaccgttaaagttttaaagtttacgtttacnccgttaagtaacgtaaacgttaagtttaaacgtaccggtcggtccgttaccggtcggttacgggttaccgaacggtaaacggggtacctaaagggttacgaaataccggaaaactcggtacggtcggacgttacggactaacccggngtttactcggttacctatttacccgg

SEQ ID NO: 185411 - DNA, 600 bp, Homo sapiens
  misc_feature: GYAE6OF02GG4RD.14.23.C01.1.454.CMB.1.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagaagcaacttagcctggtaccagcagaactggcagctccaggctctcatcagtgtncatcccacgngggccacgtggtctacccagccgaggttccagtggcaggtcggctgggacagcttcgactctcacatcagtcacgcctgcctagtcgtgtaagttagtttcgacgttaagttttaattagtttacgtatacgtactaaagttaaattaacgtaaacgttcggtacccgttcggttacgggtaccgttccgggacgtaaacggggtacctaagggtacgtaaacgtaccggtaaaacgtaccgttaagggtccggtactacggtaccacgtaagtccttacggttccttacgtacccg

SEQ ID NO: 185412 - DNA, 658 bp, Homo sapiens
  misc_feature: GYAE6OF02IYUT7.14.23.C01.1.454.CMB.1.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaanagccaccctctcctgcagggccagtcagagtgttagaagctaactgccgtggaccagcaagaaacctggccaggctcccaggcctcctcatctagtggtncactccaccacgggccctacgtcggtcgtcccgagtcccgaggttcgaggtcggacgtagggtcggggtcgtggggaactaggtacgttacaccttcctaccaccgtactccgagtcacgtcccgtgactacgtgtaagtaagttattttgactttaagttttatttagtttcgtacgtagtactagttaataaacgttacgtcggttaccgttccggttacggtaccggttccggtaaccgaaacggggtaccgtaaagggttaccgtaaagtaacccggtaaacggtaaccgtcgggtacgtaccggtagtaacccgacgttaactccggtttacgtttacccgtcttaccgg

SEQ ID NO: 185413 - DNA, 803 bp, Homo sapiens
  misc_feature: GYAE6OF02H97CV.14.23.C01.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
  modified_base (316)..(316): a, c, t, g, unknown or other
  misc_feature (316)..(316): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccacctgtctgtgtctcgaggggaaanagccaccctctcctgcagggccagtcagtagtagttagaagctaacttagcctaggtaccagacagaaaccgtggccaaggcctacccgaggcctcctnaattctagtggtcncactcccaccgacgggccctagttcgggtcgtcccagcccgtagggttcaggtggacgtagggttcgggtcgtaggggactaggtacgtttccaccgttccgtaccaacctacgttacccgaggaccgaacgtccccgttacggtacccgtaacggttccgttaagggtaaacggtttaacgtttttttacggtaaccgttttaaggttttttaacgtttttaagtttacggtttaccgtaacggttacgttaaacggtttaacttaaaacgtttaaaccggttcccggtacccggtttacccgggtacgggtttaacccgggtttaccgggaaccggttaaaccggggaaccggtaacgggttaaacgggtaaacgttaaaccggtaaaaccggttaaccggttacggtaaccgggttacgttaaccggtaacctaacccggttacgtttacccggtttacggtttacccctttaccgttaacccg

SEQ ID NO: 185414 - DNA, 620 bp, Homo sapiens
  misc_feature: GYAE6OF02I7ACH.14.23.C01.1.454.CMB.1.raw
  modified_base (204)..(204): a, c, t, g, unknown or other
  misc_feature (204)..(204): n is a, c, g, or t
  modified_base (296)..(296): a, c, t, g, unknown or other
  misc_feature (296)..(296): n is a, c, g, or t
  modified_base (308)..(308): a, c, t, g, unknown or other
  misc_feature (308)..(308): n is a, c, g, or t
  modified_base (322)..(322): a, c, t, g, unknown or other
  misc_feature (322)..(322): n is a, c, g, or t
  modified_base (614)..(614): a, c, t, g, unknown or other
  misc_feature (614)..(614): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcgagggccagtcagagtgttagaagcaacttagcctggtaccagcaagaaacctggccaggcctcccgaggcctccncatctatggtcncactcccgaaccgngggcccacgtggtctcccgatcgtaggttcaggtcggactaggtgggtctaggggacaggtacgttcactcaccaccatccgagccacgtccgtgctaacgtcgtaagtaacgttgttttcgactttaggttttattagttcgtacagtactaagttactaaacgtacgttcgggtaccttacgggtcggtaccgttcggaaccggtaacgggtaccgtaagggtacgaaactaccggaaaacgtcgttaggtacggtacgtacggacctaccgtacttcgttcgttacctntacccg

SEQ ID NO: 185415 - DNA, 713 bp, Homo sapiens
  misc_feature: GYAE6OF02JC6GK.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgccagggccagtcagagtgttagaagcaacttagcctggtaccagcagaacctggccaggctccaggctcctcatctagtggtcgctactcccaaccgaggggcccaacgttgggtcgtcccccaggcccctagggtttccaggttcggccgaggttcggggtctagggggacaaggtacgtttccaacgtttcctaccgaaccctattccgaacgtaccgaacgtcccgtcgcctacggtaccttaggtaaacgttacgtttttggacctttaaggtttttaatttagtttgttacgtacgtaccgtaaggtttaaattaaacgttaacgttacggtacccgttacccggttacgggttaccggtttaccgggacccggtaaacggggtaacccgtaaagggtacggtaaacgttaaccgaaaacggtaaccgttagggttacgggacgttacgaccgtacccgtacttaccgttacggtttaccttaccgtacc

SEQ ID NO: 185416 - DNA, 612 bp, Homo sapiens
  misc_feature: GYAE6OF02GKUI9.14.23.C01.1.454.CMB.1.raw
  modified_base (205)..(205): a, c, t, g, unknown or other
  misc_feature (205)..(205): n is a, c, g, or t
  modified_base (605)..(605): a, c, t, g, unknown or other
  misc_feature (605)..(605): n is a, c, g, or t
tcagcgtctagtaccacgaccggtgctcgatttagtacacgtgattagggattgggggaggaactgctcagttaggacccagacggaaccatggaagccccagcgcacgcttctcttcctcctgctactctggctcccagataccactggagaaatagtgatgacgcagtctccagccaccctgtctgtgtctccgaggggaaancgccaccctctcctgcagggccagtcagagtgttagaagcaacttagcctggtaccagcagaacctggccaggctccaggctcctcatctatggtgcatccacagggccactggtcgtcccagccaggttcaggtcggcaggtgggtcgtgggacaggtagttcactctcaccatcgacgcagcctgcgtagtctaggtaacgtattttagcgttaaggttttactttagtttcgtacgtagtactagttaattaacttaaccgttcgggtacccttaccggtcgggttaacccgtttcggaccggaaacgggtacccgaagggtacggaaactacggaaaaccgtaacgttagggtaccgtacgtacggtacaccggtacttaccgtacgtttcccttntaacccg

SEQ ID NO: 185417 - DNA, 741 bp, Homo sapiens
  misc_feature: GYAE6OF02GRGK2.14.23.C01.1.454.CMB.1.raw
  modified_base (204)..(204): a, c, t, g, unknown or other
  misc_feature (204)..(204): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagatacactgagaatagtgatgacgcagtctccagccacccttgtctgtgtcctaccgaaggggaanacgccaccctctcctgcgacgggtccagtcaggagttggtaagagacctaacttacggctacggtaccgacgacaaacgaaccgtcggaccgtaacggccctacccgcgggccctccttacgacttactacggttcgggtcacctaccgtacccaaccgtaccgggaccacgttcgggcctcccgaacgccgtaacggttcgaaggtcggacgtagggtcgggtcgtacggggtaacaggtaaccgttctaaccgtccttaaccgaacccgttcgaccgaccggtacgtacggtaccctacgtacgtacgttccgtaaaggttacgttaagttttgacgttttaaagtttcggtttaattcggtaacgtagtaccgtaagttaaattaaccgagttaccgtaccgttccgtacgggttaccgttcgggtaaccaacggggtaaacgtacgggtaagtaaacggttaaccgaaaccgggtaacgttaacggtacggtaccgtcgaccgtaacgtccgtttatcgttacgtacttcccg

SEQ ID NO: 185418 - DNA, 620 bp, Homo sapiens
  misc_feature: GYAE6OF02G1KFO.14.23.C01.1.454.CMB.1.raw
  modified_base (305)..(305): a, c, t, g, unknown or other
  misc_feature (305)..(305): n is a, c, g, or t
  modified_base (322)..(322): a, c, t, g, unknown or other
  misc_feature (322)..(322): n is a, c, g, or t
tcagcgtctagtaccacgaccggtgctcgatttagtacacgtgattagggattgggggaggaactgctcagtttaggacccagacggaaccatggaagccccagcgcagcttctcttcctcctgctactctggctacccagataaccactggagaaatagtgatgacgcagtctccagccaccctgtctgtcgtctccgagggaagagccacctctcctgcagggccagtcagagtgttagaagcaacttagcctaggtaccaggacaagaaacctggacacggcctaccccagggtccctcctnattccgtaatcgggtcncttaccgaagtacggccagtcggactacgcccagtccgtaaggttccaggtcggacgtacggttgggacgtacgggaactacgtacttcactcgtacaccgtatcgacgcctacctacgactccgtaggtagttactttagtttacgtttacttacgtcgttacgtacgtacgtagtaacgttacgacgacgtcgtacggtccctacgtacggtttccgggacggtacggtacgtaagggtagaccgtactacgaacgtagtcgaggctcgactactagttctgtacttcgacttccg

SEQ ID NO: 185419 - DNA, 803 bp, Homo sapiens
  misc_feature: GYAE6OF02HIQI3.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccacctctcctgcagggccagtcagagtgttagaagctaacttagcctggtaccagcagaaacctggccaggcctcccgaggcctcctcactctagtggtgccactcccaccgacggggcctaacgtcgggtcgtaccccaggtccccgtaagggtttccaggttcggaccgtagggttcggggtccgtagggggaccaagggtacgtttaccgaaccgttcccgttaccaacccgtaacgttccgaaacgggtccctaaccggtcccgtttcggaaccgtaacggtttaccctagggtaaaagtttacgttttttacgacggtttaaagttttttaacgtttagtttacggttaccaaggttccgtaaaggtttaaacttaaaaccgtttaaccgggtcccggggtaccccttttaaccggggggttaccgggtttaacccgggtttaaccgggtaaaccccggaaacggggtaaaccgttaacgggggtaaacggttaaacttaacccgggtaaaaacgtaccggtttagggtaaccgggaccttacggaccctaaaccctgtttacccggtagttttacccttaccgttaaccccg

SEQ ID NO: 185420 - DNA, 775 bp, Homo sapiens
  misc_feature: GYAE6OF02HVOQW.14.23.C01.1.454.CMB.1.raw
  modified_base (299)..(299): a, c, t, g, unknown or other
  misc_feature (299)..(299): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctaccgaggggaaagagccaccctctcctgcgaggccagtcagagtgttaagaagctaacttagcctggtaccagcaagaaaccgtggccaggcctccgaggccttccncactctagtcgtgcactccaccgacggccacgttcggtccgtcccgacgccgtaggttcgaggtcggacgtagggtcgggtacggtcgggtacgtaggtacggtttcaccgttccgtacctaccgtacgtaccgaacggtacctacggtccccgtacggtacctagggttaccgttaaggttaaacggtttacggtttttccggtaacgttttaaagttttttaaacgttttacggttttacggttaccgtaaaggttaccgttaaaaggtttaaacctttaaaacgggttttaaacccggtccgggttaccccgtttaccggggtttaacgggttacccgggttttaccgggaaacccgggtaaacgggtaacccgggtaagggtacggtaaaaccgttacgaaaaccggttaacggtggttacggactacgaccgtaaccgtagtttccgttacggttaccttaccgttacccg

SEQ ID NO: 185421 - DNA, 605 bp, Homo sapiens
  misc_feature: GYAE6OF02F6MF4.14.23.C01.1.454.CMB.1.raw
  modified_base (204)..(204): a, c, t, g, unknown or other
  misc_feature (204)..(204): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagaagcaacttagcctggtaccagcagaaacctggccaggcctcccaggcctcctcatctagtggtgcactcccaccgacggggcccacgtcgggtcgtccccaggccctaggttcaggtggcgtagggtcgggtcgtggggactaaaaggtcgttaccaacgttctaccacctatcgagtccacgccctgctagtcgtagtaagttattttcgacttagttttattattgtacagtactagttaattaactacgtggtacccttcggtacggtaccgttccggaccggtaaggaccgtaaggtacgaataccgaaacgtacgtaggtacggactacgacctacgtattcgtacgttacttctaccg

SEQ ID NO: 185422 - DNA, 703 bp, Homo sapiens
  misc_feature: GYAE6OF02I56O8.14.23.C01.1.454.CMB.1.raw
  modified_base (190)..(190): a, c, t, g, unknown or other
  misc_feature (190)..(190): n is a, c, g, or t
  modified_base (201)..(201): a, c, t, g, unknown or other
  misc_feature (201)..(201): n is a, c, g, or t
  modified_base (342)..(342): a, c, t, g, unknown or other
  misc_feature (342)..(342): n is a, c, g, or t
  modified_base (678)..(678): a, c, t, g, unknown or other
  misc_feature (678)..(678): n is a, c, g, or t
  modified_base (697)..(697): a, c, t, g, unknown or other
  misc_feature (697)..(697): n is a, c, g, or t
tcagcgtctagtaccacgaccggtgctcgatttagtacacgtgattagggattgggggaggaactgctcagttaggacccagacggaaccatgggaagccccagcgcagcttctcttcctcctgctactctggctcccagataccatggagaaatgtgatgacgcagtctccagccacctgtctgtgtcncaggggaaacngtccaccctctcctgcgagggccagtcagacgttagtacgaacgtccaacgtttacgccctaggtacccagaccaaagaaacccgtcggaccacgggtccttaccccgagggcctaccctcaacgttccttagtcgggtcncctaagtccccaaccggtaggggcccctaacgttcgggtaccgtcccgaagtccccgttacgggttacctaaggggccggacgtagggtttccggggttctcgggggaacaggttcgttacccaacgttccctactaaaccgaccttcaacggtccaacggtccctggtaccgtaggttaccgtaaggtaacggttaattttccgggacttaagttttacgttaattcggttacacgactagtaacttaagtacgtcggccttacggtcgacggtttcggaccgtaagggacctaaggtagaaactcgaaacgtagtacggtagtccgtacgtacnccgtaatccgttactcgtntacccg

SEQ ID NO: 185423 - DNA, 581 bp, Homo sapiens
  misc_feature: GYAE6OF02GTT6W.14.23.C01.1.454.CMB.1.raw
  modified_base (204)..(204): a, c, t, g, unknown or other
  misc_feature (204)..(204): n is a, c, g, or t
  modified_base (436)..(436): a, c, t, g, unknown or other
  misc_feature (436)..(436): n is a, c, g, or t
  modified_base (572)..(572): a, c, t, g, unknown or other
  misc_feature (572)..(572): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagagcaacttagcctggtaccagcaagaaacctggccaggcctaccccgaggcctcctcatctatggtgcactccaccgaggccacgtggtcgtcccagccctaagggttcaggtggcctagggttcgggtcgtacggggacaggtacgttaccgactccgtacaccatcgacgcacgtcctgctagtcagaacgttntttgcttagtttatattgtcagtactagttataagtaacgtcgtccttcggtaggtaccgttcgggaccgaacgggacgtaaggtaggaaactacgaaacggtacttggtacgcgtcgacacctataccgttcgtnttacctacg

SEQ ID NO: 185424 - DNA, 596 bp, Homo sapiens
  misc_feature: GYAE6OF02GRY1U.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggatttggggaggaactgctcagttaggacccagacggaaccatggaagccccagcgcagcttctcttcctcctgctactctggctcccagataccactggagaaatagtgatgacgcagtctccagccaccctgtctgtgtctcgaggggaaangcccaccctctcctgcgagggccagtcagagtgttagaagcaacttagcctggtaccagcagaaacctggccaggcctccgaggctcctcactctagtggtgcatcccaccgacgggccacgtggtcgtcccaggccaggttcaggtgcgaggttcgggtctggggacagtacgttccactcgtcaaccatcgagcacgcctgacagtctagtaagtacttttagcttagtttaatttagtttgtactagtactaagttaataacgttacgtacggtccgtccggttaggtaccgttaccggaccggtaacgggtaaccgaagggtacgaaactacgaaacgtaacgtggtacggtcgtagacctaccgtagttccgtacgttcctactaccg

SEQ ID NO: 185425 - DNA, 638 bp, Homo sapiens
  misc_feature: GYAE6OF02IAMRH.14.23.C01.1.454.CMB.1.raw
  modified_base (205)..(205): a, c, t, g, unknown or other
  misc_feature (205)..(205): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanagccaccctctcctgcagggccagtcagagtgttaagaagcaacttagcctggtaaccagacaagaaaccgtggaccaggcctaccccgaggccttccctacaacgttctagttggtcgcctaactcccgaccgacgggccctacgttcgggtcgtcccgacgccgtaggttcaggtcggcgtaggtcgggtcgtagggactaggtacgttccgacttctccaccactcgagcacgtcctgactagtctagaacgttattttcgattagtttatttattcgtactagtactaaagttattaaacgtacgtcgtaccgttccggtcggtaaccgttccggacgaacgggtaacgaaggtaacgtaaactaccggaaacgtacgtaggaccggtacgtacgtacctacgtagttccgtcgtttacctcttacccg

SEQ ID NO: 185426 - DNA, 596 bp, Homo sapiens
  misc_feature: GYAE6OF02HPX9T.14.23.C01.1.454.CMB.1.raw
  modified_base (299)..(299): a, c, t, g, unknown or other
  misc_feature (299)..(299): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaagagccaccctctcctgcacgggccagtcagagtgttagaagcaacttagcctaggtaccagacagaaaccgtggccgaggcctccgaggcctccncatctatggtgcactcccgaaccgacgggcctacgtggtacgtcccgcgtaccgtggttaccaggttcggacgtagggttgggtcgtacgggacgaggtcgttcaccgttcctacgaccacgtcgaacgcacgtccttgcgtacgtacgtagtaagttagtttcgactttagtttatttacgttgtacagctaagttaactaagtaacgtcgtacctggtcgtacgttcgacgacggactaggagaacgtacgaacgtacgtgacgtcgctacgactctagttcgtcgttacaccgg

SEQ ID NO: 185427 - DNA, 651 bp, Homo sapiens
  misc_feature: GYAE6OF02GVR44.14.23.C01.1.454.CMB.1.raw
  modified_base (207)..(207): a, c, t, g, unknown or other
  misc_feature (207)..(207): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtcctccgagcccaccctgtctgtgtctccgaggggaaanacgccaccctctcctgcagggccagtcagagtgttagagctaacttagcctggtaccagtcaagaaaccgtggaccaggcctacccgaggtcctcctctagtctagtggtcgcactccaccgagggccagttcggtcgtcccagccgtaggttcaggtggcgtaggtggtcgtggggactaggagttccactctacactcacgagcacgcctgctagtcgtagaaacgttgttttcgctttaagtttatttagtttgtactagtactaagtaaacttaagttaaccgtcggttacccgttacgggtacgggttacccggttaccgggtaccggtaaacggggtaacccgtaaggggttacgggaaaccgttaacggaaaaccgttaacggttacggtacgtaccggtagaaccctaccgtacttcctagttcccttactacccg

SEQ ID NO: 185428 - DNA, 641 bp, Homo sapiens
  misc_feature: GYAE6OF02GPHDI.14.23.C01.1.454.CMB.1.raw
  modified_base (205)..(205): a, c, t, g, unknown or other
  misc_feature (205)..(205): n is a, c, g, or t
  modified_base (286)..(286): a, c, t, g, unknown or other
  misc_feature (286)..(286): n is a, c, g, or t
tcagcgtctagtaccacgaccggtgctcgattttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgcccaccctctcctgcgagggccagtcagagtgttaagagcaacttagcctggtaccagcaagaaacctggaccaggccncccaggcctcctcactctagtggtcgcactcccaccgacgggccacgtcggtacgtccccgagtcccgtaggttcaggtcggctagggtcgggtactgggacaggtcgttcacgttccaccactactcgagtccacgtcctagaccgtagtcttaggtaaattgtttcgacgtttaagtttttatttagtttcgtcgtaagtacttaagttacttaaacgttacgttcggtaccccgtagggtacgggttaccgttacggaccggtaaagggtaccgtaagggtagaaaccttacggaaaacgttaccgtagtaccggattaccgactacgtattccgtacgttacctcgttacc

SEQ ID NO: 185429 - DNA, 656 bp, Homo sapiens
  misc_feature: GYAE6OF02FWY4J.14.23.C01.1.454.CMB.1.raw
  modified_base (205)..(205): a, c, t, g, unknown or other
  misc_feature (205)..(205): n is a, c, g, or t
  modified_base (235)..(235): a, c, t, g, unknown or other
  misc_feature (235)..(235): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaancgcccaccctctcctgcagggccagtcagngtgtagaagcaacttagcctggtaccagcaagaaacctggaccaggcctcccgaggcctcctctatctagtggcaccactcccgacgacgggccacgtggtcgaccccagcccgtaggttcaggtcggactagggtcgggtcgtagggactaggtcgttacaaccgttctaccaccgtatcgacgtcgacgtccgtgacgtacgtcgtacgtaagttatttcgactttagtttatagtttcgtacagtactaagtaacttaaagttaaccggtcggtacccgttcggtacgggtaaccgtttaccggaaccgtaaggggaaccaagggttacgaaacttaccggtaaaaccggtaacgttacggtacggtaccgtacgacctaaccgtaacgttccgttacgttacccgttactaccccgg

SEQ ID NO: 185430 - DNA, 643 bp, Homo sapiens
  misc_feature: GYAE6OF02JXI51.14.23.C01.1.454.CMB.1.raw
  modified_base (205)..(205): a, c, t, g, unknown or other
  misc_feature (205)..(205): n is a, c, g, or t
  modified_base (311)..(311): a, c, t, g, unknown or other
  misc_feature (311)..(311): n is a, c, g, or t
  modified_base (413)..(413): a, c, t, g, unknown or other
  misc_feature (413)..(413): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggcctcccagataccactggagaaatagtgatgacgcagtctccagccaccctgtctgtgtctccgaggggtaangcccaccctctcctgcagggccagtcagagtgtagagcaacttgctggtaccagcaagaacctggaccaggcctacccgaggtctccctcacttctagtcgggtcnccgaactcccgaccgtagggccctaacggttcggttacccgcccaacggtcccgtaaggtttccgaaggtccggcgtagggttccgggtcgtaggggaaccnggtacgttcgaaccgttcaccgacgtacgtacgacggctacgtccgtgacgtacgtcgtaggtaattgtttacggatttagtttagttacgttcgtactaagtcgtaattaagttaactacctgggtccctcggttagggtacctacgggacctaacgggaacgtagtaggtaagtaccgtaaaggtcttacggcggtactcgactacgtcctgtaccgttatctacccg

SEQ ID NO: 185431 - DNA, 1029 bp, Homo sapiens
  misc_feature: GYAE6OF02HH8S5.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctcctgctactctggctcccagataccactcggagaaatagtgatgacgcagtctccagccacctgtctgtgtctccggaaggggaaacgacgacccaccctcttcctggccaacggggccaggttccaggtacggttggttaagaacgtcctaaaccgtttacggcccttagggttaacccagtaccaacgaaaaacccgttgggaacccgacgggtacccgttacccccgaagggtacccttaccccgtaccaacgtttaccgtaacgtttacgggttacggacctaacttcccccgaaaccgtaccgggggtacccctaaaccggtttccgggttaccggtacccccgttaaacgttaccccggtaacggggttttaccaaagggggttcccggtacggttaacggggtacggggggtttccgtacgggggggtaaaccctaaaggggttaaccgggttttaccctaacccgttttacccggttacccgtaaaacccggttaacgttttaaccccggaacgggtacccgtaaacccgggttccccgttaccgggtacgttaaaccgggtttacggttaaaccgtaaaaagggtttccttttttacgggaaacgttttacgggtttttaaacgtttttaccggtttacgtaaccgggtaacttaccgggttaaagtttaaaacgtttaaaccgttaaacccggtttccggggtaccgttttaccccggggtacggggtttaacccgtttacccggggtaccggttaaaaccggggggttaacctaaaacgggggttaccgtaaaggtttaaaccccgaaaaccgggttaccggtttaacggtacgggtaccgtttccggaaccgttaacccgacgtttacgttaacggttttactaaccggtttaacccg

SEQ ID NO: 185432 - DNA, 745 bp, Homo sapiens
  misc_feature: GYAE6OF02JC29I.14.23.C01.1.454.CMB.1.raw
  modified_base (204)..(204): a, c, t, g, unknown or other
  misc_feature (204)..(204): n is a, c, g, or t
  modified_base (309)..(309): a, c, t, g, unknown or other
  misc_feature (309)..(309): n is a, c, g, or t
  modified_base (335)..(335): a, c, t, g, unknown or other
  misc_feature (335)..(335): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangtcaccctctcctgcagggccagtcagagtgtagagctaacttagctggtaccagcaacgtaacctggccacggctccccgaggcctcctcactcctagtcggtncactccaccgagggccacgtggtccnccgagccgtggttcgaggtcggacgtagggttcggggtcctaggggaactaggcgttacaccgttcctacgacccagtccgacgccgtacgtccctacggcgtacggttaccgttaaggtaaacggtttacgttttacggtacgtttaaggtttttaacgttttacgtttcggtaccgttaacggtaccgttaaagtttaaacttaaacggttaaccgttaccgggtacccggtttaccgggtacgggttaacccgggttaccgggtaccgtaaaccgggggtaaccgtaaaggggttaccggtaaaacggttacccggtaaaaacggtaccggttagggtaccggttaccggtaacggtacccgtaacccgtagtttacccggtacgtttaccgttaccgttaaccccg

SEQ ID NO: 185433 - DNA, 703 bp, Homo sapiens
  misc_feature: GYAE6OF02GK9WA.14.23.C01.1.454.CMB.1.raw
  modified_base (308)..(308): a, c, t, g, unknown or other
  misc_feature (308)..(308): n is a, c, g, or t
  modified_base (410)..(410): a, c, t, g, unknown or other
  misc_feature (410)..(410): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaagagcccaccctctcctgcagggccagtcagagtgttagaagcaacttagcctggtaccagcaagaacctggccaggcctcccgaggtctcctcatctatggtcncactcccaacgcgggccacgtggtcgtcccaggccgtaggttccaggtcggcgtagggttcgggtactggggaacaggtacgttccaacttctaccgaaccncttacacgccgtacgtccgtgacctaacggttctacggtaacgttacttttacgctttaagttttaacttagtttcgtacgtacgtacgttaagttaacttaaacgttaccggtcggttacccgttaccgggtttacgggttaacccggttacccggggaaacccggtaaacggggtaacccgtaagggttacggtaaacgttaaccgtaaaaccgggtacggttacgggtacggtaccgttacggaccctaaccgtacgtttaccgtacggtttaccgttaccgttaacccg

SEQ ID NO: 185434 - DNA, 637 bp, Homo sapiens
  misc_feature: GYAE6OF02F1PRV.14.23.C01.1.454.CMB.1.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
tcagcgtctagtaccacgaccggtgctcgatttagtacacgtgattagggatttggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagaagcaacttagcctggtaccagcaagaacctggccaggcctcccaggcctcctcatctatggtncatcccaccgagggcctacgtggtcgtcccagccgtaggttcaggtggctaggtcgggtctaggggacaggtacgttcactccgtacaccgtatcagcacgcctgctagtctagaagtgtttgacttagttttattagtttgtacaggtacctaaggttaattaaacgttaaccgttcgggtaccccgtttaccgggtacgggttaaccggtttacccgggacccgtaaacggggtaacccgtaaggggttagaaacgtaacccggtaaaacggtaccgttagggtcggtaccgtaggtaccaccgtacttacgtcgtttacgttccttaaccg

SEQ ID NO: 185435 - DNA, 809 bp, Homo sapiens
  misc_feature: GYAE6OF02INRVH.14.23.C01.1.454.CMB.1.raw
tcagcgtctagtaccacgaccggtgctcgatttagtacacgtgattagggattgggggaggaactgctcagttaggacccagacggaaccatggaagcccagcgcagcttctcttcctcctcgcttactctggctcccagactaccactggaacaaatagtgaatgacgcagtctcagccaccctgtctgtcgtcctccgaaggggaaacacgtcccacctcgtacctgccgacgggtccaggtcacggtaagtcggtttaaggaacgtacctaaacgttagcccgtttagggaaccgaacggacgtaacgaaaaccggttggacccgtaaggaccgttacccccgaagggtccctacccgttaccaacgtttaccgtaactttcgggacgtaccgtacgtaccccgtaccgtaccgggacctaaccgtcgggtacctaccccgacgtccgtaacgtttccggagtaccggcgtacggtaggggtcgtaccgggtacgacggtcgttacgacttccaccgtaccagttaccgaacgtcgacgtacctcgtacgtaagttcctaaggaacgttacggtttttcgacgtttaccggttttaatttacgttaacggttacacggttcgtaaattaacgtaacgtttaaacctcgggtttacccttaccgggtcggttaccgtttaaccgggtaacggaaacccggggttacgtaaaacggggtagttaaaaccgttaccggaaaacgtttaacggcgggtaactcggtccgaaacggtaccctaaggttcttaccgttacgttcccttaacg

SEQ ID NO: 185436 - DNA, 805 bp, Homo sapiens
  misc_feature: GYAE6OF02G5WAJ.14.23.C01.1.454.CMB.1.raw
  modified_base (185)..(185): a, c, t, g, unknown or other
  misc_feature (185)..(185): n is a, c, g, or t
  modified_base (542)..(542): a, c, t, g, unknown or other
  misc_feature (542)..(542): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccccgtntcgtgtctctacgggaagggaagaccgaccctacctcctccgtcgacggaccggaccgtacgtacgaggtaggttaggttaaggaacgtaaccttaacgtaccgtaccggttaccggtacgacgacgaaaaccgtaaccggtccggaaccggaccgccccgtacccggaccggtccccttaccctacttacttaccgttaggttcgggtccgtacctacccgtaaccccgaaccgggtaccggacccttacgggttcggttccccgaccgaccgtacccgtaccgttacgacggtcgtacggtagggtcgggtacggtacggacgtaggtcgtactctcctaccactacgtacgacncaccgtcgacgtatcgttacggaagttacgtttgttacgtactttaagtttttacttacggttcaacgtacgttaacttaagtttaaacttaacggttaccgggttcccgttacccggttacgggtaccggttaaccgggcccggtaaacggaaacccgggttaaggtaacgggtaaccgtaaacgtaaccggtaacggttacgggttcggacgttacgacgtaccctaacgttccttacgggttccttaccttaccgtcccg

SEQ ID NO: 185437 - DNA, 731 bp, Homo sapiens
  misc_feature: GYAE6OF02IVXXP.14.23.C01.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (300)..(300): a, c, t, g, unknown or other
  misc_feature (300)..(300): n is a, c, g, or t
  modified_base (317)..(317): a, c, t, g, unknown or other
  misc_feature (317)..(317): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccacctgtctgtcgtctccgaggggaaancgccaccctntcctgcagggccagtcagtcgtgttagaagctaacttagcctggtaccagcaagaacctggaccaggcctacccgaggcctccctntactcgtagtcggtacnctactcccacggcgggccacgttcgggtcctacccctagttccggtacggttcgacgggtcggtacctaggggttcgggttcgtaacggggtacctagggttaccttccgtaaccttcctacccgtaacctcgttaaccgacggtaccctaaccggttccctacggtccttaacggttcgttaacgggttaaaagtttccgttttacggaccgtttaaagttttctttaacggttcgtacgtaacgtacctaaaggtttaactaaacggttactaccggggtcccctttacgggtaggtaaccgtttcccgggaagaaacggggtaaccgtaaggttagaaaccgttaccgaaaggtaccgtgggtacgaccgtacgtaccggaccttggtcccttacggttaccttgtacccg

SEQ ID NO: 185438 - DNA, 898 bp, Homo sapiens
  misc_feature: GYAE6OF02G78AS.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaatagtgatgacgcagtctccagccaccctgtctgtacgtcctccgaaggggaacacggccaccctctcctgccgaagggtccagtcaagtacgtgttaaggaagctaaacgttacgccgttcgggtaaccaaaccaaggaaaaccctggacctaagggccttaccccgacggacctcccgtctaacgtacttacgtaggtcgactaaccgtccaacccgacgggtacccaacgttcggtcgttaccccgaacggcccgtaacggttacgtaacggttcgggactaacggttcggggtcgtacggggtaacgaaggtacggtacaccgtacttaccgacctaacgtcgaagtaccgaacgtcccgtacggtaccgaccggttataaccggaaacgtttagttttaccgaccggtttaatttttaaacgtttagtttaccgtttaacggacgtaccttaaagggtttaaacttaaaaacgtttaaccgggttacggttaaccccgttaccggggtttaacgggtaacccgggttttcggggtaaccctaaaaccgggggttaaacccggttaaacccggggtaagggttaaaacggtaaaccccggtttaaaaaccggtaaaaccccgggttttaaagggtaccgggttaaccgtacccgggtttaaacccgaacccggttaacccggtttaaaccgtttacccggttttacccggttaaccgtttaacccgggttttaaaccccccg

SEQ ID NO: 185439 - DNA, 670 bp, Homo sapiens
  misc_feature: GYAE6OF02F940T.14.23.C01.1.454.CMB.1.raw
  modified_base (204)..(204): a, c, t, g, unknown or other
  misc_feature (204)..(204): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctcgtcctgcgagggccagtcagagtgttagagcaacttgcctggtaccagcagaacctggccaggctcccagctccncatctatggtncactccaccagggccctatggtcgtcccagccaggttcagtcggcaggtcggtctagggacagtacgttcactcctcgaacctacgtcacgacagtcctagctagtcctagtaatgttttgcttaggtttattagtttcgtacgtagtacctaaggttaactaaagttaaacgttcggtacccgttaccggttcgggttacccggtttaccgggacccggtaaacggggaaccgtaacgggttaacgggtaaaaccttaccgggtaaaaacggtaacccggttacggggttaagggtaccgtttaccggggaaccttaacccggtaactttcccgggtttaccgtttacccggtttaccttaaccccgg

SEQ ID NO: 185440 - DNA, 774 bp, Homo sapiens
  misc_feature: GYAE6OF02GWHUB.14.23.C01.1.454.CMB.1.raw
  modified_base (208)..(208): a, c, t, g, unknown or other
  misc_feature (208)..(208): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtctccagccaccctgtctgtgtctaccgaagggggaaanacgcccaccctctcctgcgacgggccagtcaagtagtgttaagaagctaaacttagcctaggtaaccagacgaacgaaacctgggacccaacggcctaccccgaggccttcctacaagttctagtgggtacaccactaccccgaaccgtacgggccctaacgttgggtaccgtaccccgaaggtccccgtaagggttacagggtacggcgtagggttcgggtcgtacggggaactaggtaccgtttaccaaccttacctaccgtaaccgtaactccgaagacccgtaacggtccctaggaccgtacggttacgttaaggtaaacgtttagtttttcggtaacgtttaagtttttaaactttaacgtttacgtaaccgaagttaaaccgtaagtttaaactaaaacgttaaccggttcgtacccggttaccggttacgggtacccggttaaccgggaaccgtaaaaacggggaccgtaaaggggttacggtaaaacgtaaccgaaaacggtaacggtgtaacgtaccgtagtaacccacttacgtcgtttacgtaccttacgtaccg

SEQ ID NO: 185441 - DNA, 766 bp, Homo sapiens
  misc_feature: GYAE6OF02JQIFT.14.23.C01.1.454.CMB.1.raw
  modified_base (124)..(124): a, c, t, g, unknown or other
  misc_feature (124)..(124): n is a, c, g, or t
  modified_base (158)..(158): a, c, t, g, unknown or other
  misc_feature (158)..(158): n is a, c, g, or t
tcagcgtctagtaccacgaccggtgctcgatttagtacacgtgattagggattgggggagggaacgtgctcagttaggacccagacggaaccatggaagcccagcgcagcttctcttcctcctnctactctggctccagataccactggagaatagtnatgagcagtctccagccacctgtctgtcgtctcaaggggaacgagccctaccctctcctgccaggccagtcagacgtgtagaacgctaacgttagcctggtacacgacaacgaaaccgtgggacctaacggccctacccgaggtacctccctctaacgtaccttagtacggggtcacacctacccgtacgaacggggtccctacgtcgggtaccttacccccgaggtaccgtacgggtttaccaaggggtcgggaccccgttaaggggtttcgggtaccggtaacggggtaacctaacggggttacttcccgtaaaccgtttcgtaaaccccgaccctaaaggttccgaacgtacccggacgtcctaacggcgtacgttcgtaagtaacggtttatttccgtacgttaaggttttaactttacgttacgtccgttaacgtacgtaagttaactttaaagtaacccgttcgggttcccttaccggggttagttacccggtaccggtaccggtaaacggtccggttaaacgggtgtaaccgtaacgtaaccggtaaggtgtaccggtacgttacgaccgtactcgtaaccgtttcgtaccttaacccgtc

SEQ ID NO: 185442 - DNA, 695 bp, Homo sapiens
  misc_feature: GYAE6OF02GKZPB.14.23.C01.1.454.CMB.1.raw
  modified_base (204)..(204): a, c, t, g, unknown or other
  misc_feature (204)..(204): n is a, c, g, or t
tcagcgtctagtaccacgaccggtgctcgatttagtacacgtgattagggattggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaancgccgccctctcctgcagggccagtcagtagtgttaagaacgcaacttagcctaggtaccagcaacgaaaccgtggaccagctcccaggctcctcatctagtggtgcactcccaccggagggccacgtggtacgtcccgacgtcctaggttcacggtcggacgagggttcgggtacgtacggggactaacggtacgttaccacgttactaccgaacccgtactaccgacggtcccaacggtcccgtgaccgtagttaccggtaagtaaacggttacgtttttacggactttaaggttttaactttagtttcgtacgtagtactaagtttaacgtaaacttaccggttcgtacccgttccggttagggtacccggttaccggaccggtaaacgggacgtaagggttacgaaacgtacggtaaaccggtaggttacggtaccggtacgtacgaccgtaaccgttcgttaaccgttcgtttaccgtcttacccg

SEQ ID NO: 185443 - DNA, 837 bp, Homo sapiens
  misc_feature: GYAE6OF02IXLVY.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccacctgtctgtgtctccgaggggaaagacgcccaccctctcctgcgacgggccagtcagtagtgtagaagctaacttagcctaggtaccagacaagaacctggaccaggcctccgaggcctccgtacacttactagtggtcacactaccacgacgggccctacgtgggtcctcccgacgccgtacgggttcgaggtcggaccgtagggttcggggtcgtaggggactacggtacggttaccacgttaccgtaccacctagtaccgtacgacgtacggtcctacgacgtacggttacgtaagggtaaacgtttacgttttacgaccggttttaagtttttacgtttacgtttacgtaccgtaaacgttacgttaaagtttaaacgttaaacgttaaccgggttccgggttaacccggtttaccgggtttaccggggttaacccgggttttaaccccggggaaaccgggtttaaaacccggggggtaaaaccccggtttaaaaggggggtttaacccgggttaaaaacgtaaaccccgggttaaaaacccgggttaacgggttttaaccgggacccggggttttaccgaacccgggttaacccttaaacccgggtaactttcccgggttaaccggttttcccggttaaccttaacccccggg

SEQ ID NO: 185444 - DNA, 731 bp, Homo sapiens
  misc_feature: GYAE6OF02IW65W.14.23.C01.1.454.CMB.1.raw
  modified_base (205)..(205): a, c, t, g, unknown or other
  misc_feature (205)..(205): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgagggggaaangcccaccctctcctgcagggccagtcagagtgttagaagcaattagcctggtaccagcaagaaacctggaccaggcctccaggcctccatatctatcggtgcactcccacgacgggcccacgttgggtaccgtccccaaggcccgtaggtttacgagggttcggacctagggtcggggttctcggggaactaggtagtttccacgttcctacgaacccagttacaagccgaacgtccctaggactacggttccagtaaacgttcgtttttacggacgttttaacgttttaagtttacgttcgttacgtaacgtactaaacggttaacttaaaagttaacccgttcgggtaccctttaccggggtacgggttacccgtttaccggggaaccgtaaaacgggggtaacccgttaaagggggtaccgtaaaacttacccgggaaaaaacgttaaccggttagggtacggtaaccgtttacggaacccacccgttacgtaccgtttacggtttacccttccgttaacccg

SEQ ID NO: 185445 - DNA, 845 bp, Homo sapiens
  misc_feature: GYAE6OF02H41D7.14.23.C01.1.454.CMB.1.raw
  modified_base (204)..(204): a, c, t, g, unknown or other
  misc_feature (204)..(204): n is a, c, g, or t
  modified_base (318)..(318): a, c, t, g, unknown or other
  misc_feature (318)..(318): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatggacgcagtctccagccacctgtctgtgtctccgaggggaaancgcccaccctctccgtgccgagggcctagtcaggagttgttaaggaacgctaacttcggcctacgggtaaccagaccaggaaacctcggaccaggcctaccgacggtcctcctnacttccgtaagttggtcgaccgtacgtaccccgaaccggacgggacccctacggttcgggttacccggtacccgaacgggtacccgtaacggggttaccgtaacgggttcggaccggttaggggtttcgggggttaccggtaggggaacccgttaagggttaacgtttcccgaaccgtttcccgtaaccaaccgtactttacggaaccgtaccgacgtacccgttggaaccgttaacgttaccggttaaggttaacgtttaaggtttcgtaacgtttttaacgttttaagtttacgttacggtaccttaagtaacgtttaacgtttaaacgtttaaaccggtaaccggtttcgggtaaccccgttttacggggtaccggggttttaccgggttaacccggggaaaccggtaaacgggggtaaccggtaaacgggtaacggtaaacgttaaccggaaacgggttacgtcgggttacgaccgttacgaccgttacgtacctttcgtttacgttacctaccgttaacccg

SEQ ID NO: 185446 - DNA, 742 bp, Homo sapiens
  misc_feature: GYAE6OF02H42D7.14.23.C01.1.454.CMB.1.raw
  modified_base (339)..(339): a, c, t, g, unknown or other
  misc_feature (339)..(339): n is a, c, g, or t
tcagcgtctagtaccacgaccggtgctcgatttagtacacgtgattagggattgggggagaactgctcagttaggacccagacggaaccatggaagccccagcgcagcttctcttcctcctgctactctggcctcccagataccactggagaaatgtgatgaccgcagtctccagccctacctgtctgtcgtctaccggaagggaaacgcgccctaccctctcctgaccgagggccagtcagtgtgtaagacgactaacgttagccgtaggtaaccagacacgtaaaaccgcggaccgacgcctccgaacggtcctacctctacttacgtacgttggcnctacaccaccgaccggcacgtggtacgaccgtacgccgtaggtcaggtcggacgtaggtcgggtacgtcgggagaacggtcttacgtaccttcgtacctaccgagtaccgacgtaccacggtaccgtggtaccctaggttccgttaagggaaacgtttacgttttaggtaccgtttaagtttttaaagtttcgttacggtaacttaacggtagtttaaaacgttaaacttaaaaccggttccgtaccggttaccccggtttaaccggggtacgttacccggttaccgggtaacggaaaacccgggttacgttaaacgggaacggtaaacgtaaccgtaaaacggtacgtaggtaacggtcctaccggaactccgtaacgttcctcgttccgttattaccccgg

SEQ ID NO: 185447 - DNA, 695 bp, Homo sapiens
  misc_feature: GYAE6OF02IXQRU.14.23.C01.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (295)..(295): a, c, t, g, unknown or other
  misc_feature (295)..(295): n is a, c, g, or t
tcagcgtctagtaccacgaccggtgctcgatttagtacacgtgattagggattgggggaggaactgctcagttaggacccagacggaaccatggaagccccagcgcagcttctcttcctcctgcctactctggctccagataccactggagaaatagtgatgacgcagtctccagccaccctgtctgtgtctcgaggggaaancgccaccctntcctgcagggccagtcagagtgttaagaacgctaacttgcctaggtaccagcaagaacctggaccaggctcccgaggctccnctactctagtggtcgtcactcccgaccgacggggacctacgtggtcccgtcccgacgtaccgtaggttcaggtggacgtaggtcggggtcgtagggaacgtaggacgttacacctctccaaccgtactcgaacgaccgtacgtctacgacgtacggtcttagaacgttatttcggacgtttaagttttagtagtttgtacctagtactaagtaattaaacgttaaccgtccggtaccggttacccggtacgggttaccgttaccgggaaccggtaaacggtaacccgggtaagggttaccggtaaaacgttaaccgaaaacgggttaaccgttagggttacgggtacccgtacgaccgttaaccgtaccttttacgggaccgtttacctacgtttaaccc

SEQ ID NO: 185448 - DNA, 899 bp, Homo sapiens
  misc_feature: GYAE6OF02GGN41.14.23.C01.1.454.CMB.1.raw
  modified_base (204)..(204): a, c, t, g, unknown or other
  misc_feature (204)..(204): n is a, c, g, or t
  modified_base (283)..(283): a, c, t, g, unknown or other
  misc_feature (283)..(283): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagcccacctgtctgtgtcctcgaggggaaanacgtccaccctctccgtgccgacgggcccagtcgaggtagttgttaagaacgactaacgttacgccgttacggtaaccngacaacgaaccgtgggaccaaggtccctccccgaggtcctaccctacgacttaccgttagtcgggtacacctacgttaccccgaaccggtaacgggccctaacggtttcgggtacccgtacccgacgggtacccgttaagggttccgaagggttccggtacggtacggggttcggggttacccggtagggggtaaccgtaaggttaccgtttaccgtaccttacccgttacgaacccgtcgtaaccaccggtaccgaaccgtccgtagtacccgtaggtacgtaacgggttaattcgtttaacggtaccgttttaagtttttaacgtttacgttacgggttaactacgggtaccggtaaccggggggtaccggggttaacttaaccggggtttcccgggtacccggtttccgggtttaacccgggtttaacccgggggggttttcccggggaaacccgggggggtttaacccggttaagggggttaccgggtacggttttaaaccgggaaaaccgttcgggtttacggggttacggtacccgtttaacggggaccccttaaaccgtttcggttcccgtttaacgggttcccttttacggaccccttttacccccgg

SEQ ID NO: 185449 - DNA, 718 bp, Homo sapiens
  misc_feature: GYAE6OF02H8OJ4.14.23.C01.1.454.CMB.1.raw
  modified_base (208)..(208): a, c, t, g, unknown or other
  misc_feature (208)..(208): n is a, c, g, or t
  modified_base (218)..(218): a, c, t, g, unknown or other
  misc_feature (218)..(218): n is a, c, g, or t
  modified_base (264)..(264): a, c, t, g, unknown or other
  misc_feature (264)..(264): n is a, c, g, or t
  modified_base (317)..(317): a, c, t, g, unknown or other
  misc_feature (317)..(317): n is a, c, g, or t
tcagcgtctagtaccacgaccggtgctcgattttagtacacgtgattagggattgggggaggaactgctcagttaggacccagacggaaccatggaagccccagcgcagcttctcttcctcctgctactctggctcccagataccactggagaaattagtgatgacgcagtctccagcccaccctgtcctgtgtctccgaggggaaancgccacctcnctgcagggccagtcagagtgttagaagctaacttgcctggtaaccngacaagaaacctggaccaggcctcccgaggccttcctacacttctagttcggncctaactcccgaccggacggccctacgtttcggtccgtacccctaggccccgttaagggttccgaggtcggcgtaagggttcggggcttacggggaactaggtacgtttccaacctttcaccgacctagtacccggagacgtacgtcccgtgtcgtacggtacgtttaggaaacgtttacgttttacgggactttaaggtttttaacttttacgtttcggtacttaagtccgtaaagtttaaagttaacgtaaccgttcgtacccgttcgggtacggttaccgttaccggaacgtaacgggaaccgtaaggtaccggtaaagtaccgtaaacgtacgttacggaccggttaccgttacggaccctaacgttccgttaccgttcgttttactccgttacccg

SEQ ID NO: 185450 - DNA, 849 bp, Homo sapiens
  misc_feature: GYAE6OF02IT4VN.14.23.C01.1.454.CMB.1.raw
  modified_base (202)..(202): a, c, t, g, unknown or other
  misc_feature (202)..(202): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccacctgtctgtcgtctccgagggaancgccaccctctccgtgcagggccagtcagtagtgttaagaacgtcaacgttacgcctaggtaccagccaacgtaaaccgtggacccaggcctaccccgaggtccttacccgtctaacgttcctaaggtcgggttacgaccgtactcccgaccggtacgggtcccctaaggttcgggtccgttaccccgaggtcccgtaaggtttaccgaggttacggaccgtaagggtttccgggggttaccgtaggggtaaccgtagggtttaccggttactaacccgtttccgtaccgtaacccgttacgttacccgacggtacccggtaaccggtacccgtacgggtacccgtaacgggtttaccgttaacgggtaaacggtttaccgtttttacgggaccgtttaacgggttttttaacgtttacggtttacggttaccgtaacggtaccgttaaagttaacgttaaacgtttaaccgttccgggttacccgtttaccgggtacgggttaacccggtttaccggaaccggtaaaaccggggtaccgtaacggggtacggtaaaaccgttaccggaaaaccggtaacgttcgggtaaccggaccggttacgaaccgtaccggtacttccggttacgtttaccgttactaacccg

SEQ ID NO: 185451 - DNA, 634 bp, Homo sapiens
  misc_feature: GYAE6OF02JGS1K.14.23.C01.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (293)..(293): a, c, t, g, unknown or other
  misc_feature (293)..(293): n is a, c, g, or t
  modified_base (304)..(304): a, c, t, g, unknown or other
  misc_feature (304)..(304): n is a, c, g, or t
  modified_base (403)..(403): a, c, t, g, unknown or other
  misc_feature (403)..(403): n is a, c, g, or t
  modified_base (417)..(417): a, c, t, g, unknown or other
  misc_feature (417)..(417): n is a, c, g, or t
  modified_base (465)..(465): a, c, t, g, unknown or other
  misc_feature (465)..(465): n is a, c, g, or t
tcagcgtctagtaccacgaccggtgctcgatttagtacacgtgattagggagttgggggaggaactgctcagttaggacccagacggaaccatggaagccccagcgcagcttctcttcctcctgctactctggctcccagataccactggagaaatagtgatgacgcagtctccagccacctgtctggtcgtctccgaggggaaancgccacctntcctgcacgggccaggtccagcgtgttagaagcaagttagcctaggtaccagcagaacgtgcaggctccaggcttccncatctatggtncactccacgtagggcctacgttggtacgtcccaggcctagggttccagtcggctaggttcgggtctggggtacaggtacttcgacctttcgcaaccgtncgtacgcgacgtcncggctacgtcgttaacgaaggttacttttcgacgtttagttttaactntttcggaacacgtacggtattaaactaaacgtaacgtggtacccgtaggtagtaccggttacgaccgtaaagggtacccgtaagggttacggaaacttaaccgaaacggttaacctaggtccggtacgtacgtaccctacgaacgttccgtcggttactttccaaccgg

SEQ ID NO: 185452 - DNA, 664 bp, Homo sapiens
  misc_feature: GYAE6OF02GX6OT.14.23.C01.1.454.CMB.1.raw
  modified_base (542)..(542): a, c, t, g, unknown or other
  misc_feature (542)..(542): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagactaccactggagaaatagtgatgacgcagtctccagccaccctgtctgtcgtctccgaggggaaagcgcccaccctctcctgcgacgggccagtcagtagtgttaagagactaactagcctaggtacagcaacgaacctcggaccacggcctcccgaggccctcctacactcgtagtggtcacctactacccgaccggaaccgggaccctaccggttcggtcccgtacccgtacggcccgttaacgggttacgaggtcggacgtacgggttcggggtccggtaggggaactacggtacgttactaccgttcctacccgaactactacgacgtccgacgtccgtacgaccgtaggttactaagtaacgttcgttttacgactttagtttactttagttcgtanagtactaagttataacgtacgtcgtaccgtcggtacggtacgtaccggaccgaaggtaccgaagtacgaactaacggaacgtacgtaggcgtacgtacgacctacgtatcgtactctactcc

SEQ ID NO: 185453 - DNA, 844 bp, Homo sapiens
  misc_feature: GYAE6OF02FLNRU.14.23.C01.1.454.CMB.1.raw
  modified_base (202)..(202): a, c, t, g, unknown or other
  misc_feature (202)..(202): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctcgaggggaanacgccaccctctcctgcgagggccagtcagagtgtagagcaacttagcctggtaccagcaacgaacctggccacggcctcccgaggccttccctctatctagtggtcgctactcccgaccgacggggccacgttcggtccgtcccgacgtaccgtacggttcgaggttcggacgtacgggttcggggtccgtaggggaaccaggtaacgtttaccacgtttaccctccaaccccgtatacccgaaacgccgtaaccggtccccgttagacccgttaacggttaccgttaagggtaaacgttttaaccgtttttacggtaccgttttaaaggtttttttaagtttaacgtttttacgggttaaccgtaacggttaccgtttaaaacggttttaaacttaaaacggtttaaaccggttccgggttaccccgtttaccgggggtttaccgggttaaacccgggttttaaccccgggaaccggtaaaccgggggtaaacccgtaaaggggttaaacgggtaaaaccgtaacccggttaaaaaccgggtaaccggttacggggttaaccgggtaccgtaacggtaaccccgttaaccgtaaaccggttttcccttacccggttttacccgtttacccgtttaacccg

SEQ ID NO: 185454 - DNA, 728 bp, Homo sapiens
  misc_feature: GYAE6OF02H0T1U.14.23.C01.1.454.CMB.1.raw
  modified_base (206)..(206): a, c, t, g, unknown or other
  misc_feature (206)..(206): n is a, c, g, or t
  modified_base (314)..(314): a, c, t, g, unknown or other
  misc_feature (314)..(314): n is a, c, g, or t
  modified_base (329)..(329): a, c, t, g, unknown or other
  misc_feature (329)..(329): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggcctcccagataccactggagaaatagtgatgacgcagtctccagccaccctgtctgtgtctccgaaggggaaancgcccaccctctcctgcagggccaggtcaggagtgttaagaacgctaacgttacgccttaggtaaccagccgaagaaacctggaccgaggcctacccaggccctcctnactctaagtggtacncaactcccgaaccgtacggcccagtacggtccgtacccgaggtcccgaggtttcgaggttacggccgtagggttcggggtacgtacggggaacgtaggtaacgtttccgactttacccgtaccgaactacgtcgaacgtacgtacgtccgtacgacgtagtacgtagtaacgttagtttacgtacttacgtttaatttagttagtacgtacgtacgtaagttaaacttaaacgttaacgtacggtaccgttaccggttacggtaaccggtttacggaaccggtaaacgggtaaccggtaagggtaacgtaaacgtaacggaaacggtaaccggttacggtaacgtaccgtacggtaacctaacccgtacgtttaccggtacgttacgttacgttaaccg

SEQ ID NO: 185455 - DNA, 732 bp, Homo sapiens
  misc_feature: GYAE6OF02IY5HZ.14.23.C01.1.454.CMB.1.raw
  modified_base (215)..(215): a, c, t, g, unknown or other
  misc_feature (215)..(215): n is a, c, g, or t
  modified_base (231)..(231): a, c, t, g, unknown or other
  misc_feature (231)..(231): n is a, c, g, or t
  modified_base (248)..(248): a, c, t, g, unknown or other
  misc_feature (248)..(248): n is a, c, g, or t
  modified_base (257)..(257): a, c, t, g, unknown or other
  misc_feature (257)..(257): n is a, c, g, or t
  modified_base (289)..(289): a, c, t, g, unknown or other
  misc_feature (289)..(289): n is a, c, g, or t
  modified_base (460)..(460): a, c, t, g, unknown or other
  misc_feature (460)..(460): n is a, c, g, or t
  modified_base (515)..(515): a, c, t, g, unknown or other
  misc_feature (515)..(515): n is a, c, g, or t
  modified_base (724)..(724): a, c, t, g, unknown or other
  misc_feature (724)..(724): n is a, c, g, or t
tcagcgtctagtaccacgaccggtgctcgatttagtacacgtgattagggattgggggaggaactgctcagttaggacccagacggaccatggaagccccagcgcagcttctcttcctcctgctactctggcctcccagtactaccactggaacgaaatagtagatggaccgcagtcctccacgcccaccctgtctgtcgtcaccgaggggaacncgcccacccttctccngcgacgggctagtcagnttgtaaganctaacttcgcctacgtaccagccaaggaaccnggccagggccctaccgaggtcctcctcacttcgtagtcgggtctcaacgtcccgaccgggacggtcctactcgggttcccacccgtagaccggtacggttcgaacggtttcgacggtaggttcggtacggtacgggaacttggtaccgttcacccgtactcccgaaacctntaaccgacgtacctaccggtaccgtcgtacctagggttaactaggttaacggttnttttacggtactttaagtttactttagtacgttacgtacgtacgtaagttaacctaacgttaccgtaggttaccctttacgggtccgggtaccgtttaaccgggaccgtaaaacggggttaccgtaagggacgttaaacgtaaacccgaaggtttaacgccgggttaaccgttcgaccgtaccacggttactacgggttcttacccgtnttaacccg

SEQ ID NO: 185456 - DNA, 673 bp, Homo sapiens
  misc_feature: GYAE6OF02F1A10.14.23.C01.1.454.CMB.1.raw
  modified_base (205)..(205): a, c, t, g, unknown or other
  misc_feature (205)..(205): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtctccagccaccctgtctgtgtctccgaggggaaangccacctctcctgcagggccagtcagtagtgttagaagtcaaacttagcctggtaccagtcagaaactggaccaaggccttcccgagctcctcatctatggtgcactccacgagggccacgtggctccagtccaggttcagtcggacaggtcggtcgtgggacaggtatactacgtctacgacctatacacgcacgcctcggaccctagttctaggtaaacttattttcgacttaaggttttaacttacgtttcgttaacctaggtacttaacgtaacttaaacgttaaaccgtcgtacccgtttaccggtacgggttaaccgtttacccgggaccgtaaacggggtaaccgtaaacggggttcggtaaaaacgtaccgtaaaaccgggtaacgttacgggttaccggtacggtaaccggtacccgaacgttaaccgtaccggtttcgttaaccgttccgttaaaccc

SEQ ID NO: 185457 - DNA, 745 bp, Homo sapiens
  misc_feature: GYAE6OF02IYR0S.14.23.C01.1.454.CMB.1.raw
  modified_base (210)..(210): a, c, t, g, unknown or other
  misc_feature (210)..(210): n is a, c, g, or t
  modified_base (256)..(256): a, c, t, g, unknown or other
  misc_feature (256)..(256): n is a, c, g, or t
  modified_base (327)..(327): a, c, t, g, unknown or other
  misc_feature (327)..(327): n is a, c, g, or t
  modified_base (446)..(446): a, c, t, g, unknown or other
  misc_feature (446)..(446): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctccagataccactggagaaatagtgatggacgcagtcctaccagcccaccctgtctgtcgtctaccgagggggaaanacgcccaaccctctccgtgcgagggcctagtcaggagtgttagaanctaatgcctggtaccagacacgtaaaccgtggaccaggcctccgagctcctcatcgtagtggtcgcctacncccgaccgcgggccagtcggtccgtaccacgacccgtggttcaggttcggcgtacggggtcgggtttacggagggtaacacggtacgttaccgcttaccgaccaaaccctggtacccgnggaccctcgtccgtaagccttacggtacgtaggttaaacttattttcggaaggttttaattagttttaacgttccggtattaacggacgtaaagtttaactaaaacgggttcgttccggaccccgtttacggggttacggtaacccgggttaccgggtaaaccggaaaccggggggtaacgttaaacggggacggttaaaaacgttaccggtaaaaccggtaaccgggttagggtaccccgtagggttaccaccccgtaacgttaacgtcccttttacggtttcctaacgggtttaccc

SEQ ID NO: 185458 - DNA, 602 bp, Homo sapiens
  misc_feature: GYAE6OF02H40V8.14.23.C01.1.454.CMB.1.raw
  modified_base (204)..(204): a, c, t, g, unknown or other
  misc_feature (204)..(204): n is a, c, g, or t
  modified_base (438)..(438): a, c, t, g, unknown or other
  misc_feature (438)..(438): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgcccaccctctcctgcagggccagtcagagtagttaagaagcaacttgcctggtaccagcagaaacctggccaggcctccaggctcctcaatctatggtcgactactcccacgtacgggccctagtggtacgtacccacgccgtaaggttcaggtcggacgagggttcggtcgtagggacaggtacgttcacgtctacaacgatacagcagcctgactagtctagaacgttnttttcgacgtttaatttagttatacgtagataacagttaaacttaatacgtcggtacctcgggtacgtacgttccgaacgtaaagggtacctaaggtacgaaactcgaaaacggtacgtggtaacggcttacgacgtaaccttgtccttagttccctataaccg

SEQ ID NO: 185459 - DNA, 840 bp, Homo sapiens
  misc_feature: GYAE6OF02I9DT3.14.23.C01.1.454.CMB.1.raw
  modified_base (209)..(209): a, c, t, g, unknown or other
  misc_feature (209)..(209): n is a, c, g, or t
tcagcgtctagtaccacgaccggtgctcgatttagtacacgtgattagggattggggggagggaactgctcagttaggacccagacggaaccatggaagccccagcgcagcttctcttcctcctgctactctggctcccagataccactggagaaatagtgattgacgcagtctaccagccaccctgtctgtcgtctccgaaggggaanacggcccacctctcctgcgacgggccagttcgagtacgttagttaacgacgtactaacgttacggccgttagggtaacccagtaccgtaaacgtaaaccgtcgggtaccgacggccgttaccccgaacgggcccttcccgtacgtacgttaaccttaggttcgggggttacgacccgtaacgttacccccggaaccgggtaaccgggggaccccctaacgggtttccggggttccgtaacccccggaacgggttaccccggttaaggggttccgttaacggggtccggttacggtaggggtttaacggggtccgttaagggggaaccgttaacggttacgtttaccggtaccctttaccggtccctaaacggtactaccgaacgacgtacgtaccgtacggtaccgtaacggttcgtaaagggtaacgtttagtttacgttacgttaagttttaattacgtttagtacgtacgtaacaggttaataacggtacgttcggtcgttaccggtacggtacgttaccgaacgtaacggtaacgtagggtacgttaacgtaacggtaacgtaacgttcggtacggtacgtacgtacccgttaaccgtagttaccgtttacggtaccttagtacccg

SEQ ID NO: 185460 - DNA, 935 bp, Homo sapiens
  misc_feature: GYAE6OF02HKXO5.14.23.C01.1.454.CMB.1.raw
  modified_base (219)..(219): a, c, t, g, unknown or other
  misc_feature (219)..(219): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtctccagcccaccctgtctgtgtctccgaggggaaagacgcccacccttntcctgcgagggccagtcagagtgttaagaagcaacttagccgtagtaccagcaagaaacctggccaggctccgaggctctcatctagtggtgactactaccaccgtacggggccctacggtcgggttcgtaccccgacggtacccgtacgggttaccgtagggttacgggtaccggtaaggggtttcggggggttccgttaacggggggggaacctaacggggttaacggtttacccgtaaccgtttacccgtcccgtaaaccccgtaacgttaccgaaccggtacccgtaacggtacccgtttcgggaacgttaaccgggttaccgtttaacgggtaaacggttttaacgtttttacggtacgttttaacggttttttaaatttttacgttttagggtaccttaaacgggtacgtaaacggttttaaaactttaaaccgttaaaacccgggttttccggtaaccccgggttttacccggggttaaccggggtttaaccggggtttacccgggtaaacccgggttaaaccgggggaaaccgttaaacgggggtttaaccgggtaaaaaggtttaaacccccggtaaaaaaccgggtttaaaccgggtttaaccgggggttaaccggttacccggttaaccggtaacccccggttaaaccgttacggtttaaccccggtttaccggttttaccccgttttacccgtttaaccccggg

SEQ ID NO: 185461 - DNA, 597 bp, Homo sapiens
  misc_feature: GYAE6OF02G54TR.14.23.C01.1.454.CMB.1.raw
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
  modified_base (237)..(237): a, c, t, g, unknown or other
  misc_feature (237)..(237): n is a, c, g, or t
  modified_base (300)..(300): a, c, t, g, unknown or other
  misc_feature (300)..(300): n is a, c, g, or t
  modified_base (313)..(313): a, c, t, g, unknown or other
  misc_feature (313)..(313): n is a, c, g, or t
  modified_base (322)..(322): a, c, t, g, unknown or other
  misc_feature (322)..(322): n is a, c, g, or t
  modified_base (361)..(361): a, c, t, g, unknown or other
  misc_feature (361)..(361): n is a, c, g, or t
  modified_base (469)..(469): a, c, t, g, unknown or other
  misc_feature (469)..(469): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtctccagccaccctgtctgtgtctccgaggggaaanacgccaccctctcctgcgacgggccngtcagngtgttaagagctaactcgactaggtaccagacagaaacctggaccagcctccgagtcctcctntactctagtgtcnctactaccncggtacggctacgtggtcctccacgaccgtacggtacgnggtcgcgtaggtgggtcgtaggacgtagtcgttcacgtcaccactactacacgactacgtctagcctagtcagtagttacttgacttagttattacgtgtcgtaagtntaagttactaaacgttacgtacgtccgtaggttccggtacgttaccggacggtaacggacgtaaggtacgaacgtacgtaaaccgtaggtcgtagtcctagacctactacgcttcttactaccttccg

SEQ ID NO: 185462 - DNA, 670 bp, Homo sapiens
  misc_feature: GYAE6OF02H5GI2.14.23.C01.1.454.CMB.1.raw
  modified_base (203)..(203): a, c, t, g, unknown or other
  misc_feature (203)..(203): n is a, c, g, or t
  modified_base (433)..(433): a, c, t, g, unknown or other
  misc_feature (433)..(433): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaanacgccaccctctcctgcgagggccagtcagagttgttaagaacgactaacgttagcctaggtaccagcaggaaacctggaccacggctcccaggcctcctcatctagtggtcgcatcccgaccgacgggccctacgtcggtaccgtcccaggtaccgtagggttcacggtggaccggtagggttcgggtcgtcggggaacgacggtagttccaccttcctaccgaacctntacgacgtcgacgtcctcgacgtacgttacgtagtaagttagttttcgacgtttagttttatttaagtttgtacgtacgtactaagttaaattaagttaccgttcggtacccgttcggtacgggttaccggttcggaccggtaaacgggacgttaacgggtaacgtaacgtaccggaaaacggtccggtaggcgtacgccctaacttcgtacttcgttaccttacgtacttaccccg

SEQ ID NO: 185463 - DNA, 708 bp, Homo sapiens
  misc_feature: GYAE6OF02FNO0J.14.23.C01.1.454.CMB.1.raw
  modified_base (151)..(151): a, c, t, g, unknown or other
  misc_feature (151)..(151): n is a, c, g, or t
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactgganaaatgtgatgacgcagtctccagccacctgtctgtgtctcgaggggaangccacctntcctgcaggccagtcagagtgtaagagcaacttagcctggtaccagcagaacctgccaggcctcccaggcctccgcatctatcggtgacactcccaaccgacgggcctacgtggttaccgtaccccgacggtccctaagggttccaagggtcggtacccgtagggttcggggttccgtagggggactagggtacgttacaccgttccgtaccaccctatccgaagccgtaacgtcccgtgacgtacgttcgtaggtaaacgttcgttttacgaccgtttaagttttacgtttagtttacggtactaagtcctaagttaattaccgttaacggttccgtaccgttccggttagggttaacccgttcggtaaaccggtaacgggaaccgtaacgggttacgaaacgttaaccggtaaaaccggtaaccgttacgggtaccggttaccgtacggtaacccgaaccgttacgtttaacgtcgtttaccgttacctttaccccgg

SEQ ID NO: 185464 - DNA, 725 bp, Homo sapiens
  misc_feature: GYAE6OF02FQX95.14.23.C01.1.454.CMB.1.raw
  modified_base (204)..(204): a, c, t, g, unknown or other
  misc_feature (204)..(204): n is a, c, g, or t
  modified_base (321)..(321): a, c, t, g, unknown or other
  misc_feature (321)..(321): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcgacgggccagtcagagtgttagaagcaacttagcctggtaccaggcaacgaaaccgtggaccagggcctcccgagggtcctcctcagtcttagtggggtcnctactcccgaaccgacggggcccctagtcgggttcctccccgaggcccgtaggtttcaacgggtcggacgtacgggtttcggggtacgagggggaacagggttacgtcctaccgtctaccactactcgagtccgaacgcccttaggacgttccgtaggtaaacgtttatttcggactttaagggtttttacttaacgttggttacctaaggccggtagggtccgggtaactaaggtttccgggcccgttagtaccggttaccggtttccggggggacccgggggttaaaccgtaagggggttacggtaacggttaccgtaaaggtaccgttgggtaccggtacttcggacctaacgttcgttaccggtttcgttccctttacggtaccttccccttaccccggg

SEQ ID NO: 185465 - DNA, 202 bp, Homo sapiens
  misc_feature: GYAE6OF02I7MYX.14.23.C01.1.454.CMB.1.raw
  modified_base (155)..(155): a, c, t, g, unknown or other
  misc_feature (155)..(155): n is a, c, g, or t
  modified_base (166)..(166): a, c, t, g, unknown or other
  misc_feature (166)..(166): n is a, c, g, or t
  modified_base (168)..(169): a, c, t, g, unknown or other
  misc_feature (168)..(169): n is a, c, g, or t
  modified_base (171)..(171): a, c, t, g, unknown or other
  misc_feature (171)..(171): n is a, c, g, or t
  modified_base (174)..(175): a, c, t, g, unknown or other
  misc_feature (174)..(175): n is a, c, g, or t
  modified_base (177)..(177): a, c, t, g, unknown or other
  misc_feature (177)..(177): n is a, c, g, or t
  modified_base (179)..(202): a, c, t, g, unknown or other
  misc_feature (179)..(202): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctgctccagataccactggagaaatgngatgcgcatcncnncnctnntntnnnnnnnnnnnnnnnnnnnnnnnn

SEQ ID NO: 185466 - DNA, 689 bp, Homo sapiens
  misc_feature: GYAE6OF02FM1F1.14.23.C01.1.454.CMB.1.raw
  modified_base (201)..(201): a, c, t, g, unknown or other
  misc_feature (201)..(201): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgctgtgtctcgaggggaancgccacctctcctgcagggccagtcagtagtgttagagctaacgttagcctaggtaccaggtcaacggaaacccgtggcccacgggtcctccccgaggtcccttcctcctagtcctagttcggtacgccactaccccgaccgacggggccctacgtcgggtcgtacccacggcctaggttcgaggtcggtcaggttcgggtcgtacgggatacggtagttccactctcaaccgtatcgacgtcacgcctaggcctacgtctaacggtaattcgtttcgaacgtttagttttaacttagtttcgacgtcgtaagttaaacgttaattaaactacggttcggtcccgttacggttacggtacccgggttaacggaccggtaaaccgggtacgttaaacgggaacgttaaacgtaaccggtaaactaccgggttacggtacgggtacctacggacttaacgtccgttaggttccgttacttaccgttaccc

SEQ ID NO: 185467 - DNA, 763 bp, Homo sapiens
  misc_feature: GYAE6OF02H5VAE.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctctgctactctggctcccagataccactggagaaatgtgatgacgcagtctccacgcccacctgtctgtcgtcctacgaaggggaaacacgtccccaccttccgcctggccgtacgggccaagtaccaggtagttacggtaaagacgtacttaaccgttagcccttagggtaaccagaccgaaacggtaacctggacccgacgggtccctaccggacggtccctcctacgtaactcttacgtgcgtaccaccgtacccgaaccggtacggtcccgtaccgtttcggggaccctaccccgtaggtacccgtaccgggttctaacgggcggtaccggttagggtcgggggtacttacgggggaccgtaaggttaaccgttccctaaccgttacccgtacaaacccgttgaaccgacgtaaccgtccggtcccgtacgtacgaaccgttgttaaacggttaagtttaccgtttgtaacgtttaactttagtttacttgtaacgtgtaactaagtaacttaacgtaaccgtcgtaccgttagtcggtacgttccggaaacgaggaaccggttagaaccgtaagaaccgtcggtaactcggcgtaccagaacccgtacgttaccttccgttgttacccttcctaacccgg

SEQ ID NO: 185468 - DNA, 899 bp, Homo sapiens
  misc_feature: GYAE6OF02F9Z91.14.23.C01.1.454.CMB.1.raw
  modified_base (145)..(145): a, c, t, g, unknown or other
  misc_feature (145)..(145): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccnctggaagaaatagtgatgacgcagtctccagccaccctgtctgtcgtcctccgaaggggaaagcgccctaccctctcctggacgacgggccagtcaagtaggttagttaaggaacgtcctaaacttcggccttacgggtaacccaagccgaaaccggtaaaccgtggacccaacggtcctaccccgacggtccctcctactacgttacctagtcgggtcacctacttaccccgaaccggtaccggggaccctaccggttgggttcccgtaccccgacggtccccggttaaggttccgaacgggggttacggtacggtacgggggttccgggttacggacggggtaaacgtacggttaacggtttacctaaccgtcccttacccgaaacccgtcgtaccggaacgtcccgtacggtacccggtacggtacggttacgttaccgttaaggggttaatttacgttttacgtaccgttttaaaggttttttctttaaccggttttcgaccttaacggttaaccgtttaaagttaaacgttaaacgttaaccgggttacgttaccccggtaagggtttacccgggttaaccgggttaacccgggtaaaccgggtaaaccggggtaaaccggggttaaggttaaaccggtaaaacggttaaaccgtaaaccggttacgggttaacggtcggtaccggttaacccgttaccggtaaccttaaccgtttccggttaacgttttacccgtaggttttcccccg

SEQ ID NO: 185469 - DNA, 742 bp, Homo sapiens
  misc_feature: GYAE6OF02F7U84.14.23.C01.1.454.CMB.1.raw
  modified_base (152)..(152): a, c, t, g, unknown or other
  misc_feature (152)..(152): n is a, c, g, or t
  modified_base (205)..(205): a, c, t, g, unknown or other
  misc_feature (205)..(205): n is a, c, g, or t
tcagcgtctagtaccacgaccggtgctcgatttagtacacgtgattagggattggggggaggaactgctcagttaggacccagacggaaccatggaagccccagcgcagcttctcttcctcctgctactctggctcccagataccactgganaaatagtgatgacgcagtctccagcccacctgtctgtgtctccgaggggaaancgccaccctctcctgcagggccagtcaggagtgttagaagcaacttagccttggaccagccaacgtaaaccgtggccacgggtcctccccgagggtcctccctactacgttcttaagtgggttcactaacctcccaaccggtacgggcctacgtgggttccgtccccgaaggcccgtaaggttcgaggtcggaccgtggggttcggggttcgtaggggaactaggtacggtttccaaccgttccgtaacctaccctagttaccgacggtaccgaacggtccccgttaggaaccgtaacgttccggttaaggaaacggtttgttttacggccttttaaaggttttaatttgtttacgtaccgtagggtactaacgtttaataaaccgtacgttcggtcccgtttacgggtcgggttaaccgttccgggaaccgtaaacggggtacctaaagggggttacaaactaccggtaaaacgtacggtaggttaccggtatccggacctaaccggtacttccggtacgttcccttacttacccg

SEQ ID NO: 185470 - DNA, 923 bp, Homo sapiens
  misc_feature: GYAE6OF02ISMSH.14.23.C01.1.454.CMB.1.raw
  modified_base (209)..(209): a, c, t, g, unknown or other
  misc_feature (209)..(209): n is a, c, g, or t
tcagcgtctagtaccacgaccggtgctcgattttagtacacgtgattagggattgggggaggactgctcagttaggacccagacggaaccatggaagccccagcgcagcttctcttcctcctgctactctggctcccagactaccactggaagaaatagtgatgacgcagtctccagcccaccctgtctgttgtcctacgaaggggaanacgcccaccctctcctgcgaggccagtcagtaggttagttaagaacgtacctaacgttcgtccgtacggtaccgaacgaccgaaacggtaaacccgtcgggaccccgtaacggtaccccgtaccccgaacgggttcccttacccttaccgtactttacccgttaagttcggggtcgaaccgtaccgtaccccgaacccggacgggtccctaccggttacgggtcccgttaccccgacgggtaccccggttaacgggtttacgaacggggtcggtacgttacggggttacggggttacggtacgggtaaacgtacggttaccgttaccgtaccttacctaaccccgaccgtacgtaccgaacgaccgtaccggtacccgtggaacccgttaggttaccgtaacgggtttaaacgtttacggttttacgtaacgttttaagtttttaacgtttcgtttaccggtattaacggttaaacgtaaacgtttaaattaaccggttaaccggttcccggtacccgttttacgggtacggtttaaccgggttttacgggtaaccccggaaccggggttaacgggttaaaccgggttaaggttaaaaccggttaaccgtaaaaccggttaaaacggttaaccggggttcccggttaacgggtacccttaacgaccccggtttaaacgtccggttttaacccgtttggttaccctttaaccggg

SEQ ID NO: 185471 - DNA, 819 bp, Homo sapiens
  misc_feature: GYAE6OF02I2FKX.14.23.C01.1.454.CMB.1.raw
  modified_base (113)..(113): a, c, t, g, unknown or other
  misc_feature (113)..(113): n is a, c, g, or t
  modified_base (152)..(152): a, c, t, g, unknown or other
  misc_feature (152)..(152): n is a, c, g, or t
  modified_base (166)..(166): a, c, t, g, unknown or other
  misc_feature (166)..(166): n is a, c, g, or t
  modified_base (219)..(219): a, c, t, g, unknown or other
  misc_feature (219)..(219): n is a, c, g, or t
  modified_base (399)..(399): a, c, t, g, unknown or other
  misc_feature (399)..(399): n is a, c, g, or t
tcagcgtctagtaccacgaccggtgctcgatttagtacacgtgattagggattgggggaggaactgctcagttaggacccagacggaaccatggaagccccagcgcagcttcncgttcctcctgcttactctggcctccagataccatgganaaatgtgatgacgnacgtcctcgacgccaccttggtcctaggtcgtaccttacggaggggaaacacncccgtacccttccgtccgttcggaaccgacggggtaccctggttaccaagggtactttgggttaaacgaaccggtccttaaaacgtttccggccttaagggtacccgaacggttaccaaacggtaacccgtggacccgtacgggaccctccggaacggtccttacctctacgtcgttagngggttcacgtaccttacccgaaccggtcggacccgtacgttcgttaccgcccgaggtaccggtagttccgaggtaccgcggtacggttcggtacgtagggactacggtctacacgttcactaaccgtgtacgacgtacgacctcggtcgtacgtaccgttagtacgtaacgttactttaccgaacggtttacgtttaagttttcgtacgttacgtagtaacgtagtaaacgttacgaccgggtttaccgttaccgtaccggttaccggtaaccgggttaaccgtccgggttaaaacggaccgggttaaacgggttaccgtaaacggtaccgttaaaaccgggttcgtacggttaacgtaccgggttacaccggtttacccgaaacggtttcgtttaacgttaccgttacgttaaccccgg

SEQ ID NO: 185472 - DNA, 714 bp, Homo sapiens
  misc_feature: GYAE6OF02G0MHN.14.23.C01.1.454.CMB.1.raw
  modified_base (203)..(203): a, c, t, g, unknown or other
  misc_feature (203)..(203): n is a, c, g, or t
tcagcgtctagtaccacgaccggtgctcgatttagtacacgtgattagggattgggggagaactgctcagttaggacccagacggaaccatggaagccccagcgcagcttctcttcctcctgctactctggctcccagataccactggagaaatagtgatgacgcagtctccagccacctgtctgtgtcgtccgaagggaagngcccacctctcctgcagggccagtcagagtagtagaagtctaaacttagccctaggtaacctagacctaagaacccgtggaccgaggcctcccgaggtcctccgtacaagttcctaagtcggtcgacctacgtcccaaccggacggtccacgtttgggaccgtccccgtacgtcccgtaaggtttccaggtcggagacgggtttcgggtaccgtgggaactaagggttacgttcgtaacctcgtaccaaccgtatacgacgaccgtacgaccttagaccgtagttccgtagtaaagttgttttacgacgttttaagtttaacgttagtttacgtagaacgtagtaacgttaagaacgttaacgtccggtaaccgtccgggttacgtacggttaacccgggtacgtaaaccgggtacgtaacgggttacggtaaacgtaaccgtaaacggtaacgtaacggtacggacgttacgaaccgtacctacgttacccgtagtttcctaccttaccg

SEQ ID NO: 185473 - DNA, 717 bp, Homo sapiens
  misc_feature: GYAE6OF02G8N1U.14.23.C01.1.454.CMB.1.raw
  modified_base (369)..(369): a, c, t, g, unknown or other
  misc_feature (369)..(369): n is a, c, g, or t
tcagcgtctagtaccacgaccggtgctcgatttagtacacgtgattagggatttggggaggaactgctcagttaggacccagacggaaccatggaagccccagcgcagcttctcttcctcctgctactctggctcccagataccactggaagaaatagtgatgacgcagtctccagccaccctgtctgtgtctaccgaagggaaagacgccaccctctcctgcgagggccagtcaagagtgtagaagactaacgtgcctggtaccagacaaagaaccgtggccagggcctacccgaggtcctccctacatctagtgtcacgtactcccaaccgacggaccacgttggcgtaccccaggcctaggttacnggtcggaccgtggtggtcgtgggactacgtagttaccacgttcaccgacctagtaccgaagaccgtaccggtcctcggtacctaggttcctaaggtaaacgtttacgtttacggtacctttaaagggttttaactttaggttttacgtaacgtaccggaattaaacgttaaagtaaaccgtttaacggtccggtacccgttcggttaacgggtaccgttccgaaaccggaaacgggttaacggtaaccgggtaagggtaaaaccgtaacggaaaacccgttaggttaacgtccggtacgaccggttaccaacgtaacttcccggtttacgttaccttacgttaacccg

SEQ ID NO: 185474 - DNA, 695 bp, Homo sapiens
  misc_feature: GYAE6OF02H5C9A.14.23.C01.1.454.CMB.1.raw
tcagcgtctagtaccacgaccggtgctcgatttagtacacgtgattagggatttggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaacacgcccaccctctcctgcagggccagtcagtagtgttagaagcaacgttgcctaggtaccagcagaaaccgtggccaacggcccctacggccgtcctctacgtactgtaggtggccaactccgacccgacgggaccgtaccgttacggtcggtacccacgtaccgacggttcgtacggtggtccggaggttcgggtcggtacgggacgtaaggtacgtttccgactcgtaccacctagtaccacgcgacgtacctgacctaggtctacggtaacgttatttcggtactttaaggtttactttaagtttccgtagaacgttactaagtaagtttaacgtaacgttcggacccgttaccggttcggttaccggtaccggttaccggaaagggtaaccgagggttaacggaacttaaccggtaacgtaaacggtgacgggtaccttaacggccctaacgtacgttaccgttaggtacccttctaacgttccccg

SEQ ID NO: 185475 - DNA, 705 bp, Homo sapiens
  misc_feature: GYAE6OF02I4VHW.14.23.C01.1.454.CMB.1.raw
  modified_base (164)..(164): a, c, t, g, unknown or other
  misc_feature (164)..(164): n is a, c, g, or t
  modified_base (263)..(263): a, c, t, g, unknown or other
  misc_feature (263)..(263): n is a, c, g, or t
  modified_base (293)..(293): a, c, t, g, unknown or other
  misc_feature (293)..(293): n is a, c, g, or t
  modified_base (305)..(305): a, c, t, g, unknown or other
  misc_feature (305)..(305): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaatagtgatgacncagtctccagccaccctgtctgtgtctccgaggggaaagcgccaccctcgtcctgcgagggccagtcagtagtgttacgaagcaacttagcctggtacngcaagaacctggccaggcctccaggctccncatctagtcgtncatcccgacgtacggcctacgtggtcctcccgacgtccgaaggttcacggtcggaccgtagggtcgggtctaggggacctaggtacgtttccactttaccgacctaccgtagtccacggtccacgcccgttagccgttacgtcggttacaacgtttagtttgaccgttaagtttttaattacgtttacggtaccgtagttaccgtaaacgttttaagtaaacggttaccgttccggtaccgtttccggtacgggttaaaccgggtttaccgggaacccgggtaaacggggtaaaccgttaaggggttacgaaaccgtttacggaaaacccggttaggttaacggtacggtccgtacgtaaccgacccgttagtacggttacccgttacttaccctaaccg

SEQ ID NO: 185476 - DNA, 689 bp, Homo sapiens
  misc_feature: GYAE6OF02INN5N.14.23.C01.1.454.CMB.1.raw
  modified_base (112)..(112): a, c, t, g, unknown or other
  misc_feature (112)..(112): n is a, c, g, or t
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (220)..(220): a, c, t, g, unknown or other
  misc_feature (220)..(220): n is a, c, g, or t
  modified_base (340)..(340): a, c, t, g, unknown or other
  misc_feature (340)..(340): n is a, c, g, or t
tcagcgtctagtaccacgaccggtgctcgatttagtacacgtgattagggattgggggaggaactgctcagttaggaccagacggaaccatggaagccccagcgcagcttcncttcctcctgctactcgtggcctcccagataccacgtggacgtaaatagtgatcgacgcagtctccagccacctgtctgtgtactccgaggggtaanacnccaccctntaccgtgacacgggcctagacagtagtcgttaacgaacgcaacttgccttaggtaccagcaacggaacctcgggacacggtcctcccgaggcctccgtacagtacttacgtggtacgtcncctaccgtaccgaccggtccgtaactcgggttactccccgtatcccggtaggtttacgagttcggcgtacggtcggtacgtacggaactaggtacttacgtactcctaccgtaccaagttcccgagtaccgagtaccgtgtacgtacgtaccgtagtaacgttcgtttacgacttaagtttacgttattacgtatacggtaactacgttaagtacgttaaccggtccgtccgttaacgggttcgtaccgtttacgggaaccgtaacgggtacgtaagggtacgtaacgtacgtaacggtacgtggtacgtcgtacaccggtctacgtacgtaccgttacgttaccctag

SEQ ID NO: 185477 - DNA, 816 bp, Homo sapiens
  misc_feature: GYAE6OF02FTJRS.14.23.C01.1.454.CMB.1.raw
  modified_base (520)..(520): a, c, t, g, unknown or other
  misc_feature (520)..(520): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggcctcccagataccactggaagaaatagtgatgacgcagtcctccacgccaccctgtctgtgtcctccgaaggggaagcgccaccctcctcctcggcgacgggccagtcaggagtagtaagaacgctaacgttacgccttggtaaccgagtacgaaacgtaaaccgtcggacccgaggcccttaccccgaggtccctacccttctaagtcctaaggttcggctaccgacctacccgaaccggtacgggtaccctacgttcgggtacccgtaccccgacgggtccgtaacgggttccgtaaggggtcggtaccgttaaggggtttccgggggttcggtaacggggtaacacgggttactttacccgacttacccgtaccacctacgtacncgacctcggtaccgcggtcttacggtcttaggaaagtttgttttaaccgacgttttaaatttagtttacggtttactacgtacgttacgttaagttaaacgttaaagttaccgtcgggttccccgttaggggttacccgggttaacccggttccggtaaccgggaacggttaaccggtaaggttaaccggaaactaaccggttaaaacggtaaccggtttcgggaaacggtacccggtttaacggaccgttaaccggtaacgttcccgttaacggtttacccgttacttaacccgg

SEQ ID NO: 185478 - DNA, 895 bp, Homo sapiens
  misc_feature: GYAE6OF02IG798.14.23.C01.1.454.CMB.1.raw
  modified_base (205)..(205): a, c, t, g, unknown or other
  misc_feature (205)..(205): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtcgtctccgaggggaaancgcccaccctctcctgcgagggccagtcagtagtgtaagaagctaacttagccgtacggtaccagacaacgaaaccgtggaccgacggccctaccccgaggtcccttacccgtcacgttcctaagtcggtcgacctaaccgtacccaacccggacgggtacccctaaccggttcgggttaccgtacccccgtaacggtaccccgtaacggggtttttccgaagggttcgggtacggtaaggggtttccggggttacggttacggggaaacgttaacggtacgtttccctaaccgtttacccgtaccctaacccgtacttacccgaacggtacccgtacggtcccgtttcggaaccgttacgttacggttaaacgggtaaagtttacgtttttacggtaacgttttaaagttttttaacgttttacggtttacggttaacgttaacggttaaacgtaaacggttttaaattaaaaccggtttaaaccggttccgggttaaacccccggtttaccgggtttaaccggggttaacccggttttaaccgggaaacccggtaaaacggggtaacccggttaaaggggttaacgggtaaaaacctaaccgggtaaaaccgtaacggttacgggtacggtaaccttacggaccttaaccgttaacgtttccgtaacgtttcccttaaccgttacccg

SEQ ID NO: 185479 - DNA, 902 bp, Homo sapiens
  misc_feature: GYAE6OF02IBBW9.14.23.C01.1.454.CMB.1.raw
  modified_base (208)..(208): a, c, t, g, unknown or other
  misc_feature (208)..(208): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtcctccagccctaccctgtctgtgtcctccgaaggggaangcccaccctctctgcgacgggccagtcagagttagtaagaacgactaacgttagccgttaggtacctagactaacgaaaccgtggacccgaaggtccctacccgagggtacccttccctactaacgttacttaacgttgggtactacgacgttccccgaaccggtaccgggaaccgtaccgttacgggttcgtacccccgaacggttaccccgttacgggtttaccgaacggttcgggtaccgtaggggtttacggggtaccggttaggggaaactaggtaaccgtttccgaccgtttacctaacccgtacgtacgtaccgaacgtaccgaacggtccctaaggcctaaggttacgttaaaggtaaacgtttaacgtttttcgaccggtttaaagttttttaaacttcgttttaaacggtccgtttaaaacgggtacttaaaacgtttaacgttaaaaaccgtttaacccggggtcccgtttaacccgggttaacccgggggtttaaccgggtttaaacccgggtttacccccggggaaacggtaaacccggggaaaaccggtttaaggggtaaacccgggttaaaaacggtacccggtaaaaacgtaaccgggttaggtaaccgttaaccggacccgtaccgtaaacgttaccgtttcccggtaagttttccccgttaaccttaacccccggg

SEQ ID NO: 185480 - DNA, 722 bp, Homo sapiens
  misc_feature: GYAE6OF02JKQUZ.14.23.C01.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctcncctgcagggccagtcagagtgttagaagcaacttcgcctaggtaccagacaacgaaccgtggaccacggcctacccgaggtccttccgtacacttacgtagtcggtacgcctacgtcccaaccggtacgggaccctacggttcgggtaccgtacccacggtacccgtacggtttacgacgggtcggtaccgtaggggtttcgggttccgttacggggaaccaggttaccgttaccgtaccttaccctaccgacccttacgtcgaacgtccgaacgtccgtacggcgtaacgttcgtaacgtaacgttagttttacgaacgtttagtttatttacgttcgtacgagtactacggttaataaccggttaagttccggtaccgttccggtacgggttaaccgttaccgggaacgtaaccgggaacgtacggttacgtaacgtaccggtaacgtaacgttacgggtcgtacctagaccgtacgtacgttaccttcggttacctacgtacccg

SEQ ID NO: 185481 - DNA, 637 bp, Homo sapiens
  misc_feature: GYAE6OF02FPAGC.14.23.C01.1.454.CMB.1.raw
  modified_base (205)..(205): a, c, t, g, unknown or other
  misc_feature (205)..(205): n is a, c, g, or t
  modified_base (458)..(458): a, c, t, g, unknown or other
  misc_feature (458)..(458): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccaggataccactggagaaatagtgatgacgcagtctccagccaccctgtctgtgtctccgaggggaaangccaccctctcctgcacgggccagtcagagtagttagaagctaacgttacgcctaggtaccagcaacgaaacctggaccaaggcctccccgaggcctccgtacactcgtagtggtcgcactcccaaccgagggcctacgtggtcgtcccagacctaggttcgaggtcggcgtagggtcgggtcgagggacaggtacgttaccacttcctcaccgtagtcaacgtcacgctacgctacgtacgtagtaacgttnttttaggacctttaggttttaactagtttcgtacctagtccgtaagttaacttaagtaaccgtcgtccgttacggtggttaaccggttcgaccgaagggtaccgtaagggtacaacgtaacgtaaacggtactgggtaccacgtacgtaccaccgtattactcgttacgttactacccg

SEQ ID NO: 185482 - DNA, 842 bp, Homo sapiens
  misc_feature: GYAE6OF02GFIUY.14.23.C01.1.454.CMB.1.raw
  modified_base (180)..(180): a, c, t, g, unknown or other
  misc_feature (180)..(180): n is a, c, g, or t
  modified_base (208)..(208): a, c, t, g, unknown or other
  misc_feature (208)..(208): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggaagaaatagtgatgacgcagtctccagcccnccgtgtctgtcgtctaccgaggggaacngccaccctctcctggcacgggccagtccgagagttcgtaagacgacaacttacgccttaggaccagcaaaccgtaactcggaccgtaggtaccctacccggagggtccttccctctaacttccgttaaggttcggggtctaccaaccgttccccggaaaccggccggggtaccctacggttcggggttccctaccccgtacggtaccgttacgggtttccgaacggggttccgggtaaccgttagggggtcgggtttacccgggggaagggtaccgtaaggggttaccttacccggtaacgttcccggtaaactacccctacggttagacccgggtactaccggtccggttacggaccggttacggtcttaaccggtaggtttaaccgtttccgggttaactttagggtttttaaccgtttagtttaacgtaccctgggtaacctttaaggtaaacgtttaacgaacgtttcccggtccgtttaacggttccggtaaccgggtaccgtaccggtaaaccggggaacggttaggtaaccggaaacgttaaccggtaacggtaaccgttacgggaccgttaaccggttacaccgtaccgtttaccgtacgtttcctttacgttaccctttacccgg

SEQ ID NO: 185483 - DNA, 794 bp, Homo sapiens
  misc_feature: GYAE6OF02ICSME.14.23.C01.1.454.CMB.1.raw
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccacgcccaccctgtctgttcgtcctaccggaaggggaaacgacgccctacccctctccgtcgaccgacgggccagtcgagtaggttagttaagaacgactaacttacggaccgttcggaaccacggacaaacgtaaaccccgtgggaccgacgggtccctaccccgaggtcccttcccgtactactctagtcggtcgaccacttacccgaccgaccgggcctaacggtttcggccgtacccgacgtacccgtaggttaccgaggtacggcgtagggtcgggttcgtagggaccgaaggttccggttacctcgttccctactaccgtagtcgacgcccgtaacggcttaacgggcgttactttcggaaagttaacgtttgtttcgtaacgttttagtttaacgtttcgtacggttccgtaagaccgtttaaagtttaactttaaccggtaccgtttcggggtaccctttccggggtaacggttaccgtttacccggggacgttaaaccggggtaacggttaaaagggttaccgaaaaaccttaacgggaaaccttaccgggttggttacgaacgtacccgttacctaacggtcgttcccgtttagtacccttttcccggaacc

SEQ ID NO: 185484 - DNA, 747 bp, Homo sapiens
  misc_feature: GYAE6OF02I42ZA.14.23.C01.1.454.CMB.1.raw
  modified_base (202)..(202): a, c, t, g, unknown or other
  misc_feature (202)..(202): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaangcccaccctctcctgcacgggccagtcagagtgtagagtcaacttagcctaggtaccagcaagaacctggaccaggcctcccgaggtcctcctcatctagtcggtcacatcccgaccgacggtccacgtcggtccgtcccctatcccggaggttcaagggttcggacgtacgggtttcgggcgttacggggactaacgggtacttccgaccttactcccgaactaccgtcgaacgacctacggtaccgtaagtacggttactaacgtaagtttacgttttacgtacgttagtttttaacgtttcgttacggttactaccggtacgtaccgggaacggggtcttaacggttccgggtcccgtacgtttacccggttaccggggttttaccgggggaccggggggttaaccggtaaggggttaccggggttaacctttaacccggggaaacgtttacccgggtagggttacccgggacgtaccggtacctaaccgttcttaacccggtttcgttaccggtttacccttacgttccccgttaacccgg

SEQ ID NO: 185485 - DNA, 811 bp, Homo sapiens
  misc_feature: GYAE6OF02IUZR6.14.23.C01.1.454.CMB.1.raw
  modified_base (231)..(231): a, c, t, g, unknown or other
  misc_feature (231)..(231): n is a, c, g, or t
  modified_base (252)..(252): a, c, t, g, unknown or other
  misc_feature (252)..(252): n is a, c, g, or t
  modified_base (462)..(462): a, c, t, g, unknown or other
  misc_feature (462)..(462): n is a, c, g, or t
tcagcgtctagtaccacgaccggtgctcgatttagtacacgtgattagggattgggggaggaactgctcagttacggacccagacggaaccatggaacgccccagcgcagcttctcttcctctgctactctggcctcccgagactaccacgtggaacgtaaattgcgatacggacgctagtcctaccgagtccctaccgttgtcttggtacgtcctacggaaggggaaacncgtaccacgttcctactccgnggaccgcgggtcctaagtccgaagttacggtaggttaacgaacgttactacgttacgtcctaagggtacccatacgaacggtaaccgtggtacccgacgtcccgtaccgtacggccttaccgtactcgttactacggtggtacgtacctacgttacccgacggtaccggccttaccgtcggtacccgtaccgagtaccgtaacgggtttnacggtccgacgtgggttcggacgtcgggtaactacggactttaacccgtaccgttacacgtaccgttaacggtacgtaccggactaacggtacccggagttacccgttaaggttaaccgtacggttaacgtttggttaaaccgttagtttaaacggttttagttaacgttcgtaaaccgtaacgtagttaacgtaaacgtttaacgtaccggtttccgagtttaccggaacgggtttaccgaccggtaagggtacggtaaaccgtaggttaaaacctccggtaaaacgtaccggtaacgtcggtaacgtacccgtcaacctttcccggaattccggttacgtctaccgg

SEQ ID NO: 185486 - DNA, 767 bp, Homo sapiens
  misc_feature: GYAE6OF02GJYR9.14.23.C01.1.454.CMB.1.raw
  modified_base (236)..(236): a, c, t, g, unknown or other
  misc_feature (236)..(236): n is a, c, g, or t
tcagcgtctagtaccacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccactcaccctgttctttgtctccgaggggaaagagccaccctctcctgcgagggccagtcaggngtgtacaacaccaacttagccttggttacagcagacgtccgtggccaggctccgaggcctcctcagttgtatgacgtgacctactacccgacgacgggcccaccggcacgtcccgacgtaccgtaggttacgacggtggccgtaggggtccgggttcgtacggggaacctacggtacctttaccaccgttccgtaccacctagtaccgacgccgtaacgtacccgttaaggtacgttacgttaagggttaaacgtttacgtttttacggaacgtttttaacggtttttaacttaacggttcgtaacgaacggtacgggtaacggggtccggggttaacttaagggtttccgggtaccgttaccgtttaccgggttaaccggggttttccggggggaaccggggttaaccgtaaggggttcgggtaacgttaacccggaaacgttcggtacgggttcggtacgtaccggaccgtaacgttacgtttccgtacgtttaccgtacccggttacgtttccccggtacccgtaccg

SEQ ID NO: 185487 - DNA, 681 bp, Homo sapiens
  misc_feature: GYAE6OF02GR311.14.23.C01.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (237)..(237): a, c, t, g, unknown or other
  misc_feature (237)..(237): n is a, c, g, or t
  modified_base (257)..(257): a, c, t, g, unknown or other
  misc_feature (257)..(257): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctcgaggggaangccaccctntcctgcgaggccagtcagagtgtaanagcaacttgcctaggtaccngacagaaacctggacctaggcctcccgaggtcctcctcattcgtaagtggctcaactcccgaacgacgggcctaacgtgggtacctcccgaaggtcccgtaagggtttcaaggttcgggaccgtaggggttcgggtacgtggggaactagggtacgtactacgtctacgacctagtaccacgtaccgtagtccgtgaccgtacgtcgtaaggtagtttagtttacgacgttaagtttacttagttcgtacgtagtactaagttaactaaacgttaccgtacggtccgttacgggtacggtaccggttccgaaacggtaacgggtaccgtaagggtacggtaaacgtaaccggtaaacgggtaacgttacgggtaacggtcgtacgaccgaaccgttagttcgttacggtttctaaccgttaccg

SEQ ID NO: 185488 - DNA, 866 bp, Homo sapiens
  misc_feature: GYAE6OF02FPMM8.14.23.C01.1.454.CMB.1.raw
  modified_base (152)..(152): a, c, t, g, unknown or other
  misc_feature (152)..(152): n is a, c, g, or t
  modified_base (206)..(206): a, c, t, g, unknown or other
  misc_feature (206)..(206): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggcctcccagataccactgganaatagtgatgacgcagtcctccagccaccctgtctgtgtcctccgaggggaacncgcccaccctctcctgccagggccagtcagagtcgttaagacgctaacttacgcccttagggtacccagccgaacggaaacctcgggacccagggtccctaccccgaacggtccttaccctctacttccgttaaggttcggggtactcccgtaacgtaccccgaaccggacggggaccccttacggtccgggtacgttccccgaacgtcccggtaacggttcgaggttccggacgtggggtttcggtcggtacggggaactacgggttacgttctacccgttacctaccaacccgtacgttaccgacggcccaacggtcccgttgggaccgttaacggttacccgtttaagggtaaaacgtttcgttttttacggaacctttttaacggttttacgtttaaccgtcggttacccgaacggtttaccggaccgggtaccgggggttacgtaacgggtttccgggacccccgttacgtttacccgttaaccgggggttttccggggggaaacccgggggtaaccgttaacgggggtaacggtttacccggtaacggtaaaaccgggttacccgggtccgggttaacggtcccgtttacggaacccgttacccttagggttttccaacccgtttacccggtttacctaacccgtttcccccgg

SEQ ID NO: 185489 - DNA, 723 bp, Homo sapiens
  misc_feature: GYAE6OF02GGUUL.14.23.C01.1.454.CMB.1.raw
  modified_base (204)..(204): a, c, t, g, unknown or other
  misc_feature (204)..(204): n is a, c, g, or t
  modified_base (325)..(325): a, c, t, g, unknown or other
  misc_feature (325)..(325): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtcctcgaaggggaancgccaccctctcctgcacgggccagtcagtgtagtagacgactaacgtagccgtaggtaccagtacaacgaaaccgtggaccaggccctacccgagtccctaccgtacattctagtcggcnctacctacccgacgacgggtcctagtcggtccaccgtacggtccgtaggtcaggtacggcgtacgggtcgggtcgtagggactaggtaccttacgacctccaactaccgagtaccgaacgcctaggtcccgttagaccttcggtacgtaagggttaactttgtttaccgtactttaaggttttaacttattccggttacgaacgtaagttttacgtaaaacgttaacgtaaccggtccgggttaaccgttcgggtaacggttacccgggttaacggacccgggtaaaaggtacccggtaaacgggtttaggaaaacctaaccgggtaaaacgtacggttcggaaccggttctaccggaaccttacctaggtttcaccggttttaccgacttacccggg

SEQ ID NO: 185490 - DNA, 727 bp, Homo sapiens
  misc_feature: GYAE6OF02JCKDC.14.23.C01.1.454.CMB.1.raw
  modified_base (203)..(203): a, c, t, g, unknown or other
  misc_feature (203)..(203): n is a, c, g, or t
  modified_base (234)..(234): a, c, t, g, unknown or other
  misc_feature (234)..(234): n is a, c, g, or t
  modified_base (242)..(242): a, c, t, g, unknown or other
  misc_feature (242)..(242): n is a, c, g, or t
  modified_base (720)..(720): a, c, t, g, unknown or other
  misc_feature (720)..(720): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaatagtgatgacgcagtctccagccaccctgtctgtgtctccgaggggaaanagcccaaccctctcctgcagggccagtcagngtgtagancaacttagcctggtaccagcacgaaacctggccacggcctcccgaggcctcctcagtctagtgtagctagcccacgacgggcctacgtcggtctacccgagtccgtaacggttccaggtcggcctaggggttacgggtccgtaggggaaccgtaggtaccgttccacttccgtaccgacctacgtccacggtcaaccggtcctacggaccgtacggtccttaaggtaaacgtttcgttttaggacctttaaggtttttaactttacgtttaggtacctagtacgtaaacgttaagtttaaactaacccggttcggttaccgtacccggttgggtaacccgttttaccgggaaacccggtaaacggggtaacccgtaaggggttaacggtaaaccgtaaccggtaaaaccggttacggttaccggtaacggccttaacggacccttaaccggtacgttacccgtttagttaccccgttntaccccg

SEQ ID NO: 185491 - DNA, 878 bp, Homo sapiens
  misc_feature: GYAE6OF02INC2J.14.23.C01.1.454.CMB.1.raw
  modified_base (209)..(209): a, c, t, g, unknown or other
  misc_feature (209)..(209): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtcctccagccctaccctgtctgtgtcctccgaaggggaaancgcccaccctctccgtgacgagggccagtcgagtagttagttaacgaagtacctaacgttacgccgtacggtaccagacaacgtaaacccgtggacccgtaaggcccgtaccccgtaggacccttacccgtactacgttaccgtaggttcgggtacgtacctaacgtaccccggaaccgtaccggggtacccctacggttacgggtcccgtaacccgtaacggacccgttaagggttaccaaggggttaccgggaccggttaacggggtttccggggttaccggtaaggggaaccttacgggttaaccgtttaccgaaccgttacccgtaccgaaaccgtaacgtttccgaacggtacctacggtacccgtaggacgttaacggtaccgttaaggtaaccgtttacgttttcgaaccgttttaagttttactttacgttgggtaaacctggtaaaccttaaaggttaacttaaaccggtacggttcccggttaaccgtacgggttacggttaaccggtaccgggaaacgtaaaaccggggttaccgtaaggaaccggttaaaccaaaccgggttaaaaccgtaccggttagggtaacccgtaacggttaccgtaacccgtaacccggttagtttaacccgttacccggttacttacccgttaaccccgg

SEQ ID NO: 185492 - DNA, 834 bp, Homo sapiens
  misc_feature: GYAE6OF02IASO7.14.23.C01.1.454.CMB.1.raw
  modified_base (211)..(211): a, c, t, g, unknown or other
  misc_feature (211)..(211): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccgagataccacgtggaagaaatagtgatgacgcagtctccagtcccacctgtctgtgtcctccgaaggggaaacncgcccaccctcctccgtagcgacgggccagtacaggtagttagttagaacgtactaacgttcggtcccgttggtaaccagtacctaaggaaaaccccgtcggaacccgaggtcccctcccggtacggtaccctccttacctacttacgttacgtcggggttcgaaccctaccgttaacccggacccggtaccggggtaccccgtaacggtttcggtaccgtacccccgtaacggttccccgtaggggtttaccgacgggttcgggacggttacggggtcggggtaccgtaaggggtactaacggttaccgttcaacccttcctaccgtaaccctacgtacgaccggtactacccggttccgtacggtaaccgtagttccggttaaaggttacgtttacgttttacggtaacttttaggtttacgttttaagttacgtacgtacgtaacgttaggtttaaactttaaacgtccgtcggttacccgttaacggtttacggtacccggttaccggaaacggtaaaccgggtaacggtaacggtaacgtaacggtaaccgtaaacggtacgttccggagttaaccctgtaaccctatcggtttaccgtcgtttaccgaccttacccg

SEQ ID NO: 185493 - DNA, 841 bp, Homo sapiens
  misc_feature: GYAE6OF02JPYE9.14.23.C01.1.454.CMB.1.raw
  modified_base (208)..(208): a, c, t, g, unknown or other
  misc_feature (208)..(208): n is a, c, g, or t
tcagcgtctagtaccacgaccggtgctcgatttagtacacgtgattagggattgggggagggaactgctcagttaggacccaggacggaaccatggaagccccagcgcagcttctcttcctcctgctactctggctcccagataccacgtggagaaatagtgatgacgcagtctccgagccacctgtctgtgtcctccgaaggggaancgacccaccgtctccgtgacgaggcctaggtcgaaggtacgttacgttaacgaacgtacctaacgttacgccgtacggtaaccaggacaaacggtaaacccgtcggaccgtaacggtccctacccggacggtaccttacctacgtaccgttcgttaaggtcgggtactaccaccgtaccgaaccgggtacggtcctacggttcgggtacctacccgacggtaccggtaggttaccggtaacggggtcggaaccgggttaggggttacggggtaccggtaagggggaaccttacgggtttcccgttaaccgtccgttcctaacccgaccggtactaccggaacgtaccgtaccggtcgttaccggtacgttacggttcctaaaggggttaaaccttttggtttaacccgagtttttaaacgttcttttacggtacgttacggacgtacgtttaaacgttacgtaaacgtttccggtacggtcccgttaccggttacgggaaccgttaccgggaaacccgttaaaggggaacccgtttaagggtaacccgtaaagttaaacccggtacgggttactcgggtaaccggtacttacgacccgtagttaccgttggtacccttaaggtcccttacccg

SEQ ID NO: 185494 - DNA, 780 bp, Homo sapiens
  misc_feature: GYAE6OF02HMYQG.14.23.C01.1.454.CMB.1.raw
  modified_base (150)..(150): a, c, t, g, unknown or other
  misc_feature (150)..(150): n is a, c, g, or t
  modified_base (226)..(226): a, c, t, g, unknown or other
  misc_feature (226)..(226): n is a, c, g, or t
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
  modified_base (370)..(370): a, c, t, g, unknown or other
  misc_feature (370)..(370): n is a, c, g, or t
  modified_base (484)..(484): a, c, t, g, unknown or other
  misc_feature (484)..(484): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctccagataccactgganaaatgtgatgacgctagtctcagcccaccctgtcgtgtgtctacgaaggggaaacacgtcccacccgttctcccgngaccgagggtccaaggtcgaggacgttgtaacgacgacaacttacgcccgttaggtaccgagcgaaccgtaaaccgtcggcgacggcctacccgagtccctcttacgntcctagtggtntaccagcccgacggacgggtacccnggttacgggtcctacccgcgtaccgttaggtcctaacgggttggaccgtaggggtttgggtacgtaggggaaccttaggtaaccgtttcaactttccggaactaccggtaaccncgtacgtaccgtaccggtcgtacgtcgtacggttacggtaaaggttacgtttacgttacgtttaacgtttacggttttaacgtttcggttacgtaccgtaacgttaagtaaccgttaacgttaaacgtttccggttaccgggtccgttaaccggttaccggggttacccgggttcccgggtaaccggtaaacgggtaaggtaacgggttaacgtaaaccgttaacggtaaaccggtaggttaccgtaacggtcggtactacgacgttaacgttcgttaccgtttcgtaccgtaccg

SEQ ID NO: 185495 - DNA, 699 bp, Homo sapiens
  misc_feature: GYAE6OF02IHV6V.14.23.C01.1.454.CMB.1.raw
  modified_base (158)..(158): a, c, t, g, unknown or other
  misc_feature (158)..(158): n is a, c, g, or t
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (251)..(251): a, c, t, g, unknown or other
  misc_feature (251)..(251): n is a, c, g, or t
  modified_base (286)..(286): a, c, t, g, unknown or other
  misc_feature (286)..(286): n is a, c, g, or t
  modified_base (414)..(414): a, c, t, g, unknown or other
  misc_feature (414)..(414): n is a, c, g, or t
  modified_base (420)..(420): a, c, t, g, unknown or other
  misc_feature (420)..(420): n is a, c, g, or t
tcagcgtctagtaccacgaccggtgctcgatttagtacacgtgattagggattgggggaggaactgctcagttaggacccagacggaaccatggaagccccagcgcagcttctcttcctctgctactctggctcccagataccactggagaaatagtnatgacgcagtctccagccaccctgtctgtgtctacgaggggaangcccacctctcctgcaggcagtcagtgtgtagancacttgcgtggtacngacagaaccgtggccagtcctccgaggcctcctanactctagtcggtctacactccgacgacggtcccagtcgtcgtaccacgtccgtagtcgagtcggagtacggtgggtcgagggtacagtacggttcctactccgactaccgagtcgagacgtacgtccncgtacncgttacgtagtacttcgttacgtacgtttaagtttacgttttataccggttagtacgtactaacgtttaaagtaacccggttaacggtccgtaacccggtttccggtaagggtttaacccgtaccggggtaaaccggtaacccggggtaaacggtaccggggttaaccgttaaaccggaaccggtaaaccggttaaccggttggggttagggaaccccctttagggaacccgtaccgtaaccggtttaccgttaccggtttccaacccgttttacccgg

SEQ ID NO: 185496 - DNA, 844 bp, Homo sapiens
  misc_feature: GYAE6OF02HUC6O.14.23.C01.1.454.CMB.1.raw
  modified_base (211)..(211): a, c, t, g, unknown or other
  misc_feature (211)..(211): n is a, c, g, or t
tcagcgtctagtaccacgaccggtgctcgatttagtacacgtgattagggagttgggggaggaactgctcagttaggaccagacggaccatggaagcccagcgcagcttctcttcctctgctactctggctcccagactaccactggagaaatagtgaatgacgctagtctccagcccaccctgtctgtcgttcctaccggaaggggaaancggcccacccttccgtacctggccgacgggccgtaggtaccgaggtagttaggttaacgaacgtcttaaacgttacgccgttagggtaaccaggaccaacggtaaccgtggccacgggcctaccgacggtcctccttacacttcgttaattcggtacgtacctacgacccgaccgtaacgggcccctaaggttcgggtaccgtaccctaaccgggtccgttaacggttcgtaacggggtcggtaaccgttgggggtttacgggtccggtacggggtaacgtaacggtttacggttacctacgttaccgtacctaccgttacgtaccgagtaccgaccgtacgtacgtccgaacgttcggtaaggtaacgtttaacggttacgttaacgttagtttttaacgtttacggttacttacggtaacgttcgtaaagtttaaacgttaacgttaacggttaccgttaccgttacggtaccgggtttaaccggtaccgggtaacggtaaaaccgggtaaccggtaaacgggttaacggtaaaccgttaaccggtaaaaccgttcggttaacgtccggtttaaccgtcgtaacccgtaacgttaccgttacccgttacgttttaccgtacctttacccgg

SEQ ID NO: 185497 - DNA, 809 bp, Homo sapiens
  misc_feature: GYAE6OF02HF73U.14.23.C01.1.454.CMB.1.raw
  modified_base (203)..(203): a, c, t, g, unknown or other
  misc_feature (203)..(203): n is a, c, g, or t
  modified_base (792)..(792): a, c, t, g, unknown or other
  misc_feature (792)..(792): n is a, c, g, or t
tcagcgtctagtaccacgaccggtgctcgatttagtacacgtgattagggattgggggaggaactgctaagttaggacccagacggaaccatggaagccccagcgcagcttctcttcctcctgctactctggctcccagataccactggagaaatagtgatgacgcagtctcagccaccctgtctgtgtctccgaggggaaancgccacctctctgcaggccagtcagagtgtagaagctaacgttagcctggtaccaggacaacggaacctggccacgggtcctacccgaggtccttccgactatcctaagtggtacgcctactcccgaaccgacgggcctacgttcgggtctacccgagtcccgtaggttaccgagtcggactagggttcgggtccggtggggaacctaggtacctttaccgcgttaccgtccctaaccgacgtcgaacgtaccgacgtacccgttcggaacttacggtccgttaggtaaagtttacggttttacgccggttttaaagtttttacgtttaacggtttacgtaccgtaaacggtaccgtttaaaggtaaaccttttaacggtaaacccggttcccgggtttaaccccgggttcccgggtttaacggggttaccgggtttaccgggttaaacccggggttaaacgggaccgggtttaaaacgggtacgggtaaaacccgttaacgggttaaaaccggttaacggtacgggttaacggtaccggtaaccggttaccgtacccgggtacttaccggtttcgttaaccccgtttnttacccggttaaccccg

SEQ ID NO: 185498 - DNA, 665 bp, Homo sapiens
  misc_feature: GYAE6OF02JE9SV.14.23.C01.1.454.CMB.1.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (297)..(297): a, c, t, g, unknown or other
  misc_feature (297)..(297): n is a, c, g, or t
  modified_base (405)..(405): a, c, t, g, unknown or other
  misc_feature (405)..(405): n is a, c, g, or t
tcagcgtctagtaccacgaccggtgctcgatttagtacacgtgattagggattggggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaanacgccaccctncctgcaggccagtcagagtgtagagcacttagcctgaccagcaagaacctggaccaggcctccgagcctctcatcagtggncatcccgacggaggtccccagtcgggtctacccgagtcccgtaaggttccgaaggtcgacgttaggggtcggtcgtacgggaacaggtcttcgaacctctaccacgtntccagaccacgcccgtagaccgtacgtacgttagtaaacggtttctttaggaccttttaggttttaaaccgtttagttaccgtacgtaacgtctaagttaaacttaagtaaccgttccgtaccgttaccggttagggtacccgtcggtaaccggtaacgggtaacgtaacgggtataaacggaaccgtaaacggtcggttcggtacggcctttaccggaaacgttcgtaacttcccggttagtaccgttacccttacccg

SEQ ID NO: 185499 - DNA, 669 bp, Homo sapiens
  misc_feature: GYAE6OF02IQAOA.14.23.C01.1.454.CMB.1.raw
  modified_base (315)..(315): a, c, t, g, unknown or other
  misc_feature (315)..(315): n is a, c, g, or t
  modified_base (416)..(416): a, c, t, g, unknown or other
  misc_feature (416)..(416): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggcctcccagataccactggagaaatagtgatgacgcgagtctccacgccaccctgtctgtgtctccgaggggaagcgcccaccctctcctgcgacgggccagtcgagtagttagttaagacgactaacttagccgtaggtaccagacaacgaaacctcggaccaggcctcccgagtcctcctanacttcgtaacgtggtacgctaccgtacccaaccggtacgggcctacgttcgggtaccgtccccgaagccgtacggttcagtcgggcgtagggttcgggtcngggactaggtaccgttcacctcctaccaccgtacgaccgacgaccgtacgacccgtggacctagttaccgtagtaacgttactttacgggtactttaggttttaattacgttcgtacgtatactaagttaacgttaactacggtcgtacctcgggtgtaccgttacggaccgaaggtacgtaggacgtaacgtaacccgaagtacgtaggtacgtctacggacctacgttcgtactcgttcctacgttacccg

SEQ ID NO: 185500 - DNA, 721 bp, Homo sapiens
  misc_feature: GYAE6OF02FXIMB.14.23.C01.1.454.CMB.1.raw
  modified_base (203)..(203): a, c, t, g, unknown or other
  misc_feature (203)..(203): n is a, c, g, or t
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaanagccaccctctcctgcagggccagtcagagtcgttagagcaacttagcctggtaccagcagaacctggccaggctccnggctcctcatctagtggtcncactaccgaccgagggtccacgtgggtctcccgagcccgaggttcaggtcggacgtaggttcgggtcgtaggggactaggtcgttcacgtctacacccgattacgagtacacgcccttagcctacggttacgtacgtaaggttaacttttcggacttaacggtttttaattaccgttgttaccgtacgtacgtaaagttaagtaaactttaacggtaccggtaccccgtttaccggggttaccgggtttacccggtttaaccgggtaaccggtaaaacccggggaaccgtaaagggggttacggtaaaccgttaacggaaaaacccggttaacggttaccggttaacgggttaccgttaagtaacccggtaccgtttaaacgttcccggtttaaccggttacctttaacccgttacccgg

SEQ ID NO: 185501 - DNA, 791 bp, Homo sapiens
  misc_feature: GYAE6OF02FJH1Y.14.23.C01.1.454.CMB.1.raw
  modified_base (204)..(204): a, c, t, g, unknown or other
  misc_feature (204)..(204): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctcgaaggggaaanacgccaccctcttcctgcacgggccagtcagagtgtagaagcaacttaggcctaggaccagcaagaaacctggccaggcctccaggctccgctaatcctagtggtacgactagtacccgaaccgacgggcctacggtcggtcgaccctaaccggtccgtaacggttcgaggttcggaccgtagggttcccggggtacttacgggggaacctaaggtaacgtttaccgaaccttacccgttaaccgaaccctaacgtaccctaagggaccctacggacccgttaggaaccctttaacggttacccgtaagggttaaacggtttaacgttttacggtaacctttaaacggtttttaatttaacggttttccgttaacgaagggtttaaccaaagggtttaaaacttaaaccgttaacccgggttcggtaacccccggtttacgtaacgggggtttaacccgttaccgggtaacccgtaaagggggtacccaaaggggttacgaaacgtttaaacgaaacccgggttaactacggggtaccgtcggtaagtaccctaacggttaaactcgtttcggtacttacgttaccc

SEQ ID NO: 185502 - DNA, 927 bp, Homo sapiens
  misc_feature: GYAE6OF02HUXF9.14.23.C01.1.454.CMB.1.raw
  modified_base (152)..(152): a, c, t, g, unknown or other
  misc_feature (152)..(152): n is a, c, g, or t
  modified_base (216)..(216): a, c, t, g, unknown or other
  misc_feature (216)..(216): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctccagactaccactggganaaatagtgatcggacgcagtctccagtcccacccgtgtctcggtctccctaccgagggggaaancgacccctaccctcgtacccgtcgacgaacgggaccctacggtacaaggtacggttgttaacggaacgtaccttaaccgttacgcccttacggggtaacccaggtaccaacggtaaaacccttcggggacccgtaacggtccctaaccccgaagggtcctttaccctactagttacccgtacggtgggttagtcccgtaacgttccccgaccggaaccggggtccctacggttccgggttccctaaccccgtacggtaccccggtagttccggaagggttcggaccgtaggggtacgggcggtaggggaaaccgtaggtccggttacctaacgttcccgtaacccgactacccgtcgaacgttccggtaaccggtcccgtcggaaccttaccgggttacgtttaacgggtaaaccgttatttttacccgggaacgttttacggtttttaagtttacggttacgttacggtaaacggttacgtaaggttttaaaccaaccggttttaaacgggtcccgggtttacccgtcgggtttaaaccggggtccggttttaacccggggaaccggtaaaccgggttaaccgggaacggggttaacccttaaacgggtaaccggtaaaaccgggtttacccgtacggggtcgggttaacccgtaaccggtaacctttacggtaccggttagtttaacccgggttgttaaccccgttacc

SEQ ID NO: 185503 - DNA, 673 bp, Homo sapiens
  misc_feature: GYAE6OF02GN3I0.14.23.C01.1.454.CMB.1.raw
  modified_base (209)..(209): a, c, t, g, unknown or other
  misc_feature (209)..(209): n is a, c, g, or t
tcagcgtctagtaccacgaccggtgctcgatttagtacacgtgattagggattgggggaggaactgctcagttaggacccagacgggaaccatggaagccccagcgcagcttctcttcctcctgctactctggctcccagataccactgggaagaaatagtgatgacgcagtctccagcccaccctgtctgtcgtctccgaggggaaancgccctaccctctcctgaccgagggccagtcaagtacggtgttaagaacgactaacgttacgaccgtacggtaccacggacaacggaaaccgtcgggacctaggcctacccgacggcctcctacatcgtaagtcggtagccactcccgaaccgcgggacctacgtcggtccgcccgaggaccgtaggttcgacggtcggactaggggtcgggttcgtaggggacgtaggtagtacctaccgttctaccgaccgtactccgaacggcctaccggtcctgacgtacgtcgtagtaaggttatttacgtacttaggttttacttagttcggtacctagtacgtaattaacgtaacgttacgtcggtaccgttcggtacggtaccgttaccggacgtaaacggacgtaggacgttaagacaacggtattcggacgtcgtagacctacggtctcgtcgttctatacccg

SEQ ID NO: 185504 - DNA, 655 bp, Homo sapiens
  misc_feature: GYAE6OF02HP0V1.14.23.C01.1.454.CMB.1.raw
  modified_base (211)..(211): a, c, t, g, unknown or other
  misc_feature (211)..(211): n is a, c, g, or t
  modified_base (229)..(229): a, c, t, g, unknown or other
  misc_feature (229)..(229): n is a, c, g, or t
  modified_base (329)..(329): a, c, t, g, unknown or other
  misc_feature (329)..(329): n is a, c, g, or t
  modified_base (359)..(359): a, c, t, g, unknown or other
  misc_feature (359)..(359): n is a, c, g, or t
  modified_base (380)..(380): a, c, t, g, unknown or other
  misc_feature (380)..(380): n is a, c, g, or t
  modified_base (627)..(627): a, c, t, g, unknown or other
  misc_feature (627)..(627): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggcctcccagataccactggagaaatagtgaatgaacgcagtcctcagccaccctgtcctgtgtctaccgaagggggaaanacgcccaccctcgtaccngacgacgggccagtcagtagttagttaagaagcaacttagccttaggtaccagcaacgaaacctggccaaggcctaccgagcctcctacatctatcggtnacactccgacgtcggccacgtggctaccgngaccgtaggttccaggtacgngtaggttggacgtagggactaggtacgttacgacctccgtacaactataccgaagactaacggtccctggaacccgtagttccgtaagggtaatttcgtttagctttaaagttttacttaatcgttaacgagttacaaagtttaactaaagtaccgtcggtccctaaccggtaggtaccgttaccgacgtaaacgggaactaggtagaaacgtacgaaaccggtagtcggttaggaaccttcgaacnccgtattccggttatacccttagtaacc

SEQ ID NO: 185505 - DNA, 896 bp, Homo sapiens
  misc_feature: GYAE6OF02GDJ59.14.23.C01.1.454.CMB.1.raw
  modified_base (206)..(206): a, c, t, g, unknown or other
  misc_feature (206)..(206): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggcctcccagataccactggagaaatagtgatgacgcagtcctccagccaccctgtctgtgtctccgaggggaaangcccaccttctcctgcgacgggccagtccgagtagtgttaagagctaacttacgcctagggtaccaggccaacgaaaccgtgggacccaggggccctacccccgaggtcccttacctaccgtattaccttaagtcgggtcgtacctacgtccccgaaccggacggggtaccctaaccggttcgggttacccgttacccccgaacgggtcccgttaacgggttaccggtaggggttaccgggtaccggtaggggtttcgggggttaccgttaacgggggaactacgggtaacggtttcccgtaacctttcccggtacccaacccgtaactaccggtaacggaccggtaacgtacccggtaacgggtaccggtttacggttaacggttaaaggttttacgttttaccggttacgttttaacgggtttttaatttaacggttacggttacgttacggtaccgggtacggggtacggggtaacctacggtttaccgggacccggttaccgttaccgggttaccggggttttaccgggggaaacccgggggttaacccggttaagggggttaccggttaacgggttacccggttaaaacgggttaacggttacgggtacgttacggtaaccgtaccgtaacccgtacgtttacgttccgtttaccgtttaccgtaccgtttaccccgttaccccg

SEQ ID NO: 185506 - DNA, 842 bp, Homo sapiens
  misc_feature: GYAE6OF02H3K8K.14.23.C01.1.454.CMB.1.raw
  modified_base (177)..(177): a, c, t, g, unknown or other
  misc_feature (177)..(177): n is a, c, g, or t
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctcggctcccagataccactggaagaaattagtgatgacgcagtctcanacccaccctgtctgtcgtctaccgaggggaaagacgcccacctcctccgtgcgacgggccagtcgagtagtaggtaagaagctaacgttacgccgtacggtaaccagaccaacgaaaaccgtcggaccgacggccctccgacggcctcctctactctagtggtcncaacnccaccgtacggcctacgtcgtctccgaggccgtaggtacgaggtacggcgtagggtcggtcggagggactacggtacgttcctactactacccgtaacgacgttaccgacgtacgtaccgtcccgtacggtaacctacggtacgttaaacggttaagtttaaccgttttacggtaccgttttaaggtttttaaactttttacggttaccgttacgtaaaacgttaacgttaaaacggtttaaaacttaaacggtttaaacccggtacccggtttacccggtttaccgggttaccggggttttaaccgggttaaaccccggggaacgggttaaaaccggggtaaccgggttaaaccggggttaaaccgttaaaaccgggtttaaacccggaaaaccggttaacccgggttagggtaccccggtttaaccgtcggtaaacccgttacccggttaacgttacccggtttaccgttttacccgtacccgtttaaccccg

SEQ ID NO: 185507 - DNA, 749 bp, Homo sapiens
  misc_feature: GYAE6OF02GNLST.14.23.C01.1.454.CMB.1.raw
  modified_base (112)..(112): a, c, t, g, unknown or other
  misc_feature (112)..(112): n is a, c, g, or t
  modified_base (321)..(321): a, c, t, g, unknown or other
  misc_feature (321)..(321): n is a, c, g, or t
tcagcgtctagtaccacgaccggtgctcgatttagtacacgtgattagggattgggggagaactgctcagttaggacccagacggaaccatggaagccccagcgcagcttcncttcctcctgctactctggctccagataccactggagaaatagtgatgacgcagtctaccagccacctgtctgtcgtctccgaggggaaaactcgcctaccctctccgtggacacgggcctagtcagtacttggtaacgagcctaaattcggccgttagtaaccgacgcaacggtaaacctgggacctagggctcccgagccgttaccnctatacgttacgtggttcgctacgtaccaccgacggcctacgtcggtacgccagccgtagtctaaggtcgcgtagggttcgtacggtcggaacgtcggtaagttccgaatcctacgacctacgtacgagtacgtactccgtcgcgtacgttcgtacggtaacggtttattttaccgggagttttaacggtttaaactttacggtttcgtaccgttaacgaacgtttaaccgttaaagttaacgttaaaccgttcccggtttaaccggttccgggttacgggttaaccgttcccgggaaaccggttaacgggtaaaccggtaacgggttaacgggtaaccgtaaaccgtaaaacgggttaaccttacgggtaccgttacggacgtaacccgtacgtaccgttacgtttacgtaccttacttaaccccgg

SEQ ID NO: 185508 - DNA, 893 bp, Homo sapiens
  misc_feature: GYAE6OF02IULHN.14.23.C01.1.454.CMB.1.raw
  modified_base (172)..(172): a, c, t, g, unknown or other
  misc_feature (172)..(172): n is a, c, g, or t
  modified_base (216)..(216): a, c, t, g, unknown or other
  misc_feature (216)..(216): n is a, c, g, or t
  modified_base (557)..(557): a, c, t, g, unknown or other
  misc_feature (557)..(557): n is a, c, g, or t
  modified_base (573)..(573): a, c, t, g, unknown or other
  misc_feature (573)..(573): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctacccagactaccacgtggaagtaaatagtgaatggacncagtcctccagcccaccctgtctgtcgtactacggaaggggaanacgccctaccctctccgtaggccgacgggaccagttacgaaggtaggttacggttaagtaacgacctaacgttacgtccgtaggtaacccaaggaccaaacggaaaccgtcggaaccgacgggaccctaccccggagtccttccctacgtacttaccgtaggtcggtacactaacgtaccccgtaccggcgggtaccctggttccgggtacccgacccgaccggttaccgtacggttacggacggttaggaccgttaggggttcggggtaccgtaggacggttaggtacgttaccaccgttacctaccgaacctactacgaccggtaccgtacgttaccgngtaccggtaacggttntaaacgggtaacgtttacggtttaccgtaacggtttaagttttttaacttacgtttacgttaccgtaaacgggttactaaaggtttaaaccttaaaggtttcccgggttaacggttacccgggtttaccgggtaaccggggttacccgggtttaaaccgggtaacccgggtaaaaccggggttaaaccgggttaagggaaccgggtttaaaaaaccggttaaccccgggtaaaaggttaaccgggttaccggtaacggtcccggttaactacccggttacttaccggtagtttacccggtttaccttaaccggttccccg

SEQ ID NO: 185509 - DNA, 695 bp, Homo sapiens
  misc_feature: GYAE6OF02H0GON.14.23.C01.1.454.CMB.1.raw
  modified_base (204)..(204): a, c, t, g, unknown or other
  misc_feature (204)..(204): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgcccaccctctcctgcgagggccagtcagagtgttaagaagctaacgttacgcctggaccagcaagaaacctggccaggcctcccgaggtccttcctctatctagtggtcgcacgtccacgacggcctacgtcgtcgcccagccgtaggttcaggtcggcgtaggtcgggtacgtaggggaactaggtacgttaccacgttctaccgaacctacgtcgacgcctacgcctaggctacggttacttaaggtaacgttgtttgtacctttaagtttttaagtttatttagtaccgtacgtactaaacggttaatttaaaccgttaccggttccggtaccccgttacgggtacgggtaacccggtttaccgggaaaccggtaaacgggtaaccgtaagggtacggtaaactaaccggaaaccggttacgtacgggttcggaccgtacgtaccgtaccgttattacccggtttactttcccttacgttacccg

SEQ ID NO: 185510 - DNA, 643 bp, Homo sapiens
  misc_feature: GYAE6OF02GZG0L.14.23.C01.1.454.CMB.1.raw
  modified_base (238)..(238): a, c, t, g, unknown or other
  misc_feature (238)..(238): n is a, c, g, or t
  modified_base (507)..(507): a, c, t, g, unknown or other
  misc_feature (507)..(507): n is a, c, g, or t
  modified_base (584)..(584): a, c, t, g, unknown or other
  misc_feature (584)..(584): n is a, c, g, or t
tcagcgtctagtaccacgaccggtgctcgatttagtacacgtgattagggattgggggaggaactgctcagttaggacccagacggaaccatggaacgccccagcgcagcttcctcttcctcctgctactctggctcccagataccactggaagaaatgtgatgacgcagtctccagcccaccctgtctgtgtctcgaagggaaagcgcccacctctcctgcgacgggccagtcaggngtagttagaagcaacgttcgcctacggtacagacaacgaaaccgtcggaccgagcctacccgaggccctcctccgattaccgtagttcggcacctacctacccgaacggcgggaccctacgggtacgtccgtacccgacggtcccgtaggttcgaggtcggcgtacgggttgggtcgtaggacgtaagtcgttctacgtcacgactacgtcagcacgtccgagctacgtcgtaagtattagtttagagtttactttaagttagttacgntagtacttaggttaataacgttacgtcgtcctacgggtagtaccgtacggaacgaaagggtaccgtaagtacgtaanaacgtaaacggtagtaggtcgaacggtcaccgtacgtagttcgtacgttccgtatcccg

SEQ ID NO: 185511 - DNA, 808 bp, Homo sapiens
  misc_feature: GYAE6OF02G0E1A.14.23.C01.1.454.CMB.1.raw
  modified_base (153)..(153): a, c, t, g, unknown or other
  misc_feature (153)..(153): n is a, c, g, or t
  modified_base (161)..(161): a, c, t, g, unknown or other
  misc_feature (161)..(161): n is a, c, g, or t
  modified_base (223)..(223): a, c, t, g, unknown or other
  misc_feature (223)..(223): n is a, c, g, or t
  modified_base (504)..(504): a, c, t, g, unknown or other
  misc_feature (504)..(504): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggcctcccagataccactggaanaaatagtnaagtcggacgcagtcctccgagcccacccgtgtctagttcgtccgtacggaaggggaaaacncgacccctaccgtctcctgacgacgggccagtacaggtagttagtaacggaactactaacgttacgcgtacggtacacgcaagtaaccgcgacgagccgtaccgagccctactcatccgtaagcggtcgcgtaccaccgtaaccgccgggactaccggttcggtaccgtaccgaccgaccgttaacgttccgtaaaggtcggtatacggggttcgggtaccgttaagggacccggtagtaaccggttacttaccccgaccgtaccctaacggtaaaccctnacccggacgtacccgtaccgtaccggtaacggtaccgtagttaacggtaacggtttaaccgttacgttacttttaaaggttacgttttacgtttccgaataacggtaacgtagttaaaacccgttacgtaacgttacgggtaccgtttacgggttaaccggttacgggtaacccggaaccgggtaacggtaaacgggttaacgtaaggtaaacccgtaaccggtaaacggttaacggtgttaaccggtaccggtagaacccgtacggtaccgttttacggtcctttaaccggttacccttaccc

SEQ ID NO: 185512 - DNA, 656 bp, Homo sapiens
  misc_feature: GYAE6OF02JU80Y.14.23.C01.1.454.CMB.1.raw
  modified_base (213)..(213): a, c, t, g, unknown or other
  misc_feature (213)..(213): n is a, c, g, or t
  modified_base (319)..(319): a, c, t, g, unknown or other
  misc_feature (319)..(319): n is a, c, g, or t
  modified_base (638)..(638): a, c, t, g, unknown or other
  misc_feature (638)..(638): n is a, c, g, or t
tcagcgtctagtaccacgaccggtgctcgatttagtacacgtgattagggattgggggaggaactgctcaggttaggacccagacggaaccatggaagccccagcgcagcttctcttcctcctgcctactctggctcccagactaccactgggagaaatagtgatgacgcatcgtccagcccaccgtgtctgtacgtcctccgaaggggaacncgacccacccttctcctgcgaacgggtccagtcagtacggtgtaacgagtaccaattggcctggtaccagacaacgacgtggacacgtcctaccgagtcctcctanacgttctagtcggtcacgctcccgacgacggtcctacgtgggtacacccgtcgtacccgtaggttcacggttcgcgtaggggttcggtggtaggaacgtggtacttcacgtcctaccgacgttcgaacgacgtcgaccgacgtcgtacgtgtacgttataggttacgtttacgtgttaatttcgttacgtacgtacgtcgtaagtacgtaagttactaacggtcgtaccggtcggtacggttacggtacgtaacggaacgttaacgtacggtagttaacgacgtaacggttacgtaggccgtagtaccgactaccggtntaccgtcgtctaccgtcg

SEQ ID NO: 185513 - DNA, 657 bp, Homo sapiens
  misc_feature: GYAE6OF02I908T.14.23.C01.1.454.CMB.1.raw
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
  modified_base (257)..(257): a, c, t, g, unknown or other
  misc_feature (257)..(257): n is a, c, g, or t
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (333)..(333): a, c, t, g, unknown or other
  misc_feature (333)..(333): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatgtgatgacgcagtctccagccaccctgtctgtgtctaccgagggaancgcccaccctctccgtgcagggccagtcagtagtgtagancgaacttgcctgacngcagaacngcngctccagctcnatcagtgncacnccgacncggccacgtgtcgtcccagccgagttcagtcgacgnggtcggtcgagggacagtcgtacacttcacccactactacgtagcccacggtccctagaccgttacgtacgttaaggtaacgtttagttttacggtacgttttaacgttttagtttaactttcggtacgtaaacgtcttaaaggttacttaaaacgttaccgttacgggtaccccgttacgggtccgggttaaccgttacccggggaacgttaaaccggggaaccgttaaaggggtacgtaaaaccgtaaggtaaaccgtaccggttaaggccgttaccgtacgacccggttactaccggttctccgtttaccttaccgtaccg

SEQ ID NO: 185514 - DNA, 954 bp, Homo sapiens
  misc_feature: GYAE6OF02JP0UN.14.23.C01.1.454.CMB.1.raw
  modified_base (114)..(114): a, c, t, g, unknown or other
  misc_feature (114)..(114): n is a, c, g, or t
  modified_base (160)..(160): a, c, t, g, unknown or other
  misc_feature (160)..(160): n is a, c, g, or t
  modified_base (167)..(167): a, c, t, g, unknown or other
  misc_feature (167)..(167): n is a, c, g, or t
  modified_base (242)..(242): a, c, t, g, unknown or other
  misc_feature (242)..(242): n is a, c, g, or t
  modified_base (899)..(899): a, c, t, g, unknown or other
  misc_feature (899)..(899): n is a, c, g, or t
tcagcgtctagtaccacgaccggtgctcgatttagtacacgtgattagggattgggggaggaactgctcgagttaggacccagacggaaccatggaagccccagcgcagcttcncttcctcctgctactctggcctcccagataccactggagaatagtnatcgacnctagtctaccagccacccttgtctgtgtccgtacgaaggggaatacgccctacctctccgtgccgacgggtaccngtacgacggtacggttagttaagaacgtaccgtaaacgtttcgaccgttacggttaaccgacggtcccgtaaaccggtaaaccgcggtaaccccgaaggttacccccaaccggtagggtcccctacccttaaccgacgttacctttaacggggtcggttaactaccggtaccccgtaaccccgggaaccgtacccggggtaccttacccggggttacggtcccccgtaacgtaacccgggtcggttaacgtacccgggttaggtacggttacccggtagggggtttacccggcggtaaaccgggtaacgtttaaccgggtacccttaaacgttccccggggtaaaaaccccttaccgttttaccaaccgggacggttaaacccgccggtttcccgaaaccggttaccgttacgggtaaccctttaaagggttaaggtacccgttttaaaggttaccccggtttaagtttaacgtttaccgtttaaacgtccggaacgttaaacggttaactaaaggttaacgttacccggcggttaaaccccgggtttggttaaccccggtttacggttaacccgggtaaccggttaacccggttaaaggaaccgttaaaccgtacgaacgtttaaccggcgttaaaccgtttacggacggtttacncccggttaaccgtttacgtacgtttaccggtctttaacccggttccctaacccgg

SEQ ID NO: 185515 - DNA, 727 bp, Homo sapiens
  misc_feature: GYAE6OF02I60IF.14.23.C01.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
  modified_base (276)..(276): a, c, t, g, unknown or other
  misc_feature (276)..(276): n is a, c, g, or t
  modified_base (313)..(313): a, c, t, g, unknown or other
  misc_feature (313)..(313): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaangccaccctcncctgcgagggccagtcagngtagttagaagctaacttacgcctggtaccagcaagaacccgnggccaggtcctacccgaggcctcctcatctagtggtnactactccgaccgacgggcctacgttgggtacctacccagtcccggtaggttcaggtcggcgagggttcgggtccgtagggactaggtacgttacctccgtactaccgaccctagtccgaacgtccgtaccgtccgtaggtccgtagtaccgtagggtaaacgttacgttttacggtacgtttaaggttttaactttaacgtttcggaacctacggtttactaaacggttaaactttaaaccggtaacgttccgggtttaacccgtccgggttaacggggttaccgttacccgggtaaacggtaaccgggtaacggttaaagggtacggtaaaacgtaaccggtaaaaccggtacggtaacggttacgacgttaacgacccttacgtaaccgttcgaactttctaccgttaacc

SEQ ID NO: 185516 - DNA, 810 bp, Homo sapiens
  misc_feature: GYAE6OF02GUW8C.14.23.C01.1.454.CMB.1.raw
  modified_base (208)..(208): a, c, t, g, unknown or other
  misc_feature (208)..(208): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggcctcccagataccactgggaagaaatagtgatgacgcagtctccagccaccctgtctgtgtctccgaaggggaaancgcccaccctctcctgccgacgggccagtcgagtagttagttaagaacgtacctaacgttacggcctacgggtaaccaacggtaccgaaacggtaaaacccgtcgggaacccgtaacggtcccgtaccccgaaggtccccttaccgtacctaacgttacctaaggttcgggtcgacctaacctacccgaaccgggtaacggtccctaacggttcgggttcccggtaccccgacggttacccggtaagggttccgtaaacgggtcggtacgtacggggttcgggttaccggttacggggaactaacgggttacgttacccgtacttcccgtaaccaacccgttacgtaccgaacgccgtaccgtccgttacgctaggttactaggtaactttagtttcgacgtttaagttttatttcgtttacgctaagtactaagttaacgttaaacgtaccggtccggttaaccgttccgggttagggttaccggttaaccggaccgtaaaccggggttacgaagggttaaccgaaactttaaccgggaaacgttcggttaggacgtaacgtccgacctaacgtaccgtttcgtcttacggtacttcccgg

SEQ ID NO: 185517 - DNA, 801 bp, Homo sapiens
  misc_feature: GYAE6OF02JTKXG.14.23.C01.1.454.CMB.1.raw
  modified_base (190)..(190): a, c, t, g, unknown or other
  misc_feature (190)..(190): n is a, c, g, or t
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
  modified_base (279)..(279): a, c, t, g, unknown or other
  misc_feature (279)..(279): n is a, c, g, or t
  modified_base (356)..(356): a, c, t, g, unknown or other
  misc_feature (356)..(356): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggcctcccagataccactggagaaatagtgatgacgcagtctccagccaccctgtctgtntcnccgagggaagngcccacctctcctgccagggccagtcagagtgtagaagcaacgttgcctaggtaccagacaacggaactggaccnggtacccaccgtaggtcctaccgtcagttactagtggcgtacctacgtcccaacggaccgggtcctacgtggtaccncccgaacggtccggtaacggttcgacggtggaccgacggggttcgggttacgtacggggtaccaagggtttaccgttaccggtacctaccgtacccggaaaccttcgggtaacctaccgggaacgtccgtaccggttaccgtaccggtaaccggttacggttaaacgggttaaacgtttacgttttaccggtaacgttttaaggttttattttaaaccgggtccgttaaacgtacggttaaactaacggtttaaacgtttaaaacgtttcccggtacgggttacccggttacccgggttaaggggttacccgtttaacccggaaacccgggtaaaccgggttaacggaaacggggtttacgtaaacgtaaccggtaaacggtaaccggttgggttaaccgacgttacgtaaccgaccttccggtacttacggttcccttacgccc

SEQ ID NO: 185518 - DNA, 722 bp, Homo sapiens
  misc_feature: GYAE6OF02GOILJ.14.23.C01.1.454.CMB.1.raw
  modified_base (202)..(202): a, c, t, g, unknown or other
  misc_feature (202)..(202): n is a, c, g, or t
  modified_base (392)..(392): a, c, t, g, unknown or other
  misc_feature (392)..(392): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctcgaggggaanacgccaccctctcctgcagggccagtcagagtgtagaagcaacttagcctggtaccagcaagaacctggccaggcctcccaggcctcctcatcctagtggtcgctacgtcccaccgacgggccacgtcggtcgtcccagtcccgtaggttccgaggttcggacgtagggttcggggtccgtacggggaanacgggttacgttcctaacgttccgtacctaccgtacttacggacgacgaccggtccttcggcctaacggttctaaggtaacggtttcttttcggaacgtttaagtttttagttacgtttcgtacgtagtacgttaagttaacgttaaacgttaccggttccggttcccgtttaaccgggtcgggttttaacccggtacgggtaaacccgggaaagggttacccggtaaagggttacggtaaactaaccggtaaaaacccggtagttacggtacggtaccgttacggaaccctacggtaccgttaccgttacgtttcctaaccgttacccg

SEQ ID NO: 185519 - DNA, 859 bp, Homo sapiens
  misc_feature: GYAE6OF02GY5CF.14.23.C01.1.454.CMB.1.raw
  modified_base (227)..(227): a, c, t, g, unknown or other
  misc_feature (227)..(227): n is a, c, g, or t
  modified_base (347)..(347): a, c, t, g, unknown or other
  misc_feature (347)..(347): n is a, c, g, or t
  modified_base (377)..(377): a, c, t, g, unknown or other
  misc_feature (377)..(377): n is a, c, g, or t
  modified_base (459)..(459): a, c, t, g, unknown or other
  misc_feature (459)..(459): n is a, c, g, or t
tcagcgtctagtaccacgaccggtgctcgatttagtacacgtgattagggatttggggaggaactgctcagttaggacccagacgaaccatggaagcccagcgcagcttctcttcctcctgctactctcggcctaccagactaccacgtggaagaaatggtgaatcggaacctcgagttcctaccacgccctaccctgtctcgtacgtccgtacggaaggggaaacncggtaccctaccgtctcctcgacgaccgggaccagtcgtaggtagttacgttaagaacgacctaacgttacgccgtacggtaccaagtacaaacggtaaccgtcggaccgtacggtaccnccgacgtcctaccgtctacgtactttaggnggtaccacgttaacccgtccgaaccgggtacggaccctaccgtcgggtaccctccggtaaccgtccggttacgggttaacgnggttaccgggagttccggggggtttacggtaccgggaacgggtaacccggtagttaccgggtacccttacccgtaccgttacccgaaacggtccaacgttccgtaaccggtaccgtcccggttaacgggtaacgtccggttaaccggttaaggtttaactttaccgggtttacgttagttttaacgtttaacggtttttagtttccggttaacgactttaaacggttaagttaacgtttaaccggttaccgtacccggtaccgtttaaccggggtacgttacccgggtaaccgggtaccgtaaacggttaacgggtaacggtagtaaaccggtaacgtaacggttacgggtacgtacgacgtccgaacgtccggttataccggttcttacgtattccccg

SEQ ID NO: 185520 - DNA, 818 bp, Homo sapiens
  misc_feature: GYAE6OF02G58GU.14.23.C01.1.454.CMB.1.raw
  modified_base (204)..(204): a, c, t, g, unknown or other
  misc_feature (204)..(204): n is a, c, g, or t
tcagcgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgcccaccctctcctgcgacgggccagtcagagtgttaagaagctaacgttagcctaggtaccagacagaaaccgtggaccgacggcctccccgaggcctcctcactcgtagtcggtacgctacgtcccaaccggacgggcctacgttcgggtccgtaccccaggtacccgtagggttaccaggttcggaccggtaggggtttcggggtccgttagggggaactacggttacgtttaccgacttaccgtaccgacccgtataccgacggtcgaaccgtcccgtaggaccgtacggttaccgtaaaggtaaacggtttacgtttttacggaaccgttttaaggtttttaagtttttacgttacggttaacttacgttaccggttaaagtttaaaccttaaacggtttaccgttcgggtttaccccggttaaccggggttaccgggttaaccgggtttacccgggaacccggttaaaacgggggtaacccgttaaacgggggttaacggtaaaaccggttaacccggtaaaacgggttaaccggttacgggaccggttaccgtacggtaaccctaaccgttagttacccgtttacggttaccgttaccgttcccg

SEQ ID NO: 185521 - DNA, 740 bp, Homo sapiens
  misc_feature: GYAE6OF02GJWZE.14.23.C01.1.454.CMB.1.raw
  modified_base (176)..(176): a, c, t, g, unknown or other
  misc_feature (176)..(176): n is a, c, g, or t
  modified_base (210)..(210): a, c, t, g, unknown or other
  misc_feature (210)..(210): n is a, c, g, or t
  modified_base (479)..(479): a, c, t, g, unknown or other
  misc_feature (479)..(479): n is a, c, g, or t
  modified_base (490)..(490): a, c, t, g, unknown or other
  misc_feature (490)..(490): n is a, c, g, or t
  modified_base (497)..(497): a, c, t, g, unknown or other
  misc_feature (497)..(497): n is a, c, g, or t
tcagcgtctagtaccacgaccggtgctcgatttagtacacgtgattagggattgggggaggaactgctcagttaggacccagacggaaccatggaagccccagcgcagctctcttcctcctgctactctggcctcccaagactaccacgtggaagaaactagtgatgacgcagtcnccagccacctgtctgtcgtactcgaaggggaaancgccctacctctccgtagcgtaagggcctaggtagacgtagttagttaacggaacgtaccaacgtttaacgccgttacggaaccaggtacgaaacgtaaccgtcggacacggtcctaccgaggtcctcctagtaacttcgtagtcggtaccggtaccaaccgttcccgaaaccggcggtacctaacggttccggttacggacccctaagttccccggaggtttcgaacgcggtacgtaggtcgtacggtaggtacaggttactctaacnccgtacacgtntaacggngaccgtacgtaccgtacgactcggtacgtagtaacttagttacgtacgttactttagttacgtattacgagtaatacgtaacgttaacgtaaccgtgtaaccgttccggtaaggtaccgggttaccgtaaccggaacggtaaccggtaacggttaacgtaacggaaacggtaactaacggtacggttaacggacgttaccgaccttaaccgtaccggttactacgggttacctacgttacccg

SEQ ID NO: 185522 - DNA, 804 bp, Homo sapiens
  misc_feature: GYAE6OF02HKDOI.14.23.C01.1.454.CMB.1.raw
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
tcagcgtctagtaccacgaccggtgctcgatttagtacacgtgattagggattgggggagaactgctcagttaggacccagacggaaccatggaacgccccagcgcagcttctcttcctctgctactgtgctccagactacactggaataaatgtgatgacgcagtctccagccctaccgttgtctgtcgttacaccggaaaggggaactccgaccctaccctctaccgnggaccncgggacctagtcgagtagttacgttaacgacgtacctaacgttagccgttaacggaaccagacgaaacggtaaacctcggaccgacggtcccgtaccgtaggcccttacccagttactcgtagtcggtacaccgtactacccgacgacggtcctacggtgtcctacccgacgccgtacgttcgtacggtcgaacggtcgggtcggttcggaaggactacggtacttcaccttacgaccgaactcgttacgacgtcgtacgtcgtacgtcgtagttacgtacgttaacgttacgttagttacgtttaagtttatttagttacgtacgtacgacgttttttttttaacgaacgtttaaacgttaccggttaccgttaccggttaaccgggttaccggttaccgggtaaccgggtaaccggtaaaccgggtaacggtaacgggttaaccggttaaacggtaaaccggttaaaccggttaaccggttccggttaacggtaccggttaaccgtacccggttaaccgtaccgtttaaccggttttaccgtttaccgttacccgtttaaccccgg

SEQ ID NO: 185523 - DNA, 711 bp, Homo sapiens
  misc_feature: GYAE6OF01CYKG8.18.85.H08.1.454.CMB.1.raw
tcagtacgagtatgcacgaccggtgctcgatttagtatcactcagtcgcgggggccccagccctgggattcccagctgtttctgcttgctgatcaggactgcacacagagaactcaccatggagtttgggctgagctgggttttcctcgttgtcttttttaaaggtgtccagtgtgaggtgcagctggtggaagtccgggggaggcttagttcagccgtgggggtccctgagactcctcctgtgcacgtcctcgtggtacttcgtagtttcagtcgtcctacgtggatcgactacgtggtactcccgacctaacggttccggaagggtaagacgtacgtgggtggtcgggtctaccgtaacgttaattaaagagtaggtaggtgggggtacaccgaacgtacgttacccgtaaccggccggtaaccgttccgggtagggaccgggggcccgtccgttaccgaccctacgtcccgtacccggaacgtaacccaaaccaaccgaacgaaccgacgtcgtagtactcagaactaagtgacgacgtagtcggtagggacgtacggacggaccgacggtcttcggttacttaacgtttcgtggtacgacggtaaagggacggggtaacgtacgggtcgtacccggtaacggggtcggggttaccggcccggtaccccgggtagggggacccgaaccggggtacccgtggtaccccg

SEQ ID NO: 185524 - DNA, 284 bp, Homo sapiens
  misc_feature: GYAE6OF01CEICQ.18.85.H08.1.454.CMB.1.raw
  modified_base (266)..(284): a, c, t, g, unknown or other
  misc_feature (266)..(284): n is a, c, g, or t
tcagtacgagtatgcacgaccggtgctcgatttagtatcactcagtcgcgggtctagagacaaatttcactctacaccatcaccaacctgcaggctgaagatgtggctagttttatttctgtcagcaactatttttggtattccgatccaccttcggccaagggacacgactggagtaattaaaagactgtggctgcacatctgtcttcatctccgcatctgacatactcgtactgacgcgggctggacaaagggtcacattaggnnnnnnnnnnnnnnnnnnn

SEQ ID NO: 185525 - DNA, 689 bp, Homo sapiens
  misc_feature: GYAE6OF01CP6HN.18.85.H08.1.454.CMB.1.raw
  modified_base (345)..(345): a, c, t, g, unknown or other
  misc_feature (345)..(345): n is a, c, g, or t
  modified_base (357)..(357): a, c, t, g, unknown or other
  misc_feature (357)..(357): n is a, c, g, or t
tcagtacgagtatgcacgaccggtgctcgatttagtatcactcagtcgcgggggccccagccctgggattcccagctgtttctgcttgctgatcaggactgcacacagagaactcaccatggagtttgggctgagctgggtttttcctcgttgtctttttttaaaggtgtccagtgtgaggtgcagctggtggaagtccgggggagcttagttcagccgtgggggtccctggagactctcctgtgcagcctcgtggattcagtttcagtcgcctagtggatgcacgtggactccgcctaagttccgaagggaatagacgtggtgtgggtactcgagttataaagntggagtggggtnaccacgatccgtacggccggtaacgtccggtaggaccgggggtccctaccgttaccgaccctacgtcccgtacccgaacgaacccaaaccgaacccgaaacgaaccaaccggtctagttaactcttacgactaaagtcgagtaccgagtcgtagggaacgtacgaagggtaccgaacgggtcccttaggttacctttaacgttcgtagttacgggaacgaaacgggtaacggggaccgttacgggtaccggtaccggttacggggtaacggggttccggtacccggtaccccggtacggggacccggtaaacgggtccccggtggtaccccg

SEQ ID NO: 185526 - DNA, 560 bp, Homo sapiens
  misc_feature: GYAE6OF01EAQ8F.18.85.H08.1.454.CMB.1.raw
  modified_base (166)..(166): a, c, t, g, unknown or other
  misc_feature (166)..(166): n is a, c, g, or t
  modified_base (303)..(303): a, c, t, g, unknown or other
  misc_feature (303)..(303): n is a, c, g, or t
  modified_base (333)..(333): a, c, t, g, unknown or other
  misc_feature (333)..(333): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (380)..(380): a, c, t, g, unknown or other
  misc_feature (380)..(380): n is a, c, g, or t
tcagtacgagtatgcacgaccggtgctcgatttagtatcactcagtcgcgggggccccagccctgggattcccagctgtttctgcttgctgatcaggactgcacacagagaactcaccatggagtttgggctgagctgggttttcctcgttgctttttttaaaggngtccagtgtgaggtgcagctggtggaatccgggggagcttagttcagcctgggggtccctgagactctcctgtgcagcctctggattcagtttcagtgcctactggatgcactggactccgccaagttccagggaanagactggtgtgggtctcgacgtattaaagntggatgggggtnccanatccctacgcggactccggtggacggggccncttcacctatcctacccgagaccaacaccaagaacacgctgtatctagacaaatgagcagtcgtgggacgtcgaggacacggtctgtctattacgtgtgacgaaggagggacgtacggtgaccgtacgggaggggttcgaccggtacccgtggggacccacggggacccgtgggtacccg

SEQ ID NO: 185527 - DNA, 700 bp, Homo sapiens
  misc_feature: GYAE6OF01BO024.18.85.H08.1.454.CMB.1.raw
  modified_base (168)..(168): a, c, t, g, unknown or other
  misc_feature (168)..(168): n is a, c, g, or t
  modified_base (274)..(274): a, c, t, g, unknown or other
  misc_feature (274)..(274): n is a, c, g, or t
  modified_base (356)..(356): a, c, t, g, unknown or other
  misc_feature (356)..(356): n is a, c, g, or t
  modified_base (504)..(504): a, c, t, g, unknown or other
  misc_feature (504)..(504): n is a, c, g, or t
tcagtacgagtatgcacgaccggtgctcgatttagtatcactcagtcgcggggccccagccctgggattcccagctgtttctgcttgctgatcaggactgcacacagagaactcaccatggaggtttgggctgagcgttgggttttcctcgttgtcttttttaaaggngtccagtgtgaggtgcagctgggtggaagtccggggagtcttagtcgaggccgtgggggtcctgacgtactctctgtgcagtcctgtggtattcgagtttcagtcncctatggatgcacgtcggactccgactaacgttccgaagggaagacgacgtggtgtcgggtactacgtaacgtaattaaagngttagtagggtcggggtcaccgaatacgtcccgtacggaccggtaccgttcggtaggacggggtccctacgttccaacctacgtccgaaccgacgaaccaacgaaccgaacgaacacgtctagtactacgtacgactaaagtcgacgngtaacggtcgtagggtacgacgaacggtacgaccggtctacggttacttaacgttacggagttacggaacggtaaacgggtaaacgggtaccggtaaccgggttacggtaacccggttacgggggtaccggggtttaccggacccgggtacccgggtcggggaacccgtaacccggggtacccgtcgggtaccccg

SEQ ID NO: 185528 - DNA, 658 bp, Homo sapiens
  misc_feature: GYAE6OF01APSJI.18.85.H08.1.454.CMB.1.raw
tcagtacgagtatgcacgaccggtgctcgatttagtatcactcagtcgcgggggccccagccctgggattcccagctgtttctgcttgctgatcaggactgcacacagagaactcaccatggagtttgggctgagcttgggttttcctcgttgtcttttttaaaggtgtccagtgtgaggtgcagctggtggaagtccgggggagcttagtcagccgtgggggtccctgagctctcctgtgcagcctctggtattcagtttcagtcgcctacgtggatgcactggactccgactaagtccgaagggaagagacgtgggtgtgggtctacgtaacgttaattaagataggtaggtgggggtacaccacactcccgtacgcggactccggtaggacgggggccctcgttaccaccgactcccgtacccgagaaccaaaccgaaccaaggaaccacgctagtactctacgacaagtgagcgtaggtcgtagggagtcggacggaacacgggtactgttacttaattacgtggttacgacgtaaagggacggggtaaccgttacggggtcggtaacccggttacgggggtacgggggtttaccggcccgggtacccccggttagggggaccccgtaacggggaaccccgttcggggtacccc

SEQ ID NO: 185529 - DNA, 590 bp, Homo sapiens
  misc_feature: GYAE6OF01BUPQX.18.85.H08.1.454.CMB.1.raw
  modified_base (336)..(336): a, c, t, g, unknown or other
  misc_feature (336)..(336): n is a, c, g, or t
  modified_base (347)..(347): a, c, t, g, unknown or other
  misc_feature (347)..(347): n is a, c, g, or t
  modified_base (390)..(390): a, c, t, g, unknown or other
  misc_feature (390)..(390): n is a, c, g, or t
tcagtacgagtatgcacgaccggtgctcgatttagtatcactcagtcgcgggggccccagccctgggattcccagctgtttctgcttgctgatcaggactgcacacagagaactcaccatggagtttgggctgagctgggttttcctcgttgtctttttttaaaggtgtccagtgtgaggtgcagctggtggaagtccgggggagcttagttcagccgtggggggtccctgagactctcctgtgcagcctctggattcagtttcagtgcctactggatgcactggactccgccaagttccgagggaagagactggtgtgggtctcacgtattaagntggagtggggnccacactccgtacgcgactccggtggacggggcctcttcaccnctcctcccgagaccaacaaccgaagaaccacgctagtatctagacaaagtgagctaggtctaggggagtcggaaggaccacgggtctgttcttagttactgagacgaagggacgggtacgtacgggtgaccggttacgggtaggggttccggacccggtaccccgggtgggggacccacggggtacccctgggtaccccg

SEQ ID NO: 185530 - DNA, 655 bp, Homo sapiens
  misc_feature: GYAE6OF01D8E64.18.85.H08.1.454.CMB.1.raw
  modified_base (165)..(165): a, c, t, g, unknown or other
  misc_feature (165)..(165): n is a, c, g, or t
  modified_base (311)..(311): a, c, t, g, unknown or other
  misc_feature (311)..(311): n is a, c, g, or t
  modified_base (340)..(340): a, c, t, g, unknown or other
  misc_feature (340)..(340): n is a, c, g, or t
tcagtacgagtatgcacgaccggtgctcgatttagtatcactcagtcgcggggccccagccctgggattcccagctgtttctgcttgctgatcaggactgcacacagagaactcaccatggagtttgggctgagctgggttttcctcgttgtcttttttaaaggngtccagtgtgaggtgcagctggtggaatccgggggagtcttagttcagccgtgggggtccctgagctcctcgtgtgcagcctctggattcagtttcagtgcctactggatgcacgttggactcccgacgtaagttccgagggaacngacgtggtgtggtctacacgttataaagntgagtggggtcaccacgtaactccgtacgcggacgtccggtggacggggtcctcgttacacctagtccgtaccgacgtacaaacgaccaacgactacgacttagtactcgtacgacaaacgtgacgacgtaggtacgtaggacgtcgaaggtaccacgggtactacgttcttaacgttacgtacgtaggtacgaaacggtaggggtaaccgttaccgggtaggtaccccgttaaggggaccggggtttacgggtcccccgggtaacccggttacgggggaaccctaaccgggggtaccctcgggggttaaccccc

SEQ ID NO: 185531 - DNA, 266 bp, Homo sapiens
  misc_feature: GYAE6OF01CH4YJ.18.85.H08.1.454.CMB.1.raw
  modified_base (263)..(266): a, c, t, g, unknown or other
  misc_feature (263)..(266): n is a, c, g, or t
tcagtacgagtatgcacgaccggtgctcgatttagtatcactcagtcgcgggtctgagacaaatttcactctcaccatcaccaacctgcaggctgaagatgtggcagttttatttctgtcagcaactatttttggtattccgatccaccttcggaccaagggacacgactggagaattaaaagactgtggctgcaccatctgtcttcatccttcccgcatctgacatactcgtactgaggcgggctggacaaggcgtcaatgnnnn

SEQ ID NO: 185532 - DNA, 803 bp, Homo sapiens
  misc_feature: GYAE6OF01EA809.18.85.H08.1.454.CMB.1.raw
  modified_base (177)..(177): a, c, t, g, unknown or other
  misc_feature (177)..(177): n is a, c, g, or t
  modified_base (191)..(191): a, c, t, g, unknown or other
  misc_feature (191)..(191): n is a, c, g, or t
tcagtacgagtatgcacgaccggtgctcgatttagtatcactcagtcgcgggggccccagccctgggattcccagctgtttctgcttgctgatcaggactgcacacagacgaactcaccagtgggtaggtttgggctgagtcgttgggttttcctcgtttgttacttttttaaaggngtcagtgtgaggtncagtcgtgggtaggaacggtccggggggagtctttaggttccgagggtcccggttcggggggtacccctggacgtaccttcctccgtggtcgcctagtcccttcgttaggtacttcgtagttttaccgagtccgtaccttacgtggtactgacctacgttcggaacctccccggaaccgtaaacggttaccggaaggggtaagaacggtccggtttaggggttcggtacggttcctaacgtaaacgtttaaaggttaaaggtgttaagggtacggggttcggggacctaccgtaacctacggtaccccggtaccggaccgggttaccggttaccgggtcggggtaaccgggtccccgttaccgttaccaaccgtaccgttcccggaaccccgaaacggaaccctaaacccgaacgaaaccgtaccgacgttactacgttactacgtacgaactaagtcgaacgtccggtaaggttcggtagggtaacggcgggaacggaccgtcgggtactttacgtacttaagtccggtagacgggtaaccgagtacggtgtacgggtggaccggtaggactggtacggtcgtacgggacggacggtacggcccgtaccgg

SEQ ID NO: 185533 - DNA, 580 bp, Homo sapiens
  misc_feature: GYAE6OF01A4WSR.18.85.H08.1.454.CMB.1.raw
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
tcagtacgagtatgcacgaccggtgctcgatttagtatcactcagtcgcgggggccccagccctgggattcccagctgtttctgcttgctgatcaggactgcacacagagaactcaccatggagtttgggctgagctgggttttcctcgttgtctttttttaaaggtgtccagtgtgaggtgcagctggtggaatccgggggaggcttagttcagccgtggggggtccctgagactctcctgtgcagcctctggattcagtttcagtgcctactggatgcatggatccgccaagttccagggaagagactggtgtgggtctcacgtattaaagatgagtggggtnccanatcctacgcgactcggtgacggggccncttcaccntcctcccgagaccaacaccaagaccacgctagtactctagacaaatgacgcagtcgtgggagtcggaggacacggtctagtctagttactgtgacgaaaggacggggtactacgggtgacccggtacgggtacgggggttcggacccggtacccccggtgggggaccccgaacggggtaccccgttgggtaccccg

SEQ ID NO: 185534 - DNA, 668 bp, Homo sapiens
  misc_feature: GYAE6OF01EQ73V.18.85.H08.1.454.CMB.1.raw
  modified_base (316)..(316): a, c, t, g, unknown or other
  misc_feature (316)..(316): n is a, c, g, or t
  modified_base (342)..(342): a, c, t, g, unknown or other
  misc_feature (342)..(342): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (384)..(384): a, c, t, g, unknown or other
  misc_feature (384)..(384): n is a, c, g, or t
  modified_base (531)..(531): a, c, t, g, unknown or other
  misc_feature (531)..(531): n is a, c, g, or t
tcagtacgagtatgcacgaccggtgctcgatttagtatcactcagtcgcgggggccccagccctgggattcccagctgtttctgcttgctgatcaggactgcacacagagaactcaccatggagtttgggctgagtcttgggttttcctcgtttgtctttttttaaaggtgtccagtgtggagtgcagctggtggaagtccggggagcttagttcgagccgtgggggtccctgacgctctcctgtgcagcctcgtggattctagttttcagtcgcctagtggatgcagtggactccgacctaagtccgagggaagngacgtggtgtggtctcagttataagntgagtggggtcnccganacgtccgtacggccggtactccggngggacgggtccctcgttaccgacctacgtcccgtacccggaagtaacccaaaccaaccgaaacgaaccgtacgacgttacgtactacgtagaaccgtaaagtcgacgacgtacggttacgtgggacgtacggacggacgtaccggtnttacggttactagtttacgcggtacggtaacgaagggtaacgggtaccgtacgggttccggtaccggtacgggtaacggggttccggaccccggtacccgggtcggggacccgtaccgggtacccgtcggtaccccg

SEQ ID NO: 185535 - DNA, 678 bp, Homo sapiens
  misc_feature: GYAE6OF01BLNSV.18.85.H08.1.454.CMB.1.raw
tcagtacgagtatgcacgaccggtgctcgatttagtatcactcagtcgcgggggccccagccctgggattcccagctgtttctgcttgctgatcaggactgcacacagagaactcaccatggagtttgggctgagctgggttttcctcgttgtcttttttaaaggtgtccagtgtgaggtgcagctggtggaagtccgggggagtcttagttcaggccgtgggggtcctgagactctcctgtacagtctctggacttccaccgttcctcctacttttgcctagtcggtccgttcggggtcccggccgggtcctccggaaggggaacgggtccgtggggaggttcggggtcctccgtacgtagtcgaggtcgactacgttagggtaatgggacgtaagtaggactaaaggtcggtaccgcgacggtcgtccgggtgggacgggggtcgttaccaccgtagttacgcaaggacactaacttaccgaaagaaccgtacggttactaacgtactaaacaaatacgaaactacgcgtagaacgacgacccgagggaaccgaccggtcccgttagtttacgtttcgtggtgtagaaggtagtaacgttacgtaaaacctttcccgttagtactttcgtttgtacgtagttacgttgggtacgggaccgaagggtataggtccgg

SEQ ID NO: 185536 - DNA, 618 bp, Homo sapiens
  misc_feature: GYAE6OF01CG7HZ.18.85.H08.1.454.CMB.1.raw
  modified_base (168)..(168): a, c, t, g, unknown or other
  misc_feature (168)..(168): n is a, c, g, or t
  modified_base (261)..(261): a, c, t, g, unknown or other
  misc_feature (261)..(261): n is a, c, g, or t
  modified_base (329)..(329): a, c, t, g, unknown or other
  misc_feature (329)..(329): n is a, c, g, or t
  modified_base (361)..(361): a, c, t, g, unknown or other
  misc_feature (361)..(361): n is a, c, g, or t
  modified_base (377)..(377): a, c, t, g, unknown or other
  misc_feature (377)..(377): n is a, c, g, or t
  modified_base (399)..(399): a, c, t, g, unknown or other
  misc_feature (399)..(399): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
  modified_base (433)..(434): a, c, t, g, unknown or other
  misc_feature (433)..(434): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
  modified_base (453)..(453): a, c, t, g, unknown or other
  misc_feature (453)..(453): n is a, c, g, or t
  modified_base (458)..(458): a, c, t, g, unknown or other
  misc_feature (458)..(458): n is a, c, g, or t
tcagtacgagtatgcacgaccggtgctcgatttagtatcactcagtcgcgggggccccagccctgggattcccagctgtttctgcttgctgatcaggactgcacacagagaactcaccatggagtttgggctgagcttgggttttcctcgttgtctttttttaaaggngtccagtgtgaggtgcagctgggtggaagtccgggggagtcttagtcaggccgtgggggtccctgacgctctcctgtcgcacgcctcgtggtnttcgagttttcagtcgacctacgtggacttgcctacgtggactccgaccaaggttaccgagggaacgngacgtgggtagtcggtctacagttaataacgngtgaggtggggcacanactccgacggtcggtactcggnggcgggcctctcacntccacganacacacagacnnctnatcganacatgacgtngtcgnggacgtacgacggacgacggtctacgttatacgttagtggtacgacggtaacgggaacgggtacgtaccgggttagaccggttacggggtcgggttaacccgggtcccgtaccccggggtcgggaacccggtaccggggtcccgtccgggttaacccccg

SEQ ID NO: 185537 - DNA, 1068 bp, Homo sapiens
  misc_feature: GYAE6OF01BPW40.18.85.H08.1.454.CMB.1.raw
tcagtacgagtatgcacgaccggtgctcgatttagtatcactcagtcgcgggggccccagccctgggattcccagctgtttctgcttgctgatcaggactgcacacagagaactcaccagtgggtaggtttgggctgaggtcgtttcggggtttttccttcggtttaggtttacgttttttttaaacggtcgttaccgtaggttggtaggtagggttgcgaggtcggtggggtaggggtaaacgggtcccgggggggtaggttaccgtttaacgggtttccgaacgggtcccgggttcggggggggttccccctagggaacgttaccgttccttcccggttaggtcggccgacggtcccttcggttacgggttacttttccgtaaggttttccgtaggttccgttaccgtacgtaggtacttccggactaccggtaggtaacctccccggtaaccgttaacgggttaccgaaaaggggggtaacgtaacgggtaccggttggggttacgggtacgggtttaccgtaacgttaacggttaaagttaaaacggtggttaagggtacgggttgggggccctaacgtaacccgtaacggttaccccgtaacggggtaccgggtacccggttaaccggggtcggggtaccggggttaccccgtacttaccccggtaaacccgtacgtccccgggttaaccccgaaacggaaaccccgtaaaccgtaaaccggaaaccgtaaaccgtaacggttaccgtaacggttaactacccgggtaataaacccggtaaagttaccggtacggtaacccgggttaacggtcggggttaacgggtaaccggtacgggaacgggttaccggaaacccgggttcgtttaaaccggtttaacgttaaccggtttaacggtcgggtaacgggaaccggtaaacgggggttaaaccggggaccggttaaacggggttcccggtaaaccgggtttaccgggggggtacgggtttccccgggtaaccccgggaccccggggtttaacgggggcccgttaaaccgggggtcccgttaacgggtccccccg

SEQ ID NO: 185538 - DNA, 852 bp, Homo sapiens
  misc_feature: GYAE6OF01CA721.18.85.H08.1.454.CMB.1.raw
  modified_base (169)..(169): a, c, t, g, unknown or other
  misc_feature (169)..(169): n is a, c, g, or t
tcagtacgagtatgcacgaccggtgctcgatttagtatcactcagtcgcgggggccccagccctgggattcccagctgtttctgcttgctgatcaggactgcacacagagaactcaccatggagtttgggctgagcttgggttttcctcgtttgtctttttttaaaggngtccagtgtgaggtgcagctggtggaagtccgggggagtcttagtcaggccgtgggggtccctgacgtacttctcctgtgcacgtcctcgtggtactttccgtagttttcagtgtacccttacgtggatcggcacgtggacctcccgaccaacggtttaccagggggtaaacgacggtacgttgggttcgggtcgggttacctacgtaacgtttaaagttaaaaggtgttacgggtaagggttcggggggtaccgacccgaacgtaaccgttcccggttaacccggccggggtaaccccgtttccggggtacggggaccggggtccccgtacccgtttacccgaacccgtacgttccccgttaaccccgaacgaaacccaaacccgaaccaaacggaacccacggtacttaggtaacttcgtacaaccgtaacgtcggaacgtaccgtacggttacggtaaggggtcgtaacgggaaccggtaccgtaaccgggttccttaggttaccgttaagttaccggttcgttacgggaacgtaaacgggggtaaccgggttaccggttaccgggtaccggtaccgggtttaccggggtaccggggggttttacgggtacccccggtaacccccgggggtcgggggaccccgaacccgggggttaaaccccgttcggggttaacccccg

SEQ ID NO: 185539 - DNA, 865 bp, Homo sapiens
  misc_feature: GYAE6OF01A77UN.18.85.H08.1.454.CMB.1.raw
  modified_base (169)..(169): a, c, t, g, unknown or other
  misc_feature (169)..(169): n is a, c, g, or t
tcagtacgagtatgcacgaccggtgctcgatttagtatcactcagtcgcgggggccccagccctgggattcccagctgtttctgcttgctgatcaggactgcacacagagaactcaccatggagtttgggctgagtcttgggttttcctcgttgtacttttttaaaggngtccagtgtgaggtgcagctggtaggaacgtcgggggagtcttagtcacggccgtgggggtccctgacgctctcctggtgcagtcctcgtggtacttctagttcagtcgtaccgtacgtggacttcgactacgttcggacctcccgacgtaacggttccggaaggggaactacggtcggttggggtacggttcggggtacctacgtaaggttaacgttaaacggcgttacgggtagggttaccgggggtcaacccgtaacgtacgttaccccggtaacgggtacccggtaaccggttaccgggtacggggtaccggggtcccctaccgtttacccgaaccgtaaccgttacccggtacccgaaacggtaacccaaacccgtaaccggaaacgtaacccgtaacgtcgttaacgtacgtaccgtaagaacgtaaagtcgaacgtcgtacgggttacggagggtaacgtccgggtaaccggaccgttacgggtactttaccgttacggttaacttcgggtaggttaaccggaacgggtaaaggggttaccggggtaacccggtttacgggtaccgggttaacccgggtttaacgggggttacccgggggttacccgtaaacccccggggtaccccgggggttaccggggtaaccccggggtaaacccggggttaaccccgttcgggggttaacccccc

SEQ ID NO: 185540 - DNA, 829 bp, Homo sapiens
  misc_feature: GYAE6OF01B1FAT.18.85.H08.1.454.CMB.1.raw
tcagtacgagtatgcacgaccggtgctcgatttagtatcactcagtcgcggggccccagccctgggattcccagctgtttctgcttgctgatcaggactgcacacagagaactcaccatggaggtttgggctgagtcttgggttttcctcgtttgtactttttttaaagggtcgtccgagtgtgaggtgcagcgtggtgggaagtccgggggagtcttagtcgaggccgtggggtccctgacgtactctcctggtcgccacggtcctgtggtattccgagttttcgagtggtcccttaagttggaacttggacctacgtcggtacctcccgaccgtaacgttaccggaaggggaatacggacggttggttcggttacgggtactacctaaggttaagttaaagagttacggtaaggtgggggttacacccgtactaacgtacccgtaacggcggtacctccgggtacgggacggggtcctacttaccaacccgttgtccccgtaccgaacgaacccaaacgtaaccgaacgaaccgtacgtaccttacggtaactcgtactaaccgtaaagtacggtacgaccgtaggttacggtagggaacgttaaccgggaacggtaaccgtaccgggtacttacggtttaccgttaacgtttacggacgttacggtaaaccgggtaggggtaaacgggttacccggttaaggggttacccggtaacccgggttaccgggggttacgggggttaccccgggtacccgggtacccccggggggttaaccgggtaaccccggggtaaccgggttaccccggttcggggtaaaccccccg

SEQ ID NO: 185541 - DNA, 868 bp, Homo sapiens
  misc_feature: GYAE6OF01CZLRB.18.85.H08.1.454.CMB.1.raw
  modified_base (234)..(234): a, c, t, g, unknown or other
  misc_feature (234)..(234): n is a, c, g, or t
tcagtacgagtatgcacgaccggtgctcgatttagtatcactcagtcgccggggccccagccctgggattcccagctgtttctgcttgctgatcgaggactgcacacagaagaactcaccagtggtaggtttggctggagtcgtttcgggttttcctcgtttgttacgttttttaaaggtcgtccgagtgtgaggtgcagtgtggtaggacggtccgggggagtcttacggtcncggtccggtcgggggtccctggacgtaccttcgttccgtggtgccgtacgtccttcgtaggtactttccgtaagtttcgtacggtcgtaccctagtggaatcgacctacgtacggtacctcccggtaccgtaacggttacccggaagggtaacggacgtacggttcgggttcggggttaccggttcgtaaccgtaaacgtttaaacgttaaaaggtacgtaagggtaccgggtgggggtacccacccgaaacgttaacccgttacccggtaaccgggtacccggtacccgggtccgggtaacggggtcccggggtcccccgttacttacccgaacctacccggttacccgtaaacccgggaaactaaaacccgaaccgaaaaccgtaaccgacccgtatttacggtaacttaccgtacgaactaaacgttcggaaacgttccgtaagggttaccggtaacggggtacgtacgggtaaccgggacttaaccgggctttagtacgtttaacgttacgaggtacgacggtaaggacgggtacgtacggtcggtacggttacgggtacgggttcccgggacccggtacccgggtaccggggaacccgtaccgggtaacccgtcggtaccccgtacccg

SEQ ID NO: 185542 - DNA, 842 bp, Homo sapiens
  misc_feature: GYAE6OF01CPMKD.18.85.H08.1.454.CMB.1.raw
tcagtacgagtatgcacgaccggtgctcgatttagtatcactcagtcgcgggggccccagccctgggattcccagctgtttctgcttgctgatcaggactgcacacagagaactcacatggtagtttggctgagtcgttgggttttcctcgttgttactttttttaaaggtcgtcgtagtggtggaggtgacgagtcgtggtagggaaggtccgggggtagtcgttagttcgacggtccggttgggggtccctagacgtctctccgtgtcgcgacgtccttgtggtattcgtagtttcgagtcgtcctacgtgtagtcgtccgtagtcggacctccgaaccgtaacggttaccggaaggggaagtacggtacggttgggttccggtagggttcttaacgtaacggtttaaagttaaaggtagtgggtaacgggtcggggtacctacctaccgtaccgtacccggttaccgggaccgggttaaccccggtcgggtaccggggtacccggggtacccgtttccgttaccccgtacccgttacccgtccccgtaaccccgggtaacaacccgtaaaacccgaaaccgaaacggtaaacccgtaccgttacgttacgtaaccgtcgttaacgaacccgttaaagaccggtagtaccggtaagtcgggtacggacggtaacggaacgggacccgtacgttcgttacgttctaagtttcgtacgtaggtaccggtaagggaggtaaccggttccggtacggtcccgggttaaggggttcccgggttaccggtccccgggtaacccggggacgggtacccggttacccggggccttacccgggtacccg

SEQ ID NO: 185543 - DNA, 853 bp, Homo sapiens
  misc_feature: GYAE6OF01BW6A5.18.85.H08.1.454.CMB.1.raw
  modified_base (455)..(455): a, c, t, g, unknown or other
  misc_feature (455)..(455): n is a, c, g, or t
tcagtacgagtatgcacgaccggtgctcgatttagtatcactcagtcgcggggccccagccctgggattcccagctgtttctgcttgctgatcgaggactgcacacagagaactcaccagtggtagtttgggctgagtcgttggttttcctcgtttgtacgttttttaaaggtgtcctagtgtcgaggtgctagcgtggtggaacgtccggggagtcttagtcgacggtccgtggggtccctaggacgtacctcgtcctgtcgccgacgtccgtagtgtacttcgtacgtttcgacgttcgtaccgttaacgtacggtaactacggtaccgtaccgtacgggtaccgttaccccggtaaccccgtaaacggtttcccggaaaaggggtaaacgtacggttacgttcggggtcgggttacggttacctaaacgtaacggtttaaagttaaaacggngtaggtagggtcgggtaccacgtacgtacgtccgacgtcgaccgtcggtacggcgggtacctcgttacacctacgtccgtaccgaacgaaccaaaccgtaccgaaacgtaaccgtacgtacgttagtaaccgttcgaacgtaacgttaaacggtacgtaacggtaccgtaaggttaccggtaagggtaccgtaccggtaacgggtaacccgtacgggttaccgtttcgttaaaccgttacgtttaccggtagggttaccggaaaaggttaccgggaaaccggggttaccgtaccgggttcggtaaccgggttcgggttacccgggggtaaccgtacccccgggtaccgggtaccggggtacccggttaaacccgggttaccccgtcggttaaccccgg

SEQ ID NO: 185544 - DNA, 928 bp, Homo sapiens
  misc_feature: GYAE6OF01AXPR7.18.85.H08.1.454.CMB.1.raw
  modified_base (169)..(169): a, c, t, g, unknown or other
  misc_feature (169)..(169): n is a, c, g, or t
tcagtacgagtatgcacgaccggtgctcgatttagtatcactcagtcgcgggggccccagccctgggattcccagctgtttctgcttgctgatcaggactgcacacagagaactcaccagtggagtttgggctgagtcttgggttttcctcgtttgtcttttttaaggngtccagtgtgaggtgcagtcgtgggtggaagtccgggggagtctttagtcgacggtccggtcgggggtccctgacgccttctccgtgtacgccacgtccttcgtaggtacttcgtagtttacagtccgtaccttagtggtagtcgcgtacgtggacctacccgacgtaacggttaccggaagggaactcggtacgtgggttcggtcggtctaccgtaagttaagtaaggtagtgggtacggtggggacacccgtaacgtacccgttaccggaccggtaccgggtaaccgttcccgggtacgggtacccgggggtccccttaccgtttaacccaccgttaacccgttccccggtaaccccggaaacgtaaaccccgaaaacccgaaacccgtaaaaccgggtaaaccctaccggtacctttacggtaacgtttccgtaacggtaaaccgttaaacgtacgggtaaccgtaccggttacggggttacgggttacggggtaaccgtaacggggtaaaccggtacccggttacggtacccgttttaggttaaaccgttttaagttacccgggtacgggtttaacggaacgggttaaaccggggaacggggttacccggtaacccgggtcggggttaaaccccggggttaaggggggttacccgggggttcccccggttaccccggggtaaaccccggggggtttcccgggggaaacccccgggtaccggggtttaaccccccgggttccgggtaaccccccgg

SEQ ID NO: 185545 - DNA, 941 bp, Homo sapiens
  misc_feature: GYAE6OF01BJB21.18.85.H08.1.454.CMB.1.raw
  modified_base (175)..(175): a, c, t, g, unknown or other
  misc_feature (175)..(175): n is a, c, g, or t
  modified_base (427)..(427): a, c, t, g, unknown or other
  misc_feature (427)..(427): n is a, c, g, or t
tcagtacgagtatgcacgaccggtgctcgatttagtatcactcagtcgcggggccccagccctgggattcccagctgtttctgcttgctgatcaggactgcacacagagaactcaccagtggtaggtttggctgagtcgttgggttttcctcgtttgttacgtttttttaaaggngtcctaggtgtgaggtgcagtcgtgggtaggaaggtccgggggagtcttagtcgacggtccggtcgggggtcctagacgtccttcgtccgtgtcgcgacggtccttgtggttacttcgtagttttcacgtcgtaccttagtcggattcggactacgtacggacctacccggtaaccgtaacggttaccggaaggggaacgtacggtacgtggggttacggtcggttacctacgtaaagttaagttaaaaggngttcgggagggttcggggaccaccagtaccgtaccggtacggaccggtacggttcggcggtaccggggccttaccgtaccgaccgtaccgttacccgaacccgaacgtaaacccgaaccgaaccggtaaacgaaccggtacttaccggttaagtaaccgtacggttaacgaaacgtaaacggtacggtacccggtaacggtacggtttaaccggggtaccggggtaaacgggtaacccggggtaacgggttaaccccgtaaacccggggttttacttaacgggttttaaacccctttaggggttaaccgtagggttaaaccccggggtaaacgggtaaaaccgggggttaaacccgggggttaccggttaaaacccggggttacccggggttaaaccggggttaaccgggggggttacccggggtttaacccggggaccccccggttaccggggggtaacccggggttaccccggaaacggggtttaaccccccgtcggggttaaacccccccg

SEQ ID NO: 185546 - DNA, 946 bp, Homo sapiens
  misc_feature: GYAE6OF01B0GTB.18.85.H08.1.454.CMB.1.raw
  modified_base (364)..(364): a, c, t, g, unknown or other
  misc_feature (364)..(364): n is a, c, g, or t
tcagtacgagtatgcacgaccggtgctcgatttagtatcactcagtcgcgggggccccagccctgggattcccagctgtttctgcttgctgatcaggactgcacacagaagaactcaccagtggtagtttggctgagtcgttgggttttcctcgtttgttacgtttttttaaaggcgtccagttggtgaggtgcaggcgttggtaggaacggtccgggggagtccgtttagtcgacggtccggttcgggggtccctaggacgtaccttccgtccgttggtacgtctacgtccttcggtaggttacttttccgtagttttcgacggtcgtaccttacgtaggtatcgtacgacgttcggtaaccncccggtaacgtaacggttacggaaacggggaaggtaacgtcggtttcggtagggttacggttaccgtacgttaaaacgtttaaaaggttaagtaccggttagggtagggttacgggggttacctaacccgaacttaccgtcccggtaacggtcccggtacccggttcgggtacgggaccggggtacccctttccgtaaccctacccggtaacccttcccggtaaccccggaaactaacccgaaacccaaaccggtaaacaaacccgtacgtaccttagaaccgttacgtaaccgaactaaacggtacgtacgtaccggttacggttagggtacgggtaccgggtaacgggaacccggtaaccgtcgggttaaccttcggtttaacttaaggttccggtaacgttaccggtaaacgggaaacgggtaaacccggggtaacgggtttaccgggtaacccggggttaaccgggtaacccggggggtttaaccggggttacccggggtacccccggtaacccggggttaacccggggaaccccgggttaaacccggggttacccccgggtacggttaaccccccgg

SEQ ID NO: 185547 - DNA, 569 bp, Homo sapiens
  misc_feature: GYAE6OF02G5D7E.18.85.H08.1.454.CMB.1.raw
  modified_base (332)..(332): a, c, t, g, unknown or other
  misc_feature (332)..(332): n is a, c, g, or t
  modified_base (344)..(344): a, c, t, g, unknown or other
  misc_feature (344)..(344): n is a, c, g, or t
  modified_base (379)..(379): a, c, t, g, unknown or other
  misc_feature (379)..(379): n is a, c, g, or t
tcagtacgagtatgcacgaccggtgctcgatttagtatcactcagtcgcgggggccccagccctgggattcccagctgtttctgcttgctgatcaggactgcacacagagaactcaccatggagtttgggctgagctgggttttcctcgttgctttttttaaaggtgtccagtgtgaggtgcagctggtggaatccgggggagcttagttcagccgtgggggtccctgagactctcctgtgcagcctctggattcagtttcagtgcctactggatgcactggatccgccaagttccgagggaagagactggtgtgggtctcacgtataaagntggagtggggtnccacatccgtacgcggactccggtggacggggccncttccaccatccgtccgagaccaacaccaagaacacgctagtactctagacaaatgagcgagtcgtagggagtcggaggacgacggtctgttactattactgtcgacgaggacgggactacgggtcgaccgtacgggtaggggttcggccggtacccggtcggggacccgacgggtaccctgggtacccg

SEQ ID NO: 185548 - DNA, 548 bp, Homo sapiens
  misc_feature: GYAE6OF02GVHBU.18.85.H08.1.454.CMB.1.raw
  modified_base (342)..(342): a, c, t, g, unknown or other
  misc_feature (342)..(342): n is a, c, g, or t
  modified_base (375)..(375): a, c, t, g, unknown or other
  misc_feature (375)..(375): n is a, c, g, or t
tcagtacgagtatgcacgaccggtgctcgatttagtatcactcagtcgcgggggccccagccctgggattcccagctgtttctgcttgctgatcaggactgcacacagagaactcaccatggagtttgggctgagctgggttttcctcgttgcttttttaaaggtgtccagtgtgaggtgcagctggtggaatccgggggaggcttagttcagcctggggggtccctgagactctcctgtgcagcctctggattcagtttcagtgcctactggatgcactggatccgccaagttccagggagagactggtgtgggtctcacgtattaaagatgatgggggtnccacatcctacgcggactccggtgacggggccncttcaccatctccgagacacaccaagaacacgctgtatctgacaaatgagcagtctgggatcgaggacacggctgtctattacgtgtgacaggagggactacgggtgacccgtacggtaggggtttcggtaccggaccccggtggggacccgaggggtaccccgtggtacccg

SEQ ID NO: 185549 - DNA, 665 bp, Homo sapiens
  misc_feature: GYAE6OF02I6PBR.18.85.H08.1.454.CMB.1.raw
tcagtacgagtatgcacgaccggtgctcgatttagtatcactcagtcgcgggggccccagccctgggattcccagctgtttctgcttgctgatcaggactgcacacagagaactcaccatggagtttgggctgagctgggttttcctcgttgtcttttttaaaggtgtccagtgtgaggtgcagctggtggaatccgggggagcttagttcagccgtgggggtccctgagctctcctgtgcaggccctgcattcattctttaatagttattggatgcacgtgggtccgccaggcgtccgggggaaggggccgggaggtgggtcggaccaaacataatgacaagagtggaactggaagaagaactagtgtaggacttcgtaggtaggaacgggccgtaattccgaacccagttcctaccgaagaacgaaccaaacaacgttaaagaacctttaacgtgttaatctagaccaaaagttcgaaaccacgtaccctacgaacggaccggacccggaaagggacccgtaaccgggtcgttaggttacgttaacgtttaaccgtggttacgacgggaaagcgacgtagggtcgggtaccgttgggggaactaggtcgggaccggttcgggaccgggggacccgaaacggggtaccccgacggttaccccgg

SEQ ID NO: 185550 - DNA, 709 bp, Homo sapiens
  misc_feature: GYAE6OF02HDFX9.18.85.H08.1.454.CMB.1.raw
tcagtacgagtatgcacgaccggtgctcgatttagtatcactcagtcgcgggggccccagccctgggattcccagctgtttctgcttgctgatcaggactgcacacagagaactcaccatggagtttgggctgagctgggttttcctcgttgtcttttttaaaggtgtccagtgtgaggtgcagctggtggaagtccgggggagcttagttcagccgtgggggtccctgagactctcctgtgcagcctcgtggattcagtttcagtgcctacgtggatgacacgtggactccgaccgtaagttcccgaagggaagacgtaccgttgggtggtgggtcctcgtaacgttaagttaaagagtaggaggttgggggtacgacccgaactacgttacccgtacggaccggtaccgtccgggtagggacggggtcccgtacgttacccgaaccgtacgttcccgtacccgaaggaaccctaaaccgaaccgaaaacgaacccgaccgtacttacgtactcctagaaccaaagttcggacgtacgacggttacggtagggacgtacggaacggaccgtacgcgttacgttacttagttacgtggacgacgtaaggggtaacgggtaccgtaccgggtacgtaccggtacgggtacggggttacggacccggtacccggtcggggacccgtaacggggtacccgttcggtaccccg

SEQ ID NO: 185551 - DNA, 572 bp, Homo sapiens
  misc_feature: GYAE6OF02JE967.18.85.H08.1.454.CMB.1.raw
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
tcagtacgagtatgcacgaccggtgctcgatttagtatcactcagtcgcgggggccccagccctgggattcccagctgtttctgcttgctgatcaggactgcacacagagaactcaccatggagtttgggctgagctgggttttcctcgttgtctttttttaaaggtgtccagtgtgaggtgcagctggtggaagtccgggggagcttagttcagccgtggggggtccctgagactctcctgtgcagcctctggattcagtttcagtgcctactggatgcactggactccgccaagttccgaagggagagactggtgtggtctcacgtataagntgagtggggtnccanatcctacgcggactccggtggacggggcctcttcaccatcgtccgagacaacaccaagacacgctgtatctgacaaatgagcagtcgtgggagtcgagacgacggctgtctattactgtgacgaggacgggtacgtacgggtcgtacccggttagggtacggggtttcggtacccggaccccggttacggggacccgtaacggggtaccccgttgggtacccg

SEQ ID NO: 185552 - DNA, 255 bp, Homo sapiens
  misc_feature: GYAE6OF02F1QEW.18.85.H08.1.454.CMB.1.raw
tcagtacgagtatgcacgaccggtgctcgatttagtatcactcagtcgcgggtctgagacaaatttcactctcaccatcaccaacctgcaggctgaagatgtggcagttttatttctgtcagcaacattttggtattccgatcaccttcggccaagggacactactggagattaaaagaactgtggctgcaccatctgtcttcatcttcccgccatctgacatactcgtactgagcgggctggcaaggcgcatag

SEQ ID NO: 185553 - DNA, 629 bp, Homo sapiens
  misc_feature: GYAE6OF02GSF1U.18.85.H08.1.454.CMB.1.raw
  modified_base (249)..(249): a, c, t, g, unknown or other
  misc_feature (249)..(249): n is a, c, g, or t
  modified_base (361)..(361): a, c, t, g, unknown or other
  misc_feature (361)..(361): n is a, c, g, or t
  modified_base (403)..(403): a, c, t, g, unknown or other
  misc_feature (403)..(403): n is a, c, g, or t
tcagtacgagtatgcacgaccggtgctcgatttagtatcactcagtcgcgggggccccagccctgggattcccagctgtttctgcttgctgatcaggactgcacacagagaactcaccatggagtttgggctgagctgggttttcctcgttgtctttttttaaaggtgtccagtgtgaggtgcagcgtggtggaagtccgggggaggcttagtcagccgtgggggtcctgagctctcctgtgcagcctntggattcagtttcagtgcctactggatgcactggatcccgacctaagttcccgagggaagagacgtggtgtcgggtctcgacgttattaaaggattggaaggtgggggtacnccgaacgactcccgtacgcgggtactccggtggacggggccncgttccacctatccgtaccgacgaccaaacaaccaacgaaccacgctagtactctgacaaagtcgagtacgagtcgtagggacgtacggaggaccgacgggtctagttacttattaccgtgtagacgtagggaccgggacgtacgggtagtcccggttagggtacggggttacggtacccggacccggtcggggacccggtaacggggtaccccgtggtaccccgg

SEQ ID NO: 185554 - DNA, 618 bp, Homo sapiens
  misc_feature: GYAE6OF02FR205.18.85.H08.1.454.CMB.1.raw
  modified_base (248)..(248): a, c, t, g, unknown or other
  misc_feature (248)..(248): n is a, c, g, or t
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
tcagtacgagtatgcacgaccggtgctcgatttagtatcactcagtcgcgggggccccagccctgggattcccagctgtttctgcttgctgatcaggactgcacacagagaactcaccatggagtttgggctgagctgggttttcctcgttgctttttttaaaggtgtccagtgtgaggtgcagctggtggaatccgggggagcttagttcagccgtgggggtccctgagactctcctgtgcagcctntggattcagtttcagtgcctactggatgcactggactccgaccaagttccgagggaagagactggtgtgggtctcgacgtataaagntggagtggggtnccantccgagcgactcgngacgggccnctcacagtcctccgagacaacacaagaacacgctagtactctagacaaagtgaacgctacgtcgtagggacgtacggaaggaccgtacggtacttacgtacttaacgtttacgtaggtacgacgaagggacggggtaaccgtaccgggtacggtacccggttaacggggtacggggtttacgggtacccggtacccccgggtgggggtaacccggtacggggtaaccccggtgggtaaccccgg

SEQ ID NO: 185555 - DNA, 718 bp, Homo sapiens
  misc_feature: GYAE6OF02GUURD.18.85.H08.1.454.CMB.1.raw
  modified_base (357)..(357): a, c, t, g, unknown or other
  misc_feature (357)..(357): n is a, c, g, or t
tcagtacgagtatgcacgaccggtgctcgatttagtatcactcagtcgcgggggccccagccctgggattcccagctgtttctgcttgctgatcaggactgcacacagagaactcaccatggagtttgggctgagcttgggttttcctcgttgtctttttttaaaggtgtccagtgtgaggtgcagctggtggaagtccggggagcttagttcagccgtgggggtccctgagactctcctgtgcagcctctggattctagtttcagtcgcctacgtggatgcacgtggactccgaccaaggttccgaaggggaacgagtacgtgggtcggttgggtcctcgacgttaattaaacggngttaggaaggttcgggggtcacccgacgtacgttacccgtacgggaccggtaccgtccggtacggggacggggtcccgtacctttcgaacccgtacgttcccgtaccccggaaacgaaaaccctaacccgaaaacgaaaccgaccggaccttaggttaacttccgtacgaactaaagtcgaaggtaccgacggttcggtaggggacggtaccggaaagggaccggtaccggtcgttacgttacgttacttacggttgtacgacgaagggacgggtacgtacgggtcgtaccggtaagggtcggggttaccggtaccggacccggtcgggtaccgaccggggtaccgtcggtaccgtcccgg

SEQ ID NO: 185556 - DNA, 655 bp, Homo sapiens
  misc_feature: GYAE6OF02GZBVA.18.85.H08.1.454.CMB.1.raw
tcagtacgagtatgcacgaccggtgctcgatttagtatcactcagtcgcgggggccccagccctgggattcccagctgtttctgcttgctgatcaggactgcacacagagaactcaccatggagtttgggctgagctgggttttcctcgttgtctttttttaaaggtgtccagtgtgaggtgcagctggtggaagtccgggggaggtcttagttcagccgtggggggtccctgagactctcctgtgcagcctcgtggattctagtttcagtcgccttacgtggatcgcacgtggactcccgcctaagttccgaaggggaagagacgtgggtggtgggtctcgacgttaattaaagatggaggtggggtcaccacgtactccgtacggccgggtacctccggtagggacggggcccgtcttccgacctactcccgtacccgacgaaccaaccaaccaaacgaaccacgtactgtactcgtgacaaatgacgacgagttcgtgggacgtcggaacggacgacggtctcgttacgttacgttacgtgtacgacgtaacgggacgggtacgtacgggtcggtaccggttacggggtacggggtttcggtacccggtacccgggtccgggaccggaccggggtacccgtcgggtaccccg

SEQ ID NO: 185557 - DNA, 867 bp, Homo sapiens
  misc_feature: GYAE6OF02JYD8Y.18.85.H08.1.454.CMB.1.raw
tcagtacgagtatgcacgaccggtgctcgatttagtatcactcagtcgcggggcccccagccccgtggtacttcccgagtctttgttttcgtcgtcgttcgtcgtagtactacggaaggtacgtcgaccaaccaacgaagaacgtaacctacccaaccgtaggtaggtttaggttggtcgtagacgttccggtttttccggttttcccgtttggtttcgttttttaaacggttttttaaggtccgtaacgtgttggtaggtggtcgcgtcgtggttaggtaaggtaccgggtaccgggagttcgtttacgtcgaccggtccgggttccggtccgagacgtccgttccgtgtcgtcgacgccgtccgttcgtagttacttcgttacgttcgtacggtcccgtaccgttagtacgtagtccgtaccgtacggtagtacccgtacccgtaacgttaccggtacggaaaggaacgtacgtggttgggttggtccggttacctaaccgtaagttaaagtaagtagtggtagggtcggaccacgtaacgttaccgtaccgtacggtccgtaccggtcggacgggtaccgtcccgttaccgtacccgaaccgtccgttacccgtaccgaaacgaacccgtaaacccaacgaaacgtacccgtcgtacgttaatacgtacccgaagaaactaaggtacgacggtaccgttacgtacgggtacggtacgtacggaaccgcgttccgtgttacgttaaccgtttacgtcgtaacgtacgacggacggtaacggtcccgtaacggaccttaccgggtaagggttcggtacccgtcccggtaaccggccgacccggtaccggttacccgcgttaccccg

SEQ ID NO: 185558 - DNA, 603 bp, Homo sapiens
  misc_feature: GYAE6OF02F86WI.18.85.H08.1.454.CMB.1.raw
  modified_base (166)..(166): a, c, t, g, unknown or other
  misc_feature (166)..(166): n is a, c, g, or t
  modified_base (308)..(308): a, c, t, g, unknown or other
  misc_feature (308)..(308): n is a, c, g, or t
  modified_base (324)..(324): a, c, t, g, unknown or other
  misc_feature (324)..(324): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (370)..(370): a, c, t, g, unknown or other
  misc_feature (370)..(370): n is a, c, g, or t
  modified_base (429)..(429): a, c, t, g, unknown or other
  misc_feature (429)..(429): n is a, c, g, or t
tcagtacgagtatgcacgaccggtgctcgatttagtatcactcagtcggcgggggccccagccctgggattcccagctgtttctgcttgctgatcaggactgcacacagagaactcaccatggagtttgggctgagctgggttttcctcgttgcttttttaaaggngtccagtgtgaggtgcagctggtggaatccgggggagcttagttcagcctggggggtccctgagactctcctgtgcagcctctggattcgagttttcagtgcctactggatcgcactggactccgactaagttccagggaanagactggtgtgggtcncacgtattaaagctgatgggtntgccanatccgacgcggactcggnggacggggcctcgttcacctatccgtaccgagaccaacaaccaagaacacgctagtacncgtagacaagtgagctagtcgagggacgtcgaggactacggtcttcggtactaattccgtagtacgagtaacgggacggggtaactaccgggttcgacccgttaacgggtacgggggtttcggtacccggtacccccgggttagggggacccgtaacggggtaacccgtccggg

SEQ ID NO: 185559 - DNA, 307 bp, Homo sapiens
  misc_feature: GYAE6OF02ITJ9S.18.85.H08.1.454.CMB.1.raw
  modified_base (174)..(174): a, c, t, g, unknown or other
  misc_feature (174)..(174): n is a, c, g, or t
  modified_base (265)..(265): a, c, t, g, unknown or other
  misc_feature (265)..(265): n is a, c, g, or t
  modified_base (271)..(307): a, c, t, g, unknown or other
  misc_feature (271)..(307): n is a, c, g, or t
tcagtacgagtatgcacgaccggtgctcgatttagtatcactcagtcgcgggtctgagacaaatttcactctcaccatcaccaacctgcaggctgaagatgtggctagtttatttctgtcagcaactattttggtattccgatcaccgtttcggcccaagggacacgactgganattaaagactgtggctgcaccatcgtgtctcatcttaccgcatctgacatactcgtactgacggcggctaggccaagggtcgacctaagtnagcgannnnnnnnnnnnnnnnnnnnnnnnnnnnnnnnnnnnn

SEQ ID NO: 185560 - DNA, 305 bp, Homo sapiens
  misc_feature: GYAE6OF02G437I.18.85.H08.1.454.CMB.1.raw
  modified_base (240)..(240): a, c, t, g, unknown or other
  misc_feature (240)..(240): n is a, c, g, or t
  modified_base (263)..(263): a, c, t, g, unknown or other
  misc_feature (263)..(263): n is a, c, g, or t
  modified_base (267)..(269): a, c, t, g, unknown or other
  misc_feature (267)..(269): n is a, c, g, or t
  modified_base (271)..(305): a, c, t, g, unknown or other
  misc_feature (271)..(305): n is a, c, g, or t
tcagtacgagtatgcacgaccggtgctcgatttagtatcactcagtcgcgggtctgagacaaatttcactctcaccatcaccaacctgcaggctgaagatgtggctagttttatttctgtcagcaactatttttggattccgatcaccttcggccaagggacacgactggagtaattaaaagactgtggctgcacatctgtcttcattcctccgcatctgactatctcgatgagcggtcnggacaaggcgtacaataggctgntcgnnnannnnnnnnnnnnnnnnnnnnnnnnnnnnnnnnnnn

SEQ ID NO: 185561 - DNA, 731 bp, Homo sapiens
  misc_feature: GYAE6OF02F4XJY.18.85.H08.1.454.CMB.1.raw
  modified_base (359)..(359): a, c, t, g, unknown or other
  misc_feature (359)..(359): n is a, c, g, or t
tcagtacgagtatgcacgaccggtgctcgatttagtatcactcagtcgcgggggccccagccctgggattcccagctgtttctgcttgctgatcaggactgcacacagagaactcaccatggagtttgggctgagctgggttttcctcgttgtctttttttaaaggtgtccagtgtgaggtgcagctggtggaatccgggggagcttagttcagccgtgggggtcctgagctctcctgtgcagttctcgtgggttcgtcaggtggcgactacatgagccgtgggtcccgccgaggcctccgaaggggaacgggccgtggggagtggatctctactttattataggtggtcggtaaccanatactacacacgactcggtagaacggcgtattccgacctatcctacgagaaacgaccaacttacccgaaggaaactactaagtttacgttaacttacttaacaaaagtacgtaaaccgttaaaccgttcggaaaggtacggacccggtaaagggaaccgtaaccgggaccctaagttcgtttaaacttacggttggttacgggtacgggtacttaacgtttttaccgttaccgggtacccccggttacggggggtaccccggggttaaaccccggttcgggtaaccccgtaaccccggtttcccctaccccccgaaccccgttccccgaacccgggttaacccggccccctagggttccccggttacccccg

SEQ ID NO: 185562 - DNA, 346 bp, Homo sapiens
  misc_feature: GYAE6OF02HFCQC.18.85.H08.1.454.CMB.1.raw
  modified_base (181)..(181): a, c, t, g, unknown or other
  misc_feature (181)..(181): n is a, c, g, or t
  modified_base (297)..(297): a, c, t, g, unknown or other
  misc_feature (297)..(297): n is a, c, g, or t
  modified_base (301)..(346): a, c, t, g, unknown or other
  misc_feature (301)..(346): n is a, c, g, or t
tcagtacgagtatgcacgaccggtgctcgatttagtatcactcagtcggcggggtctgagacaaatttcactctcaccatcaccaacctgcaggctgaagatgtggcagtttatttctgtcagcaaactatttttggtatttccgattcacctttcggaccaaaggggcacgactaggganaattaaaaaggactgtgctgactaccattctgtcttcgacttcctccccgatatcgtacgtactattactcgtaactgacggcgggactaggacaaaacggcgacagttagcagcntagnnnnnnnnnnnnnnnnnnnnnnnnnnnnnnnnnnnnnnnnnnnnnn

SEQ ID NO: 185563 - DNA, 667 bp, Homo sapiens
  misc_feature: GYAE6OF02IZYBA.18.85.H08.1.454.CMB.1.raw
  modified_base (312)..(312): a, c, t, g, unknown or other
  misc_feature (312)..(312): n is a, c, g, or t
tcagtacgagtatgcacgaccggtgctcgatttagtatcactcagtcgcgggggccccagccctgggattcccagctgtttctgcttgctgatcaggactgcacacagagaactcaccatggagtttgggctgagctgggttttcctcgttgtcttttttaaaggtgtccagtgtgaggtgcagctggtggaagtccgggggagcttagttcagccgtgggggtccctgagactctcctgtcgcagcctctggattcagtttcagtcgcctactggatgcactggactcccgcctaacgttccgaggggaanagactgggtgtgggtctctacgtattaaagatgagtggggtcaccacactaccgtacgcggacgtcggtggacggggccctcttaccgaacccgtacttccgtacccgagaaccaaaccaaccgaaacgaaccacgtacttagtaactccgtagacctaaagtcgaacgtccgaggtcggtagggacggtcggaacggacgtacggtcttacgttacttaacgtttacgtaggtacgacgtaagggacggggtaaccgtacgggtaccggtacccggttaacggggtacggggttacggtacccggtaccccggtcgggggacccgtaacggggtaccccgttagggtaaccccg

SEQ ID NO: 185564 - DNA, 680 bp, Homo sapiens
  misc_feature: GYAE6OF02IPWAE.18.85.H08.1.454.CMB.1.raw
  modified_base (385)..(385): a, c, t, g, unknown or other
  misc_feature (385)..(385): n is a, c, g, or t
  modified_base (508)..(508): a, c, t, g, unknown or other
  misc_feature (508)..(508): n is a, c, g, or t
tcagtacgagtatgcacgaccggtgctcgatttagtatcactcagtcgcgggggccccagccctgggattcccagctgtttctgcttgctgatcaggactgcacacagagaactcaccatggagtttgggctgagctgggttttcctcgttgtctttttttaaaggtgtccagtgtgaggtgcagctggtggaagtccgggggagcttagttcagccgtgggggtccctggacgactctcctgtgcacgtcctcgtggtacttcgtagttttcagtcgtccttacgtggatgcctacgtggaactcccggaccgtaaggtccgaagggaagtcggacgtgggtgtgggtctacgtaacgtaattaagatcggaggttggggtacnccacgtacgtacctacggtccggaacttccggagggacggggtccctcgttacccaccgtactcccgtaccgaacgaaccaaaccgaccgaaacgaccacgctagtactctagacaagtgacncgacgtcgagggtacgcggaacggacgcggtactcgttacttagttacgacggttagacggtacgggaacgggtccggttaacgggccggttaccggtaacgggtacgggggtttcggacccggtaccgggtacggggccccggtaacgggtaccccgtcggttaaccccgg

SEQ ID NO: 185565 - DNA, 965 bp, Homo sapiens
  misc_feature: GYAE6OF02HBO2J.18.85.H08.1.454.CMB.1.raw
  modified_base (163)..(163): a, c, t, g, unknown or other
  misc_feature (163)..(163): n is a, c, g, or t
tcagtacgagtatgcacgaccggtgctcgatttagtatcactcagtcggcggggccccagccctgggattcccagctgtttctgcttgcctgatcaggactgcacacagagaactcaccatggagtttggctgagcgtggtttcgtcgttgtcgtttttaagngtcgatgtgaggtgcagtcgtggtggaagtccggggagtcgttagttcaggtccgtcgggggtccctagagtaccgtcctctaggtgacgacgtcctacgttggtacgttccgtagtttaccgaggttcgaccgttaacgtcgggtaatccggtacctaccgtaggtacccgttaccgacccggttaaaggtacccggaaggggtaaacgacggttaccggtgggttacggtccgggttaccaacgttaaacgttaacgttaaaacgtgtaacggttagggtcggggtaccgtacctaacgtaacgttaccgtaccgggtagggtcccgtacggggtaggggaaccgggtccttacccggtttaccaaccccggttaccgtttacccggaaccccggtaaagaaccccgtaaaccgaaacccggtaaaacgtaaccccgaccggttaacgttaggtaacccttaaggtttaacccgaaagtttaaaacggttccggtaaacggtacccgtttaacgggttaccgggtaacggggttaacgtaaacccgggttaaccggggaaacccgtttcccggggtaaaccgtttttaccggtaccgtttaaccgttttaaaaccggtttgggaaacccggggttaacggggaaccgggggtttaaccggggtttaaccccgggtgggttaaccccggttacccgggttaaacggggttaccggggggttaaccccgtttacccgggggacccgggtttacccggggaaccggggtaaacccccgtttacggttaaccccgggtccccgg

SEQ ID NO: 185566 - DNA, 743 bp, Homo sapiens
  misc_feature: GYAE6OF02F74PS.18.85.H08.1.454.CMB.1.raw
  modified_base (245)..(245): a, c, t, g, unknown or other
  misc_feature (245)..(245): n is a, c, g, or t
  modified_base (352)..(352): a, c, t, g, unknown or other
  misc_feature (352)..(352): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
tcagtacgagtatgcacgaccggtgctcgatttagtatcactcagtcgcggggccccagccctgggattcccagctgtttctgcttgctgatcaggactgcacacagagaactcaccatggagtttgggctgagcttgggttttcctcgttgtactttttttaaaggtgtccagtgtgaggtgcagtcgtggtggaagtccgggggagcttagttcagccgtgggggtccctgagctctcctgtncagcctcgtggattctagtttccagtcgcctacgtggatgcacgtggactcccgactaacgttaccgaggaagacgtacgtggtgtggtctactacgtaattaaagntaggaggtggggtnaccanactcgacgcgacgtcggtggacgggcctctaccactactccgccgaacaaccaaccaaccgaagaaccgacgtctagtactcgtacgaactaaacgtgaacgtaccgtacggttcggtaacgggtacggtaaccgggaacgggtacccgaacgggttacgttaccggtttaacttaaccgtttacggttcgggttaacggaccggtaacgggggtaaccggggtaaccgggttaacccggggtaccggtacccccggggttaacgggggttaccggggggtttacccgggtaccccgggtaaccccggggttcccggggggtaacccccgggtaacccgggggttacccccggttcggggttaaccccccgg

SEQ ID NO: 185567 - DNA, 889 bp, Homo sapiens
  misc_feature: GYAE6OF02HBA3W.18.85.H08.1.454.CMB.1.raw
tcagtacgagtatgcacgaccggtgctcgatttagtatcactcagtcgcgggggccccacgccctgggattcccagctgtttctgcttgctgatcaggactgcacacagagaactcaccatggaggtttgggctgagcgtggttttcctcgttgttcttttttaaaggtgtccagtgtggaggtgctagcgtggtaggaagttccgggggagtcgttagttccaggccggtggggggtaccctggacgtacctctaccgtggtacgacgacgtccttcggttgggtaacttccgtaggtttcctacggttggacccgttacgtggtaagttcgaccgaacgttcgggtacttaccccggtaccgtaaacgtttacccggaaaggggtaaacgtaacggtaaccgttcggggttaggttccgggggttacttacccggtaaacggtttaaagtttaaaaacggaacgttaggggtaaggttccgggggggttacacccgtaaacgtccgtttaccggaccggtaccgggtaaccgtcccgggttaggaaccggggtcccggtaaccttccgaaccgtacgttacccgacccggtaacgaaccaaaccgaaaccgtaaacgaacgtaaccgtacgttacgtagtaccgtagaacgtaaagtcggtacgacgtcggtacgaggggacgttaacgggaaccgtaaccggtacggtactttaccgggttaactttaggttaccagggttaccgaaacgggttaacgggaacgggtaccggttaaccggggtaccggtaccgtaaccgggggttaacggggtttcccggacccgggttttaccccggagggggtaacccccggaacgggttacccccggtaccgggtaaccccgg

SEQ ID NO: 185568 - DNA, 696 bp, Homo sapiens
  misc_feature: GYAE6OF02IVDSJ.18.85.H08.1.454.CMB.1.raw
  modified_base (203)..(203): a, c, t, g, unknown or other
  misc_feature (203)..(203): n is a, c, g, or t
  modified_base (269)..(269): a, c, t, g, unknown or other
  misc_feature (269)..(269): n is a, c, g, or t
  modified_base (362)..(362): a, c, t, g, unknown or other
  misc_feature (362)..(362): n is a, c, g, or t
  modified_base (379)..(379): a, c, t, g, unknown or other
  misc_feature (379)..(379): n is a, c, g, or t
  modified_base (482)..(482): a, c, t, g, unknown or other
  misc_feature (482)..(482): n is a, c, g, or t
  modified_base (684)..(684): a, c, t, g, unknown or other
  misc_feature (684)..(684): n is a, c, g, or t
tcagtacgagtatgcacgaccggtgctcgatttagtatcactcagtcgcggggcccccagccctgggattcccagctgtttctgcttgctgatcaggactgcacacagagaactcaccatggagtttggctgagcgttggttttcctcgttgttcttttttaaaggtgtccagtgtgaggtgcagctggtggaagtccggggngcttagttcgagccgtgggggtcctgacgctctccgtgtgcagtcctcgtggtacttcgtagtttnacgttgaccctagtggatgcctacgtggacctccgacctaaggttccgaaggaagagtcgtagggtgtcggttctacgtaacgtaagttaaangtagtaggtgggtaccnccgaatccgtaccgtaccggaccgtacgtccggagggtaccgggtccctacgtccaaccgtcctacccgtacccgagaaacccaaaccgtaacaaacgaaccncgtactgttaactaccgacgtaacaagtacgactacgtaacgttcggaaggtacggtacggacgaccgtacggtcttcgtacctttaacgtgtaccggtaagtaccgtaaggggtacggttaccgtaccggttacggtacggtacgggttacggggtcccggtacccggtcccgggtagggtacccggaaccgggttacccncccggttaaccg

SEQ ID NO: 185569 - DNA, 940 bp, Homo sapiens
  misc_feature: GYAE6OF02HQ76X.18.85.H08.1.454.CMB.1.raw
tcagtacgagtatgcacgaccggtgctcgatttagtatcactcagtcgcggggccccagccctggattcccagctgtttctgcttgctgatcaggactgcacacagagaactcaccatggagtttggctgagctgggttttcctcgttgtcttttttaaaggtgtccagtgtgaggtgcagcgtggtaggaagtccgggggaggtcttagttcgagccgtgggggtccctgagtacctcctcctgtgcacgcctctggtattcgtagtttcagtcgcctagtggatcgacacgtggactcccgactaacgttccgaagggaacgtagacgtgggtggtcggtctacgtaacgttaagttaaagagtaggtaggtcggggtcaccgtactacgtacccgtacggtaccggtaaccgttcgggtcgggtaccggggtacccttacgttacccggaaccctaccgtaccccggtacccgtaaaccggtaaaccctaaaaacccgaaacccgtaaaaccggtaaacccgtaacccggttaaccgttacggttaaaccgttacccgtaacgtaaacccgttaaaaagttcggaaaccggtacgtaacccgggttaccgggtacgggggtaaaccggtaacccgggtaaacgggtaacccggtaaccgggttacgtttacggtttaaccgttttaaacccgttttaacggtacgggtttaacccggaaccggggttaaacggggtttaacccggggggtaaaccggtttcccggggtttaacccccggggtaacccggggttttaacccgggggggttaccggggggtttttaaccccgggggtaaccccccgggttaacccccggggggttaaccgggggtaacccccccgggggtaaaaccgggggtttacccccgggtttaaccccggggttacccccccggg

SEQ ID NO: 185570 - DNA, 325 bp, Homo sapiens
  misc_feature: GYAE6OF02HZIAI.18.85.H08.1.454.CMB.1.raw
  modified_base (280)..(280): a, c, t, g, unknown or other
  misc_feature (280)..(280): n is a, c, g, or t
  modified_base (283)..(325): a, c, t, g, unknown or other
  misc_feature (283)..(325): n is a, c, g, or t
tcagtacgagtatgcacgaccggtgctcgatttagtatcactcagtcgcgggtctgagacaaatttcactctcaccatcaccaacctgcaggctgaagatgtggctagttttatttctgtcagacaactatttttggtattcccgatccaccttcggaccaagggacacgactggagaattaaaagaactggtggctgcacatctgtcttcacttcctcccgcatctgactattaccgtacgtacgtgacggcggtctgggaccgtaaggcgcaagtagnctnnnnnnnnnnnnnnnnnnnnnnnnnnnnnnnnnnnnnnnnnnn

SEQ ID NO: 185571 - DNA, 934 bp, Homo sapiens
  misc_feature: GYAE6OF02FIS4P.18.85.H08.1.454.CMB.1.raw
tcagtacgagtatgcacgaccggtgctcgatttagtatcactcagtcgcgggggccccagccctgggattcccagctgtttctgcttgctgatcaggactgcacacagagaactcaccatggagtttgggctgagcttgggttttccctcgttgtcgtttttttaaaggcgtccgagtgtggaggtgcagtcgtggtaggaacgtccgggggagtacgttagtcgacggtccggttcgggggtccctagacgtactcctccgtgtccgactaccgtccgtacgttcggtacgtttcttaagggtttaccaacgggttccgtaccgttacgggtagggtacttaccggcccgtaacggttcgggtaccgtccccggaaacccgttaacgggttaacccgggaagggggtaaacggtaacggttaaccgggttggggtttacggggttaccgggttaccgttaaccgttaaaacggtttaaagtttaaaaccggtaggttacgggtacggggttacggggggtactaacccctaagtacccgttacccggaaccgggtacccgggttacccgtaccggggtaccgggaaccggggtcccgttcccttaccggaaccgttacccggtaccgtaacccgaaccgaaaccgaaaccgtaaacccgtaaacggaacccgtacgtcgttaacgttacgtcgtaacggaccttaaaggacgtacggtaccggtagttacgggtaagggtccggaacggtaaccggacggtaccggttacgttacggttaccgtttaagtttcggtaacgtcggtaaccggtagggtacgggtaccggtaccgggtacggtaccgggttaaacggggcggggtttaccccggtaccgggaaccccgggttccggggaaccggtttacccgggtaccggttccgttaaccccgg

SEQ ID NO: 185572 - DNA, 881 bp, Homo sapiens
  misc_feature: GYAE6OF02HWLEP.18.85.H08.1.454.CMB.1.raw
tcagtacgagtatgcacgaccggtgctcgatttagtatcactcagtcgcgggggcccccagccctgggattcccagctgtttctgcttgctgatcaggactgcacacagagaactcaccatggagtttgggctgagtcttgggtttttcctcgtttggtcttttttttaaaggtcgtccgagttgtgaggtgcagtcgtggtggtaagtccgggggagtcttaggttcacggtccgtgggggtccctggacgtacctccttcctggtgccagtccctgtcggtactttcctagtttcgacgtcgaccttacgagggtactgccgtacgttacggtaccgtacccggtaccgtaacggtttacccggaaggggtaacgtacggtaccggtttaggggtcggtttcgggtcctacggtaacgtttaaacgttaaaggtacgtaggtagggttacggggtaccacgtaccgtacgtaccgtaccggaccggtacccgttcggtgggaaccggggttccctaccgtttaccaccgtccttacccgtacccggtaacgaaccaaacccgtaaacccgaaacggaacccgtaacggtacctttacgtaacgttaccgaaccgtaacgtaaacgttcgaacggttacggtaaccggttcggtaccggggttaagacccgggttaacggaccgggtaccggtactttaccggttatttacgtttacgagggttacggaacgtaaccggggtaacggggttaacccggtttaccgggaacggttacccggtttaacgggggttacggggttaaccccgggtttaccccgggaacccgggtttcccgggaacccggggttaacccggttaccccggttacggtaacccccg

SEQ ID NO: 185573 - DNA, 851 bp, Homo sapiens
  misc_feature: GYAE6OF02IW5T9.18.85.H08.1.454.CMB.1.raw
  modified_base (434)..(434): a, c, t, g, unknown or other
  misc_feature (434)..(434): n is a, c, g, or t
  modified_base (455)..(455): a, c, t, g, unknown or other
  misc_feature (455)..(455): n is a, c, g, or t
tcagtacgagtatgcacgaccggtgctcgatttagtatcactcagtcgcggggcccccagccctgggattcccagctgtttctgcttgctgatcaggactgcacacagagaactcaccagtggtaggtttggctgagtcgttcgggttttcctcgttagttacgttttttaaaggtcgtcgagttgtggtaggtgcagcgtggtaggaacggtccgggggagtcgttaggtcgacggtccgggttcgggggtccctggacgtaccgttccgttccgtggtcgcgaccgtccgtcgttggtactttcgtagtttcgagtcgtccgtacgtggactcgacgtacgtggtacctccgacccgttaacggtccggaaggggtaacgtacggtacgttgggttcggtcgggtttactacgtaagtttaaagttaaaggngttacggtaggtcggggtacncccgtaagtccgtaccgccgggtaccggtacggttccggacgggaccgggtcccgtcttccacccgtacgtccgaacccgtacgaaaccaaccgaaaccgaaccgaacgccgtactacgtacgtacgtaacgaacgaagtacgacgtacgtacgggttagtacgggtacgtaccggaaccggacgtacgtaccggttagttacccgtttaggttaccgttacggtacgaaccggggtaaggtaacccggggtttaacccggtcgggttaacccgttaccgggggtttaaaccggggtacccgggggtttaaccgggtaccccccggtttacccggggggacccggggtaaaaccccggggttacccgggttaaccccggtccgggttaaccccggg

SEQ ID NO: 185574 - DNA, 807 bp, Homo sapiens
  misc_feature: GYAE6OF02FMA11.18.85.H08.1.454.CMB.1.raw
  modified_base (167)..(167): a, c, t, g, unknown or other
  misc_feature (167)..(167): n is a, c, g, or t
tcagtacgagtatgcacgaccggtgctcgatttagtatcactcagtcgcgggggccccagccctgggattcccagctgtttctgcttgctgatcaggactgcacacagagaactcaccatggagtttggctgagcttgggttttcctcgttgtctttttttaaaggngtccagtgtgaggtgcagctggtaggaagtccgggggagtcttagttcagtccgtgggggtccctgagactctccgtgtcgcacgtcccttcgtggtactttccgtagttttccaggttcgcccgttaacgtagggacttcggaccacgttgggtaacttcccccggtaaccgtaaacggtttaccccggaagggggtaaaacgacgggtaccgttagggggttcggttaccgggggttaccttaccggtaaacggtttaaagtttaaaagacgttaggggtaacggttggggggttacctacccgaacggttacccgttacccgtaacgggacccgggtacctttaccgggggtcgggaacgggggtccccgttaccgttacccgaaccctaccggttccccggtacccggaacgaaaccctaaacccgaacccgaaaacggtaaacctaccggtacgttacgtaactcgtacgaactaaacgtggaactcgaggttcgtagggacgtacggaacggacgcgggtacttcgtacttagtacgtgtacgacggtaggcggtaccgtaaggtacgtaccggtagggtaccgggttcgtcccggacccggtcgggaccgtacccgggtaccgtcggtacccg

SEQ ID NO: 185575 - DNA, 827 bp, Homo sapiens
  misc_feature: GYAE6OF02HPQBB.18.85.H08.1.454.CMB.1.raw
  modified_base (296)..(296): a, c, t, g, unknown or other
  misc_feature (296)..(296): n is a, c, g, or t
tcagtacgagtatgcacgaccggtgctcgatttagtatcactcagtcgcggggccccagccctggattcccagctgtttctgcttgctgatcaggactgcacacagagaactcacagtggagtttgggctgagtcgttcgggttttcctcgtttgttacgtttttttaaaggtgtccgtaggtgtgaggtgcagtctggtaggaacggtccggggagtctttaggtcacggtccggttgggggtcccctaggacgtaccgttccttccgtaggtcgccgacgtcctaggtacggtntttacgtacggttttaccgaggttccgtacccgttacgtaggtacttcgaaccgtaggttaccggtactaccccggtaaccgttaaacggtttacccgaaaggggaacgtaaggtaccggttagggttccggtacggttcttaacggtaacgtttaaagttaaaggtgttacggagggttaccggggtacacccgtacgtacgtacccgtacggtaccggtacccgttacggtacggggtcggtaccccgtacgttacccgaacgtccgtaccccggtaaccgaacgaaacccgtaaaccaaccgtaaacgaaccgtcgttacgtagttactacgtacgaaacgtaacgttgaacgtacgtcgttaccgggtaagggacgtaaccgggagtaaccgtcgttcgtacgttacgttaacgtcgacgtagaacggtacgggtacggtacgtaacggtccggttaaccgggtggtaccgggttccggaccggtaccggacgggttaacccgtaccgggtaccggtgtaaccccgg

SEQ ID NO: 185576 - DNA, 834 bp, Homo sapiens
  misc_feature: GYAE6OF02I0RWW.18.85.H08.1.454.CMB.1.raw
tcagtacgagtatgcacgaccggtgctcgatttagtatcactcagtcgcgggggcccccagccctgggattcccagctgtttctgcttgctgatcaggactgcacacagagaactcaccagtggaggtttggctgagtcgttgggttttcctcgttgttcgttttttaaaggtgtcctagtgtgaggtcgcgagtcgtggtaggtaacggtccgggggtaggtcgttagttcgacggtccggtcggggggtccccgtggacgtaccgttccgtccgttcgtcgcgacgtccgttcgtggtacttcgtagtttcgtacgtcgtccgttacgtggtacgtagcctacgtacggtacctacccggaccgtaacggttaccggaagggtaacggacggtacggttggtcggtcggtacctacgtaacggttaaagttaaagtagtaggtagggtacgggtacgaccgtacgtaccgtaccgtaccggacggtaccgtacggtagggccgggtccgtaccgtaccgaccgtaccgtcccgtaccgaacgtaacccgaaaccgtaaaccgaaacggtaaccgtacgtaccgttacgtacgtaccgtacgtaacttaaaggaccgtaacgtccggtaacgtcgggtaacgggtaacgtaccggtaccggaacggtaccgttccgttacggttaaccttaacgttaccggtacgtaacgacggtacggggtaccggttacgtaccgggttacccggtacgggttaacggggtaccgggtttaccggtaccccggtacccgggtacgggtaaccccggtacgggtaccccgttcccggtaccg

SEQ ID NO: 185577 - DNA, 788 bp, Homo sapiens
  misc_feature: GYAE6OF02FHM7G.18.85.H08.1.454.CMB.1.raw
  modified_base (110)..(110): a, c, t, g, unknown or other
  misc_feature (110)..(110): n is a, c, g, or t
  modified_base (369)..(369): a, c, t, g, unknown or other
  misc_feature (369)..(369): n is a, c, g, or t
  modified_base (587)..(587): a, c, t, g, unknown or other
  misc_feature (587)..(587): n is a, c, g, or t
tcagtacgagtatgcacgaccggtgctcgatttagtatcactcagtcgcggggccccagccctggattcccagctgtttctgtcttgctgatcaggactgcacacgaganactcaccagtggtagtttggctgagtcgtttcgggttttcctcgtttgttacgtttttttaaaggtcgtccgtaggtgttaggaggtgccgagtcggttagggtacggtaaacgggtcccggggggattcgttaacgtttcgacggtccgggttcgggggtccccttaggaaccgtaccgtccgttccgtggtcgccgtaaccggtccctcgacgttaactttccgtaatttaactttaagtaacgtttagttaggtanccgtaccgtacggtccggtccgaacggtcggtccgggacgggggtaacggggcggtaggtcgggtacacctaagattacgagacgtaagtaggacgaagtaggaagtaacgtactgttacggtacgaagttcgtaggacggtaggtaaccttacgttcccgaattacctccaagaacgaacgaaacctaacggtaataaacgttacgtataccgttanacttaacgaacgtaagaaccgaactccgtacaacgagtaccggacgtaacggacgtacgtagttacttaaccgtttagttatacgggtacgaacgaaggttcgaacgtccgggttaaggaccgggaacgtaaccggtacgggtagtaccggggttcggaaccggggtaaccggacccgggttacccggtagtaacccccgg

SEQ ID NO: 185578 - DNA, 725 bp, Homo sapiens
  misc_feature: GYAE6OF01BQMI6.10.84.H07.1.454.CMB.1.raw
  modified_base (192)..(192): a, c, t, g, unknown or other
  misc_feature (192)..(192): n is a, c, g, or t
  modified_base (699)..(699): a, c, t, g, unknown or other
  misc_feature (699)..(699): n is a, c, g, or t
tcagcatagtagtgcacgaccggtgctcgatttagcagacgtctgtcgcgggaggagcatcacccagcaaccacatctgtcctctcgagaatcccctgagagctccgttcctcaccatggactggacctggagatcctcttcttggtgcagcagccacgaggacgcccactcccgaggtcgcaccgtggtcncgaggtcgggactgcgagtgagacgccgtgggcctcagtggaacggtctccgtgcgtaaggcttacgtggactacctaaccgttccaccgtagtaccttacgtatactaaccacggttacgggtcaccggtaccgacggtcccccgttaggaaccgtaacggtaccgttaggacggtagggaacgttcggggtactacggggactaaccggtaacccgtaggggaaacggtccggggtacggtaaccaaaccgttaaagttacgtacgacgtaacgtacggtaacgtccgtttaggacgggtacgtacggtaccgtacgtcgaaccgtagggaacctacgtaccgacgtccgaacacgtacggaccctagacgtaccggactacggacgaccgtacgttacgtaggtaacgtacgacggtaacggtacccgtacgtacccgttacgtaacgtttccgggacggttccggaccgggtacggggtaccgggtaacggttacccggttanacggtaaccggtccgttaaacccggg

SEQ ID NO: 185579 - DNA, 638 bp, Homo sapiens
  misc_feature: GYAE6OF02HGM33.10.84.H07.1.454.CMB.1.raw
tcagcatagtagtgcacgaccggtgctcgatttagcagacgtctgtcgcgggaggagcatcacccagcaaccacatctgtcctctcgagaatcccctgagagctccgttcctcaccatggactggacctggaggatcctcttcttggtggcagcagccacaggagcccactcccaggtgcacctggtgcagtcggggactgcagtgaggacgccgtggggcctcgagtgaaggtcctcctgcaaggtcttcgtggataccaccttcaccagtcttctatactaccacgtgggtcgccgacgacggccccgtaggaaccaaagggtccttggaacgttgggagttggggcttgggaacttcccgaaacccggtggaaacggtcgggtaggacaactaaagtttgacgcacgaggacgtcgtttacgagggaccgtagggtaccaccgggttacggaaccgtacggggaacctaccggttacccaacgttaccgaaccgaaccgacgtacccgtaacacgttacggaccctaggacgacgtagtcgtagtacgtcgtagaccgacgaccggccgttacttacgttacgtggtacggcggacgggtcgggtacgtaccgttagtcgtaggtacggtacccg

SEQ ID NO: 185580 - DNA, 625 bp, Homo sapiens
  misc_feature: GYAE6OF01C2FNX.10.16.B05.1.454.CMB.1.raw
  modified_base (384)..(384): a, c, t, g, unknown or other
  misc_feature (384)..(384): n is a, c, g, or t
  modified_base (417)..(417): a, c, t, g, unknown or other
  misc_feature (417)..(417): n is a, c, g, or t
tcagcatagtagtgcacgaccggtgctcgatttagagctcacgtagttggggtttggggggggtctcaggaggcagcgctctcgggacgtccccaccatggcctgggctctgctattcctcaccctcctcactcagggcacaggttcctgggcccagtctgccctgtctcagcctgcctccgtgtctggtctcctggacagtcgatcacatctcctgcaatggaagcgaaagtgactatttggttactttaaattttgtcttctttggtaacctaaacgagaacgacccaagaaccaaaacgacccccctaaaaatttactactaattttctagtctgtcaagtaacgtccggtaccctcgtagggtttctagtccgtctttcncgttgctcaagtctggacaacgacggcctcccngacatctcgtgggctcgagctgacggacgagactagtaattattattgctagctacgtaataactaaccaacaacctaaacgtctttagacgttagttacggacggacggaacctaaacgtcgtacccgttccgttaccgtccaccgacccgagtaccctccgtaccccgtcggtacctaccgtttcctccggttccccgtacccccg

SEQ ID NO: 185581 - DNA, 624 bp, Homo sapiens
  misc_feature: GYAE6OF01D2RP4.10.16.B05.1.454.CMB.1.raw
  modified_base (190)..(190): a, c, t, g, unknown or other
  misc_feature (190)..(190): n is a, c, g, or t
  modified_base (384)..(384): a, c, t, g, unknown or other
  misc_feature (384)..(384): n is a, c, g, or t
tcagcatagtagtgcacgaccggtgctcgatttagagctcacgtagttgggtttggggagagctctggggagtctgcaccatggcttggaccccactcctcttcctcaccctcctcctccactgcacagggtctctctcccagcttgtgctgactcaatcgccctctgcctctcgcctcccgtggggacnccgtcggtcaagctcatctgcactctgagcaggtggcacagcaactacgccatcgcagtggacatcagcagcagccgaggacgaacgggtcctacggtactgagttaggaaggttacaggttgagtcggcaacgaccaacgaaccgggtaaggggaccggactcccgtagtacgtttcgttttacgacggtccnggacgtcggtacgggctacggcgtcggtacctaccgtaccacgtactccgaccgactcccgaccgtgtcgtaggagtacgtggacggcttacgaactttacgttaacgtcgacgtacggaccgttggggacctagggtttggttaacgttggtttcggggttaccggacgggtacggtaaccgtaggtcgacccggttaccgtacggtaccggcaacccgccggacgtcgtccccccggg

SEQ ID NO: 185582 - DNA, 739 bp, Homo sapiens
  misc_feature: GYAE6OF01B6VO5.10.16.B05.1.454.CMB.1.raw
  modified_base (216)..(216): a, c, t, g, unknown or other
  misc_feature (216)..(216): n is a, c, g, or t
tcagcatagtagtgcacgaccggtgctcgatttagagctcacgtagttggggtttgggggggggtctcaggaggcggccctctcgggacgtctccaccatggcctgggctctgctattcctcaccctcctcactcagggcacgagggtcctgggcccagtctgccctgactcagcctgcctccgtgtcgtgggtctcctggacacgtccatcaccntcctcctgcacgtcggacccacagttacagttaggtaaataatagaattatcgtctccgtacgtaaccaactacgtacccaggaccaaaccgacccccaaatgatagtatttatagtatagtactaagtaactccgtacccttacggttaggggtttctgtacttcgtcctttccgtttcgtcccttacgtaacgtcgtacggaacctaaaccgtacccggtcccttacccgtacgaccctacttccgtcgtacgggtaccctaccgaggtacgtacggacggacggacggtatacgttaatttacttacgtcgaccgtaagtcctaacaactaaccgtaacgaaccggtacggacggtacggggttcgggggttacgggttccgggttacccgggggacggggaaccctacgttaccggtccggtaacccggtacgtaccgggtaccgaccggacccggtacggtcccgtcccccggtaccccgttcggtaaccccttcggttcccttccccggtaaccccc

SEQ ID NO: 185583 - DNA, 764 bp, Homo sapiens
  misc_feature: GYAE6OF01C2584.10.16.B05.1.454.CMB.1.raw
  modified_base (166)..(166): a, c, t, g, unknown or other
  misc_feature (166)..(166): n is a, c, g, or t
  modified_base (217)..(217): a, c, t, g, unknown or other
  misc_feature (217)..(217): n is a, c, g, or t
  modified_base (335)..(335): a, c, t, g, unknown or other
  misc_feature (335)..(335): n is a, c, g, or t
tcagcatagtagtgcacgaccggtgctcgatttagagctcacgtagttgggtttggggagagctctggggagtctgcaccatggcttcggaccccactcctcttcctcaccctcctcctccactgcacaggtctctctcccagcttgtgctgactcaatcgccctntcgcctctcgccctccgtgggacgccgtcggtcaagtctcatctgcactcngacgcgaggtcggacaacgacgacaaaccgtccgaccagtccgacagtcggacatacgacgacagacacgaccaggacggtaacggcctacggttactgacgtaggtaaacggttaanaggtgaagtcggacacggtaccgaacggaaccggggaaacggggtaccggtaacttacccgtaggttaacgttttccggtttacgaccggttacgacggttccgtcgggtacggggtactcgggacgtccgtaccttacccgactaccgtactacccgtacccgacgtaccctacgacgttacgtacggaacggtacgtacgggacgttacgtaaccgtactttaacgttaccgtacgtaaccggtacggtaccgggttacggaccgttacgggttagggtttacggttcgggttacggggtttacccggggaacgggtaacgggttaacccggtacggtacccgggtttaaccggttacccggttaccgggtaccgggttaacccgacccgggaaccccggtaaacgggttcccggttaaccccccgg

SEQ ID NO: 185584 - DNA, 872 bp, Homo sapiens
  misc_feature: GYAE6OF01CVVZ6.10.16.B05.1.454.CMB.1.raw
tcagcatagtagtgcacgaccggtgctcgatttagagctcacgtagttggggtttggggagagctcgtggggagtctgcaccatggcttcggaccccactcctcttcctcaccctcctcctccactgcacgaggtctctctcccgagtcttgtgctgactacaacgtccgcccttctcgcctctcgtccctcccggtagggacctccgttcggtacaacggcctaccgtactcgtacgacctacgttcgaggtacgccgtagggtacggacctaacgacggaacctaacgtaccgactacgtcgacctagcggactaacgcgacgacgacgaccgacgacgaggaacggtaccggtacccgttaggtaacgtagtaacgtaaggtaacggttaacgtagggtacgtagtaccggacgaaccggtaccggaacggtaaccggggacgggtaccgttacgtacgttcggttacgttttaccggttccggaggtacccgtagtccggttacggaggttaccgacggtaccggtaccgttaccgtaacccttaccggaacctttcccgtaccccgaccgttaccggtaccccgttacggtaccggttaagggtacgtacggtaaggtcgtaacggtcctagtttaaaccccgttcgtaccgttcggttaaccggacggttaccggtaccggggttaacctttaggttaacgggtacggtttttaccgggtaacgggggtttacccgggttaacgggggaacccggtttaaaggaccccggtttaacgtaacccgggggtttaaccccgttaccggttaacccgggtaacggtaccccgttaaaccccgggtccggttaccccggggttccccccgg

SEQ ID NO: 185585 - DNA, 757 bp, Homo sapiens
  misc_feature: GYAE6OF01BAY0K.10.16.B05.1.454.CMB.1.raw
  modified_base (383)..(383): a, c, t, g, unknown or other
  misc_feature (383)..(383): n is a, c, g, or t
tcagcatagtagtgcacgaccggtgctcgatttagagctcacgtagttgggtttggggagagctcgtggggagtctgcaccatggcttggaccccactcctcttcctccacccccctcctccactgcacgagggtcctctcctcccagtcttgtgctgactcaatccgccctctgcctctcgccctccgtgggactccgtcggtacaagcctacatcgtcgctactcgtggacgcgagggtcggccacgacgacaaccgtacggcctagtccgactagtcggacactacgacgcgacggaccgaacggccgaagggaacggtaacccggggtccccgttaacgggttacctttaggaacgttacgggtaaaacggtttaacgngggtagagtcgggaccacgaccccgaacggaaccggggaagggggtaccggtcttccgtaggttacgtttacggtttcgaacggtcaggtccgtagggtggctcggcgacctcctaaccgtccactcgtcccactaccgcctacgagtccgtagaacggtctagggaccgtcgtagtaaccgtttacttaccggtcggtaccgacggggttaccggtacggggtacttaaccggtttagggtttcgggtttacgggttcgggggtttaccgggaccgggtacggtaacggtacggtccggtcccggttaccgtaccgggttaaccgaccgggttaacccgaccggttaccgggtcccgtcccggttacccccgg

SEQ ID NO: 185586 - DNA, 954 bp, Homo sapiens
  misc_feature: GYAE6OF01AJPR4.10.16.B05.1.454.CMB.1.raw
  modified_base (187)..(187): a, c, t, g, unknown or other
  misc_feature (187)..(187): n is a, c, g, or t
tcagcatagtagtgcacgaccggtgctcgatttagagctcacgtagttgggtttggggagagctcgtggggagtctgcaccatggcttcggaccccactcctcttcctcaccctcctcctccactgcacgacgggtctcctcctcccgagtcgttgtgctcgactcaactccgccctcgtcgcctcncgccctaccggagggctccgtcggtacacgtctcactcgtcgcctacgtcgtggacgcgagggtcggacacgacgtacctaaccgtaccgacctacgtaccgactgtacggtacactacgacgcgacgaccgaccggacggaacggacgggacccgggttacccgttacggttacgtaggtaacggtaacgggtaaacggtttacgaggtagacggtaccggaccgtaccggaacccggtaaacggggaaccggggtaaccgggggtaaccgtaccgttcccggtacggtttaccgttttacggttaccgggtaccggttaccggtaccgggttaccggttcggggtaccggtaccggtaccgggtacccgtacccggttacccctaccggtacccgtaaaccgtcccgttaccccgttaaccgacccggttacccgttacgggtacgttaccgggtacgggtaaacggtaccgggttacggaccgtttaaccgttaaccgggttttaaccgtaccggtttaaccggtccgggttaaacccgggcccgggtttaaaccggggttcccgtttaacgggttcggtttttacgggttacgggtttccggggggtttacccgggggtaaacgggggtaacccgggttaaccccgggtccgggttaaacccggttcccgggttaaccccgggtaacccgggttccgggttaaaccccgggccccgttaaccccgggtacccgggttacccgggtcccccgttaacccccggg

SEQ ID NO: 185587 - DNA, 825 bp, Homo sapiens
  misc_feature: GYAE6OF01CL83U.10.16.B05.1.454.CMB.1.raw
  modified_base (797)..(797): a, c, t, g, unknown or other
  misc_feature (797)..(797): n is a, c, g, or t
tcagcatagtagtgcacgaccggtgctcgatttagagctcacgtagttggggtttgggggagagctcgtgggggagtctgcaccatggcttcggaccccacttccttcttccctccaccccttcctccctcccactgccaacgtacgggtcctcctcctccccagtcctttggtgctacgacctacaacgttcccgccccttgtcgcccttcgtccggtcccctcccggtggggacctcccgtaccgggtacaaacggtccttacattccgtacgacctaccttcggtagacgacggtacggggtacggaacaccggaactaccgtaaaccgccgaccagttcccgataacggtacgctaaactcgaacggaccagaccgaacggccgaagggaaaccggggtaccgggtaccggttacggtaaggttacgaagtaacgggtaaacgttacgagtcggagtcggaccaacgaccgaacgacggggaagggcgtactcgtagttacgtttcggttcggacggttcgacgcggtcggtcggattacggcgccgtaccctaccgtaccacccttacctaccgtacccgtccgtcccgttacgacgggttacgacgggtaaggtttacgacgggttacgtaccgttaaccgtagtttaaccgtacggttacggaccggtaacgggtaccgggttcgggtaacgttgggtttaacggtttcggggttccgggttcggggttacggaacgggggtaacccgtacgtagggtcccgtacggttaccgggacgttaacgggaccncccgggtaaaccgtcgtccccgtcccgg

SEQ ID NO: 185588 - DNA, 765 bp, Homo sapiens
  misc_feature: GYAE6OF01E49VC.10.16.B05.1.454.CMB.1.raw
  modified_base (148)..(148): a, c, t, g, unknown or other
  misc_feature (148)..(148): n is a, c, g, or t
  modified_base (189)..(189): a, c, t, g, unknown or other
  misc_feature (189)..(189): n is a, c, g, or t
  modified_base (304)..(304): a, c, t, g, unknown or other
  misc_feature (304)..(304): n is a, c, g, or t
  modified_base (386)..(386): a, c, t, g, unknown or other
  misc_feature (386)..(386): n is a, c, g, or t
  modified_base (517)..(517): a, c, t, g, unknown or other
  misc_feature (517)..(517): n is a, c, g, or t
  modified_base (562)..(562): a, c, t, g, unknown or other
  misc_feature (562)..(562): n is a, c, g, or t
  modified_base (569)..(569): a, c, t, g, unknown or other
  misc_feature (569)..(569): n is a, c, g, or t
tcagcatagtagtgcacgaccggtgctcgatttagagctcacgtagttgggtttggggagagctcgtggggatctgcaccatggcttcggaccccactcctcttcctcaccctcctcctccactgcagaggtctctctccagtcttgngctagactcaactccgccctcgtcgcctctcgcccgtccgngggactccgtcggtacaacgtcctcactccgtcgcctacgttcaggacgtcgagggtcggaccacgtacgaccaaccgtaccgccacgtccgactaagtcggtacagtaccgganccggaagccgtaaccgaccggaaaggaccggggtaacggtccccggttagtaactaggagttaacgggtaaacgtttaacgnggtacgaggtacgaccgaacgtaacccggaacgaaaccgggggtagggaccgtactacccgggttagttacggttttaccggttacgacccggtagacgtccggtaggtcccgggattacggaccgtaccnccgttaacccgcaaccttcgtcccgtaaccgcgttaccgacggtntaccggnggtagtaccgaggtacgtccgttaactactttaccggtaccgtacgtacgtaaccgggcgttaacggttcttacgggttaggttcggtttaggggtttccggggaacggcggggttaaacccggaacggttcgtcccgggtaccgttaccgaccgggttggacccgtaacgtcccggaacgttcccgggtaccccg

SEQ ID NO: 185589 - DNA, 790 bp, Homo sapiens
  misc_feature: GYAE6OF01A2KYM.10.16.B05.1.454.CMB.1.raw
  modified_base (285)..(285): a, c, t, g, unknown or other
  misc_feature (285)..(285): n is a, c, g, or t
  modified_base (770)..(770): a, c, t, g, unknown or other
  misc_feature (770)..(770): n is a, c, g, or t
tcagcatagtagtgcacgaccggtgctcgatttagagctcacgtagttggggtttggggggggtctcaggaggccggccctctcgggacgtctccaccatggcctgggctctgctattcctcaccctcctcactcgagggcacgacggggttcctcgggcccagtctgccctgactcagcctgcctcggtgtcgtcgggtcctccgtaggaccagtcgtatccacagtcctcctgacctacgtggaacctgacgtagtcggtacgtttggtagttaataacgttntgtcctcgacggtaaccaacaccaccgagaccaaccgacccctaatcattacggttattttggattacggtacctaacggtaaccgtccggtacccgttaggtacgggtttactaacgttccgttacttccgttcggtcggtacctaccgtaacggtcgtacgggacctaaacccggtccgtaccctcccgtacgaacccgtacttccggttcgtaccggggtccctacggtacgggtacgttcgggaaacgggtacggtacggttagttaaccgttaagttttaccgtacggtccgttacgaaacctttcgtaactaacgtaacctaaccgtacgtaacaccggttataccggtttaaccttacggttcggtaacccgtcggggtaacgggacggtaaccgtaaccgccggttaacccgtaccggttcggtaacggtacccgtaaccggtccgtaacccggtcccgtacccgtacccccggttntaccctacccgggtttcccc

SEQ ID NO: 185590 - DNA, 712 bp, Homo sapiens
  misc_feature: GYAE6OF02IWQ3X.10.16.B05.1.454.CMB.1.raw
tcagcatagtagtgcacgaccggtgctcgatttagagctcacgtagttgggtttggggggggtctcaggaggcggccctctcgggacgtctccaccatggcctggctctgctattctcaccctcctcactcagggcacagggtcctggcccagtctgaccctgactcagcctgcctccgtgtctgggtctcctggactagtccatcaccatctcctgcactggacccactagttacattacggtaaataagtgaatgtagtctcctggtaccactacgtaccaggacaacgaccccaatgatcgtactttatgagtatactaagtaactccgtacctacggtaaggtttctagagttcgtcctttagttccaccttaaccgtaacgttcgtacgtacgaaccgaccggtccctccgtacggaaccttagtctcgtcgggtacctccgacgacgttggaaccggtaccggagtacctagtaacgtttacttaacgtcggtaacacgcctagtaacccagtaaccgaacggtacgactaacggggtcggttacgggttaaggttcccgggggagggaccccgaagtacccggtaccggttaaccgtttccggaaaccggttacggaacccgtaaacccgggtaaccgtcccggttccccgttacccccggttacggacccgtttaacccgtttacgtaccccggtttacccccc

SEQ ID NO: 185591 - DNA, 871 bp, Homo sapiens
  misc_feature: GYAE6OF02F472R.10.16.B05.1.454.CMB.1.raw
  modified_base (149)..(149): a, c, t, g, unknown or other
  misc_feature (149)..(149): n is a, c, g, or t
  modified_base (192)..(192): a, c, t, g, unknown or other
  misc_feature (192)..(192): n is a, c, g, or t
tcagcatagtagtgcacgaccggtgctcgatttagagctcacgtattgggtttcggggagagctctggggagtctgcaccagtggcttggaccccactcctcttcctcaccctcctcctccactgcacagggtctctctcccagcttgngctgactacaatcgccctctcgcctctagcctcccgtgggacncctcggtcaagctcatctgactacctcgtgacgacgtaggtcgggacacgtaggacctaaaccgttaccggaccctaacgtccgaccgaacgttcgggacctacggttaccacgtaccgtaacggaccaacggtaccccgaaaggaaccgggtaaccgggtcccccgttacgggttaacccgttaggtaacgttacgggtaaacggttaaacgtacggttaggtacgttacgggaccgtaaccgtacccgaaaccgtaacccggggaaacggggggtaaccggtaccgttaccccggttaaggttaccgtttttacgggttttaccggtacggggttacccgtacggtaccgttaccgggtccgggtacgttacggtaccgtacccgttaccttaacccgtaccgtacccgtacgttacccgttacccgtaacccgtccttaaccggtcgttaccgtacgggaacggtagtcgggtacgtaccgtacggttaacttacccgttagtaccggtaccgttaaccggaccgggttacgggaacctttaccggttggtttagttacgggtttacgggttaccggacgggtaaccgggtaccgtaccggttccggtaccggttaacccggttccggttaaccggtacggtacccgtaacccgggtacggtccccgtaccccggg

SEQ ID NO: 185592 - DNA, 975 bp, Homo sapiens
  misc_feature: GYAE6OF02JHMAN.10.16.B05.1.454.CMB.1.raw
  modified_base (147)..(147): a, c, t, g, unknown or other
  misc_feature (147)..(147): n is a, c, g, or t
  modified_base (192)..(192): a, c, t, g, unknown or other
  misc_feature (192)..(192): n is a, c, g, or t
  modified_base (198)..(198): a, c, t, g, unknown or other
  misc_feature (198)..(198): n is a, c, g, or t
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
tcagcatagtagtgcacgaccggtgctcgatttagagctcacgtagttgggtttgggagagctctggggagtctgcaccatggcttggaccccatcctcttcctcaccctctcctccactgcacgaggtctctctacccagctttgngctagactcaacttccgccctctcgccttcgacgtccctacccgngggacnccgtcggtcagtcctactntcgngactcgttacgtgacgtaccgtagggtacggacacgttaacggcctaaacaccggcctaagtcgacgtacggtacgtccgtagaccgcgaccggaagcgacggtaaccgtaaggaaccggtaaccggttcccgtacgttaaaacttggaaacgtttacggaaacgtttaccgacggtcgggtaactccgggactaacgggtacccgtaaaccgggaaacgggggttaaaccggggtaaccggttacccgttccgggtttaaaacgggtttccgtttttaaccccggggttttaaacgggaacccgggttttaaccgaacgggtttcccgggttaccggggggttaaacccggggttcctaaccgggtttaacggggttacccctaccgttttaaaccccgggaaccttaaacccggttttaacccgaccggtttaaaccccgggtcgtttaaccccggaacgttaaccggtttaaaggccgggttaaaaccggggtccttaggggtaaccgtacggtttaaaccggtttaaacctcgttttaaccgggtacgtttcggaaaccccggttacggggaccgtttaccgtaaaggggtttaccggtttacgggtttaccggggtttacgggggtaaccgggttaccgggtaaaccgttaacggggtccgttaaccggggtaccgtttaacccgggttacggtttaccggaaccgggtaaccccgttacggttaacggggttccccggtaaccccggg

SEQ ID NO: 185593 - DNA, 664 bp, Homo sapiens
  misc_feature: GYAE6OF01BAY0A.44.64.F09.1.454.CMB.1.raw
  modified_base (184)..(184): a, c, t, g, unknown or other
  misc_feature (184)..(184): n is a, c, g, or t
  modified_base (292)..(292): a, c, t, g, unknown or other
  misc_feature (292)..(292): n is a, c, g, or t
tcagacagtatatacacgaccggtgctcgatttagcgcgtatacaaggggagagaagacaggattcaggacaatctccagcatggccggcttccctctcctcctcaccctcctcactcactgtgcagggtcctgggcccagtctgtgctgactcagccatcctcagcgtctggggacccccggnagacggtcacgatcttttgtctggaagtaggtccaacatcggaataattacgtatactggtatcggcaattcacaggagcggtccccagacccctcatctataggganaatcagcggccctcgacggggtccctgaccgtattctctcgccctccgaagtccgtcggccaccgtcacgtcccctcccgtggccctatccgagggtcgggcccttcccggggtaccgaggtacgtgacggtcgttgtatttacgtttcgtggtggtccgggtcgttaggggattacgacgtacgttccgtaggtaggtacggaccgttggtccttacggttccggggacgggtaacggggaacctaggaccgtacggtacccgttaccgtaagtccgaacgtaccccgaacgggtccctacccgggtcccccctcgggtcccacccgttcccgttaccggttaccccccaccccttcccttccgttaaccg

SEQ ID NO: 185594 - DNA, 246 bp, Homo sapiens
  misc_feature: GYAE6OF02F8OI1.44.64.F09.1.454.CMB.1.raw
  modified_base (243)..(246): a, c, t, g, unknown or other
  misc_feature (243)..(246): n is a, c, g, or t
tcagacagtatatacacgaccggtgctcgatttagcgcgtatacaaggggagtcggtcggccgggcttgacatctggggccagggattactggtcaccgtctcctctgcctccaccaagggcccatcggtcttccccctggcgccctgctccaggagcacctccgagagcacagcggccctgggctgcctggtcaaggactacttccacgtctactgctgagcgggctggcaaggcgcatagnnnn

SEQ ID NO: 185595 - DNA, 553 bp, Homo sapiens
  misc_feature: GYAE6OF02HJQ08.44.64.F09.1.454.CMB.1.raw
tcagacagtatatacacgaccggtgctcgatttagcgcgtatacaaggggagagaagacaggactcaggacgatctccagcatggccagcttccctctcctcctcaccctcctcactcactgtgcagggtcctgggcccagtctgtgatgtctcagccaccctcagcgtctgggacccccgggcagggggtcaccatctcttgttctggaaggaagtccaatatcggatcttatcctgtcaactggtatcggggactcccaggcaccggcccccgactccttatctatgctactaatcagcggccctcgacggggtccctgcccgattctctggctccaagtctggcactacaggctacctggccatccttgactctccagtctgagatgaggctgtattactactgtgctagctagtgggatgacacggccgggaacggcgtgggtcggttcgggcgggacgggaccgtaaggttcggaccgtcgtaggtcgacgcccgaaggcctccggccccgttcggtccacgtccgtcgttccccgcccttcctctac

SEQ ID NO: 185596 - DNA, 537 bp, Homo sapiens
  misc_feature: GYAE6OF02GFE25.44.64.F09.1.454.CMB.1.raw
  modified_base (184)..(184): a, c, t, g, unknown or other
  misc_feature (184)..(184): n is a, c, g, or t
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
  modified_base (306)..(306): a, c, t, g, unknown or other
  misc_feature (306)..(306): n is a, c, g, or t
  modified_base (385)..(385): a, c, t, g, unknown or other
  misc_feature (385)..(385): n is a, c, g, or t
  modified_base (423)..(423): a, c, t, g, unknown or other
  misc_feature (423)..(423): n is a, c, g, or t
  modified_base (447)..(447): a, c, t, g, unknown or other
  misc_feature (447)..(447): n is a, c, g, or t
tcagacagtatatacacgaccggtgctcgatttagcgcgtatacaaggggagagaagacaggattcaggacaatctccagcatggccggcttccctctcctcctcaccctcctcactcactgtgcagggtcctgggcccagtctgtgctgactcagccatcctcagcgtctgggacccccgggnagacggtcacgatcttttgtctggaagtaggtccaacatcggaagtaatacgtatactggtatcggcaattcacaggagcggtccccagacccctnatctataggganaatcagcggccctnacggggtccctgaccgattctctgcctaccaagtcctggccacctcacgcctcctggccatcagtggctccggtcgagntgaggctgtattattctgtgcggtcgttgggatgactntccgtgagtgactgctagttcggnggaggaccagtctacgaccgtactacgtcacgaccgaaggtcctacgccccgtcggtccacgttcgtaccgttcccacccttcctactac

SEQ ID NO: 185597 - DNA, 783 bp, Homo sapiens
  misc_feature: GYAE6OF02HUO8I.44.64.F09.1.454.CMB.1.raw
  modified_base (186)..(186): a, c, t, g, unknown or other
  misc_feature (186)..(186): n is a, c, g, or t
tcagacagtatatacacgaccggtgctcgatttagcgcgtatacaaggggagagaagacaggattcaggacaatctcagcatggccggcttccctctcctcctcaccctcctcactcactgtgcagggtcctgggcccagtctgtgctgactcagccatcctcgagcgtcgtcggggacccccggnaggaccggtcaccgatttccttttggtactaggtaaggttacggtaccaactacgtcggaagttaacttacgtatccgtggtagtcggctaaattcgacgaggacgccggtccccacgtacccctactatctaggtagggagtaactcgacggaccgtcccgtacggtacggggtccctacggaccgtacgttcgtaccgtcggtccctacgtaacggtcgtacgggcctaccgtccgtaccgtccctacccgtgtaccacgtacggtacgggtaccggttcccggtacccgggtaccggtacggtcgtacgggtacgtacgtacgtttaagtttcgtttacgtggttacgggtcggtcggttagggtacttacggtacctacggttcgtcgggtagtacggtaccggttgttaccggttacggttccggggaacgggtaaccgggtaaccgtacggtaccggtaccggtaccgttaccgtaaccggtaccgacccgggttaccggacggttacccggtacccgggtcccccgttacggtacccttcccggttaccttcccccggtttacccccgtaccctttcccgtacgttaacc

SEQ ID NO: 185598 - DNA, 507 bp, Homo sapiens
  misc_feature: GYAE6OF01ANRQL.16.53.E09.1.454.CMB.1.raw
  modified_base (494)..(507): a, c, t, g, unknown or other
  misc_feature (494)..(507): n is a, c, g, or t
tcagtgtactactccacgaccggtgctcgatttagagagagtgtgttgggtttgggattcacgttgcagatgtaggtctgggtgcgccagatgcccgggaaaggcctggagtggatggggaggattgaggctagtgactcttataccaactacagcccgtccttccaaggccacgtcaccatctcagttgacaagtccatcaacactgcccacctgcagtggagcagcctgaaggcctcggacaccgccatgtattactgtgcgagacatggggatttatattgtactaataatgtatgccactttgactactggggccagggaaccctggtcaccgtctcctcacgcctccaccaagggcccatccggtcttccccctggccaccccgtcctcccaacgacgccacctcgtgggggcacgagcggccctgggctcgcctggtcaacggactacttcgagtagtacacgtgagtcgggctggcaggcgcatagnnnnnnnnnnnnnn

SEQ ID NO: 185599 - DNA, 583 bp, Homo sapiens
  misc_feature: GYAE6OF01BF3GB.16.53.E09.1.454.CMB.1.raw
  modified_base (563)..(563): a, c, t, g, unknown or other
  misc_feature (563)..(563): n is a, c, g, or t
  modified_base (568)..(568): a, c, t, g, unknown or other
  misc_feature (568)..(568): n is a, c, g, or t
  modified_base (570)..(574): a, c, t, g, unknown or other
  misc_feature (570)..(574): n is a, c, g, or t
  modified_base (577)..(581): a, c, t, g, unknown or other
  misc_feature (577)..(581): n is a, c, g, or t
  modified_base (583)..(583): a, c, t, g, unknown or other
  misc_feature (583)..(583): n is a, c, g, or t
tcagtgtactactccacgaccggtgctcgatttagagagagtgtgttgggtttgggattcacgttgcagatgtaggtctgggtgcgccagatgcccgggaaaggcctggagtggatggggaggattgaggctagtgactcttataccaactacagcccgtccttccaaggccacgtcaccatctcagttgacaagtccatcaacactgcccactgcagtggagcagcctgaaggcctcggacaccgcatgtattactgtgcgagacagtggggatttatattgtactaataatgtatgcctactttgactacgtgggccaggaaccctggtcaccgtctcctcacgcctccaccaacggcccagtccggtccttccccctcggccacccctcctccaacgacgccaccgtcgcgggggtacacgacgccggcccgtcgggcgtcgtcccgtcggtaccgtaacggtaccgtaccgttacccggtaagttacggtaacgtaaccgttcggaacgggtccggggccgttcgggaccggaacgggcccggaacgaagttaccggancgagngnnnnngcnnnnngn

SEQ ID NO: 185600 - DNA, 492 bp, Homo sapiens
  misc_feature: GYAE6OF01D6JAS.16.53.E09.1.454.CMB.1.raw
  modified_base (485)..(486): a, c, t, g, unknown or other
  misc_feature (485)..(486): n is a, c, g, or t
  modified_base (488)..(492): a, c, t, g, unknown or other
  misc_feature (488)..(492): n is a, c, g, or t
tcagtgtactactccacgaccggtgctcgatttagagagagtgtgttgggtttgggattcacgttgcagatgtaggtctgggtgcgccagatgcccgggaaaggcctggagtggatggggaggattgaggctagtgactcttataccaactacagcccgtccttccaaggccacgtcaccatctcagttgacaagtccatcaacactgcccacctgcagtggagcagcctgaaggccctcggacaccgccatgtattactgtgcgagacatggggatttatattgtactaataatgtatgccactttgactactgggccagggaaccctggtcaccgtctcctcacgcctccaccaacggcccactccggtccttccccctggccaccctcctccaacgacgcaccctcgtcggggcacgacgcgccgtgggctcgcctggcagactactcgagtagtacagtgagcggctggacaggcgcatgnngnnnnn

SEQ ID NO: 185601 - DNA, 605 bp, Homo sapiens
  misc_feature: GYAE6OF01E1XTY.16.53.E09.1.454.CMB.1.raw
  modified_base (572)..(572): a, c, t, g, unknown or other
  misc_feature (572)..(572): n is a, c, g, or t
  modified_base (576)..(576): a, c, t, g, unknown or other
  misc_feature (576)..(576): n is a, c, g, or t
  modified_base (578)..(579): a, c, t, g, unknown or other
  misc_feature (578)..(579): n is a, c, g, or t
  modified_base (581)..(582): a, c, t, g, unknown or other
  misc_feature (581)..(582): n is a, c, g, or t
  modified_base (584)..(584): a, c, t, g, unknown or other
  misc_feature (584)..(584): n is a, c, g, or t
  modified_base (586)..(590): a, c, t, g, unknown or other
  misc_feature (586)..(590): n is a, c, g, or t
  modified_base (592)..(605): a, c, t, g, unknown or other
  misc_feature (592)..(605): n is a, c, g, or t
tcagtgtactactccacgaccggtgctcgatttagagagagtgtgttgggtttgggtgcgccagatgcccgggaaaggcctggagtggatggggaggattgaggctagtgactcttataccaactacagcccgtccttccaaggccacgtcaccatctcagttgacaagtccatcaacactgcccacctgcagtggagcagcctgaaggcctcggacaccgccatgtattactgtgcgagacagtgggtatttatattgtactaataatgtatgcctatttcgactacgtgggccacgggaaccctggtccaccgtcctcctcacgccctaccaccgaacgggcccacgtccggttcccttcccccgtcggccctacccctccgttaccaacgacgcctaccgtcggtcgggggaccacgacggccggcccgtggggtcctcggccggttcggtacccgtaaaggtacccgttaacccgttaccgggaagtttaacggtaaccgtacggttcgggaacgggtcccggggtacggttcgggaaccggaacgggccggtaacgaagttaacggntcgngnngnngngnnnnngnnnnnnnnnnnnnn

SEQ ID NO: 185602 - DNA, 643 bp, Homo sapiens
  misc_feature: GYAE6OF01DL3VQ.16.53.E09.1.454.CMB.1.raw
  modified_base (204)..(204): a, c, t, g, unknown or other
  misc_feature (204)..(204): n is a, c, g, or t
tcagtgtactactccacgaccggtgctcgatttagagagagtgtgttgggtttgggattcacgttgcagatgtaggtctgggtgcgccagatgcccgggaaagcctggagtggatggggaggattgaggctagtgactcttataccaactacagcccgtccttccaaggccacgtcaccatctcagttgacaagtccatcaacnctgcccacctgcagtggagcagcctgaacggcctcggacaccgcatgtattactgtgcgagacagtgggtatttatattgtaactaataatgtatgcctatttgactacgtgggaccaggaccctggtcaccgtctcctacacgcctacacgaacggccatccggttccttccccgtggtccaccccgtccctaccaacgcgacctaccgtcgtcgggggcacgacgtccggaccgtcgggacctcgccgtacgggtaccgaacggtaccgttaaccgttaccggaacgttaacggtaaccgtaacggtacgggtaacgggccggggtaccggttacggggaaccggaaccggggtaccggtaaccgtaaaggtaaccggttagaccgggttacgtacgtacgacgacgtacgtacgtacgacgacgacgagacgtacg

SEQ ID NO: 185603 - DNA, 176 bp, Homo sapiens
  misc_feature: GYAE6OF01B5S3T.16.53.E09.1.454.CMB.1.raw
  modified_base (171)..(176): a, c, t, g, unknown or other
  misc_feature (171)..(176): n is a, c, g, or t
tcagtgtactactccacgaccggtgctcgatttagagagagtgtgttgggttgggggaagaggaagactgacggtccccaggagttcaggtgctgggcacagcggccctgggctgcctggtcaaggactacttccgagtagtacactgagcgggctggcaaggcgcatagnnnnnn

SEQ ID NO: 185604 - DNA, 584 bp, Homo sapiens
  misc_feature: GYAE6OF01EQMQH.16.53.E09.1.454.CMB.1.raw
  modified_base (225)..(225): a, c, t, g, unknown or other
  misc_feature (225)..(225): n is a, c, g, or t
  modified_base (437)..(437): a, c, t, g, unknown or other
  misc_feature (437)..(437): n is a, c, g, or t
  modified_base (538)..(538): a, c, t, g, unknown or other
  misc_feature (538)..(538): n is a, c, g, or t
  modified_base (567)..(568): a, c, t, g, unknown or other
  misc_feature (567)..(568): n is a, c, g, or t
  modified_base (571)..(584): a, c, t, g, unknown or other
  misc_feature (571)..(584): n is a, c, g, or t
tcagtgtactactccacgaccggtgctcgatttagagagagtgtgttgggtttgggattcacgttgcagatgtaggtctgggtgcgccagatgcccgggaaaggcctggagtggagtgggggaggattgaggctagtgactcttataccaactacagcccgtccttccaaggccacgtcaccatctcagttgacagtccatcaacactgcccacctgcagtggancagcctagacggcctcggacaccgcatgtattactgtgcgagacagtggggtatttatattagtactaattaatgtatcgcctactttgtacgtacgtggggccgaacgggtaccctggtccaccgttctccctacacgcctccgaaccaacgggtcccacgttccgttccccttccccgtcgggtccctaccccgtccctaccaacggacncccgaaccgtccgcggggggaccaccgacggaccgggcccgtcgggcctcgtccggtcgtaccgacgtaccttaccgttaccggtacgtacgtaccacggngcggcgggcgtggacgtacgcgacgatgnngtnnnnnnnnnnnnnn

SEQ ID NO: 185605 - DNA, 561 bp, Homo sapiens
  misc_feature: GYAE6OF01A6Y09.16.53.E09.1.454.CMB.1.raw
  modified_base (225)..(225): a, c, t, g, unknown or other
  misc_feature (225)..(225): n is a, c, g, or t
  modified_base (421)..(421): a, c, t, g, unknown or other
  misc_feature (421)..(421): n is a, c, g, or t
  modified_base (543)..(543): a, c, t, g, unknown or other
  misc_feature (543)..(543): n is a, c, g, or t
  modified_base (546)..(546): a, c, t, g, unknown or other
  misc_feature (546)..(546): n is a, c, g, or t
  modified_base (549)..(549): a, c, t, g, unknown or other
  misc_feature (549)..(549): n is a, c, g, or t
  modified_base (552)..(561): a, c, t, g, unknown or other
  misc_feature (552)..(561): n is a, c, g, or t
tcagtgtactactccacgaccggtgctcgatttagagagagtgtgttgggtttgggattcacgttgcagatgtaggtctgggtgcgccagatgcccgggaaagcctggagtggatggggaggattgaggctagtgactcttataccaactacagcccgtccttccaaggccacgtcaccatctcagttgacaagtccatcaaacactcgcccacctgcagtggancagcctgaacggcctcggacaccgcatgtattactgtgcgagacagtggggtatttatattagtaacttaataatgtaatgtacctactttcgacgtacgtcggggaccacgggtacctggtaccaccgtctcctcacgtcctaccgacgaacggccacgtcgtcccttcccgtcgccctaccctcaccgaagacnccaccgttcggtcggggcacgcgccggaccgtcggtctcgtccgtcggtcgaaacggtccttaccgtcgaagttacgacctacgtcggaacggtccggacgtcgacggaggtcacgtatcgnagngancgnnnnnnnnnn

SEQ ID NO: 185606 - DNA, 625 bp, Homo sapiens
  misc_feature: GYAE6OF01ELKD6.16.53.E09.1.454.CMB.1.raw
  modified_base (595)..(595): a, c, t, g, unknown or other
  misc_feature (595)..(595): n is a, c, g, or t
  modified_base (597)..(601): a, c, t, g, unknown or other
  misc_feature (597)..(601): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
  modified_base (608)..(615): a, c, t, g, unknown or other
  misc_feature (608)..(615): n is a, c, g, or t
  modified_base (617)..(623): a, c, t, g, unknown or other
  misc_feature (617)..(623): n is a, c, g, or t
  modified_base (625)..(625): a, c, t, g, unknown or other
  misc_feature (625)..(625): n is a, c, g, or t
tcagtgtactactccacgaccggtgctcgatttagagagagtgtgttgggtttgggtgcgccagatgcccgggaaaggcctggagtggagtggggaggattgaggctagtgactcttataccaactacagcccgtccttccaaggccacgtcaccatctcagttgacaagtccatcaacactgcccacctgcagtggagcagcatgaggcctcggacaccgccatgtattactgtgcgagacagtgggtatttatattacgtactaataatgtatgcctactttgacgttacgtcggggaccgacgggtaaacccgtcggtacacccggttcctacccgtcaccgccctacccaacccgtaacgggccctacgttccccggttacctttccccccgtcggacccctaccccgtacccttacccaacgtaaccgcctacccgtcggtcgggggaccacgacgggccggacccgtggggcctcggacccgttcggtaacgaaccgggtaaccttaccgttacccggtagttaacgtaccgtaacgtacggtaccgggccggtccggtcgggacgacgggaccgcgtaagtacggcgngnnnnncgngngnnnnnnnngnnnnnnngn

SEQ ID NO: 185607 - DNA, 497 bp, Homo sapiens
  misc_feature: GYAE6OF02FHDU2.16.53.E09.1.454.CMB.1.raw
  modified_base (338)..(338): a, c, t, g, unknown or other
  misc_feature (338)..(338): n is a, c, g, or t
  modified_base (483)..(497): a, c, t, g, unknown or other
  misc_feature (483)..(497): n is a, c, g, or t
tcagtgtactactccacgaccggtgctcgatttagagagagtgtgttgggtttgggattcacgttgcagatgtaggtctgggtgcgccagatgcccgggaaaggcctggagtggatggggaggattgaggctagtgactcttataccaactacagcccgtccttccaaggccacgtcaccatctcagttgacaagtccatcaacactgcccactgcagtggagcagcctgaaggcctcggacaccgccatgtattactgtgcgagacatggggatttatattgtactaataatgtatgccactttgactactggggccagggaaccctggtcaccgtntcctcagcctccaccaagggcccatcggtcttccccctggccaccctcctccaagacgcacctctgggggcacagcggccctgggctgcctggtcaaggactacttccgagtagtacactgagcgggctggcaaggcgcatagcnnnnnnnnnnnnnnn

SEQ ID NO: 185608 - DNA, 462 bp, Homo sapiens
  misc_feature: GYAE6OF02I8M5J.16.53.E09.1.454.CMB.1.raw
  modified_base (451)..(462): a, c, t, g, unknown or other
  misc_feature (451)..(462): n is a, c, g, or t
tcagtgtactactccacgaccggtgctcgatttagagagagtgtgttgggtttgggtgcgccagatgcccgggaaaggcctggagtggatggggaggattgaggctagtgactcttataccaactacagcccgtccttccaaggccacgtcaccatctcagttgacaagtccatcaacactgcccacctgcagtggagcagcctgaaggcctcggacaccgccatgtattactgtgcgagacatggggatttatattgtactaataatgtatgccactttgactactggggccagggaaccctggtcaccgtctcctcagcctccaccaagggcccatcggtcttcccctggcaccctcctccaacgagcacctctgggggcacagcgcctggctgcctggtcaaggctacttccgagtagtacactgagcgggctggcaaggcgcatagnnnnnnnnnnnn

SEQ ID NO: 185609 - DNA, 494 bp, Homo sapiens
  misc_feature: GYAE6OF02I6NR9.16.53.E09.1.454.CMB.1.raw
  modified_base (479)..(494): a, c, t, g, unknown or other
  misc_feature (479)..(494): n is a, c, g, or t
tcagtgtactactccacgaccggtgctcgatttagagagagtgtgttgggtttgggattcacgttgcagatgtaggtctgggtgcgccagatgcccgggaaaggcctggagtggatggggaggattgaggctagtgactcttataccaactacagcccgtccttccaaggccacgtcaccatctcagttgacaagtccatcaacactgcccacctgcagtggagcagcctgaaggcctcggacaccgccatgtattactgtgcgagacatggggatttatattgtactaataatgtatgccactttgactactggggccagggaccctggtcaccgtctcctcagcctccaccaagggcccatcggtcttccccctggccaccctcctccaagcgcacctctggggcacagcggccctgggctgcctggtcaaggctacttccgagtagtacactgagcgggctggcaaggcgcatagnnnnnnnnnnnnnnnn

SEQ ID NO: 185610 - DNA, 513 bp, Homo sapiens
  misc_feature: GYAE6OF02GFGG8.16.53.E09.1.454.CMB.1.raw
  modified_base (478)..(478): a, c, t, g, unknown or other
  misc_feature (478)..(478): n is a, c, g, or t
  modified_base (498)..(513): a, c, t, g, unknown or other
  misc_feature (498)..(513): n is a, c, g, or t
tcagtgtactactccacgaccggtgctcgatttagagagagtgtgttgggtttgggattcacgttgcagatgtaggtctgggtgcgccagatgcccgggaaaggcctggagtggatggggaggattgaggctagtgactcttataccaactacagcccgtccttccaaggccacgtcaccatctcagttgacaagtccatcaacactgcccacctgcagtggagcagcctgaaggcctcggacaccgccatgtattactgtgcgagacatggggatttatattgtactaataatgtatgccactttgactactggggccagggaaccctggtcaccgtctcctcacgcctccaccaacggcccatcggtccttccccctggccacccctcctacccaagacgccaccctcgtcgggggcacgacgccggcccgtgggcctgccgtggtcaaggacctacttccgagtacgtacactgngcggcgtggcaggcgcatgnnnnnnnnnnnnnnnn

SEQ ID NO: 185611 - DNA, 818 bp, Homo sapiens
  misc_feature: GYAE6OF02FFT1K.16.53.E09.1.454.CMB.1.raw
  modified_base (144)..(144): a, c, t, g, unknown or other
  misc_feature (144)..(144): n is a, c, g, or t
  modified_base (199)..(199): a, c, t, g, unknown or other
  misc_feature (199)..(199): n is a, c, g, or t
  modified_base (222)..(222): a, c, t, g, unknown or other
  misc_feature (222)..(222): n is a, c, g, or t
  modified_base (791)..(791): a, c, t, g, unknown or other
  misc_feature (791)..(791): n is a, c, g, or t
  modified_base (800)..(800): a, c, t, g, unknown or other
  misc_feature (800)..(800): n is a, c, g, or t
  modified_base (811)..(811): a, c, t, g, unknown or other
  misc_feature (811)..(811): n is a, c, g, or t
  modified_base (814)..(814): a, c, t, g, unknown or other
  misc_feature (814)..(814): n is a, c, g, or t
  modified_base (816)..(817): a, c, t, g, unknown or other
  misc_feature (816)..(817): n is a, c, g, or t
tcagtgtactactccacgaccggtgctcgatttagagagagtgtgttgggtttgggattcacgttgcagatgtaggtctgggtgcgccagatgcccgggaaagcctggagtggatggggagattggaggctagtgacctcttanaccaactcagcccgtctcaagccacgtcacatctcagttgacaagtccatcaacnctcgcccactgaccgagtggacncgacgccctaggaacgcctacgggaccaccgcctagttcgttacttacgtgtcggcgaacgtaccaggttacggggtattttattaagttacgttaacttaactaagttagtacttcgacccttacgtttacgtaaccgttaccggtacggggtaccccgtaacggggtaacccgtttcggtacccgtaaccccggttccttcccgtaccgtacccggtacccttaccccggaacggtaaacccggggtcccctaacggtttcccccggtttccccgtacccccgttccgggtacccccttaccccgttacccctaaccgaaccgtaccgtaacccgtacccggtacggggtccgggaaccccgtaaccgggtacccgggccccgggtacccgggttccgggtacccttccgggttacccggtttaaccgggaaccggtttaaacccgggttaccctttaacccgggttaccggaacgtttaaccgggtaaccgtacgggttaccgggaaccgggttcgggacccggttaacgggaaccgtacgggtccaaggttaaccgtgactcganacctgtcgnacgcttcgacntcncnnc

SEQ ID NO: 185612 - DNA, 654 bp, Homo sapiens
  misc_feature: GYAE6OF02F45I7.16.53.E09.1.454.CMB.1.raw
  modified_base (226)..(226): a, c, t, g, unknown or other
  misc_feature (226)..(226): n is a, c, g, or t
  modified_base (625)..(625): a, c, t, g, unknown or other
  misc_feature (625)..(625): n is a, c, g, or t
  modified_base (638)..(638): a, c, t, g, unknown or other
  misc_feature (638)..(638): n is a, c, g, or t
  modified_base (641)..(642): a, c, t, g, unknown or other
  misc_feature (641)..(642): n is a, c, g, or t
  modified_base (644)..(644): a, c, t, g, unknown or other
  misc_feature (644)..(644): n is a, c, g, or t
  modified_base (647)..(654): a, c, t, g, unknown or other
  misc_feature (647)..(654): n is a, c, g, or t
tcagtgtactactccacgaccggtgctcgatttagagagagtgtgttgggtttgggattcacgttgcagatgtaggtctgggtgcgccagatgcccgggaaaggcctggagtggatggggaggattgaggctagtgactcttatacccaaactacagcccgtccttccaaggccacgtcaccatctcagttgacaagtccatcaacactgcccacctgcagtggancagcctgaaggcctcggacaccgccatgtattactgtgcgagacagttggggatttaatattgtactaataatgttatgcctactttgactacgtcggggccagggaaccctggtccaccgtccttcctcacgtccctacccgaaccaacgggcccgacgttcccgggtcctttcccccccgtacgggtaccctaaccccccgttccctacccgtaaacggacgaccctacccgtcccggttacgggggggtcccaaccggtacgggtccccgggcccggttacggggtcctacggtcccgttacgggttccgaaacgggtaccttaccgttacccggtaaggtacggttaaccaccgtacggacgggaccgggtcgtacgggaccgtaacgggaccgngtacgtagcagtncgnncncgnnnnnnnn

SEQ ID NO: 185613 - DNA, 554 bp, Homo sapiens
  misc_feature: GYAE6OF02HBE4V.16.53.E09.1.454.CMB.1.raw
  modified_base (226)..(226): a, c, t, g, unknown or other
  misc_feature (226)..(226): n is a, c, g, or t
  modified_base (253)..(253): a, c, t, g, unknown or other
  misc_feature (253)..(253): n is a, c, g, or t
  modified_base (311)..(311): a, c, t, g, unknown or other
  misc_feature (311)..(311): n is a, c, g, or t
  modified_base (538)..(539): a, c, t, g, unknown or other
  misc_feature (538)..(539): n is a, c, g, or t
  modified_base (541)..(554): a, c, t, g, unknown or other
  misc_feature (541)..(554): n is a, c, g, or t
tcagtgtactactccacgaccggtgctcgatttagagagagtgtgttgggtttgggattcacgttgcagatgtaggtctgggtgcgccagatgcccgggaaaggcctggagtggatggggaggattgaggctagtgactcttataccaactacagcccgtccttccaaggcccacgtcaccatctcagttgaacaagtccatcaacactcgcccactgcagtggancagcctgaaggcctggaccaccgcatntattactgtgcgagacagtgggtatttatattgtaactaataatgtatgcctactttnactacgtcgggccaacggaaccctgcaccgtctcctcagcctaccaacaacggcccagtccgtcctcccctggccctaccctcctaccaacgacgcctacctcgtacggggcacgacgccgcccggtagggcctcggtcccgtggttaccaacgggtacttacgtaccgtaagttacgtactacgtaggaccgcgggtacgtcgggactaagggccgctaagtacgnngnnnnnnnnnnnnnn

SEQ ID NO: 185614 - DNA, 389 bp, Homo sapiens
  misc_feature: GYAE6OF01C7K3D.30.68.G02.1.454.CMB.1.raw
  modified_base (379)..(389): a, c, t, g, unknown or other
  misc_feature (379)..(389): n is a, c, g, or t
tcagcacgctacgtcacgaccggtgctcgatttagtcgatagtgaagggaaagggcgagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgcagtttatattgtcagcactataacaattggcctccggaaacttttggccaggggaccaagcttgagatcaaacgactgtgctgcaccatctgtcttcatcttcccgcatctagaacgtagctgctgagcgggctgggcaaggcgcatagnnnnnnnnnnn

SEQ ID NO: 185615 - DNA, 388 bp, Homo sapiens
  misc_feature: GYAE6OF01EEDG5.30.68.G02.1.454.CMB.1.raw
  modified_base (382)..(388): a, c, t, g, unknown or other
  misc_feature (382)..(388): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgcagtttattattgtcagcactataacaattggcctccggaaacttttggccagggaccaagcttgagatcaaacgaactgtggctgcacatctgtcttcatcttcccgccatctgaacgtagcgtgctggagcgggctggcgaaggcgacatagnnnnnnn

SEQ ID NO: 185616 - DNA, 385 bp, Homo sapiens
  misc_feature: GYAE6OF01BL724.30.68.G02.1.454.CMB.1.raw
  modified_base (379)..(385): a, c, t, g, unknown or other
  misc_feature (379)..(385): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgcagtttattattgtcagcactataacaattggcctcggaaacttttggccaggggaccaagcttgagatcaaacgactagtggctgcaccatctgtcttcatcttcccgcatctgaacgtagcgtgctgagcgggctggcaaggcgcatagnnnnnnn

SEQ ID NO: 185617 - DNA, 384 bp, Homo sapiens
  misc_feature: GYAE6OF01EOII9.30.68.G02.1.454.CMB.1.raw
  modified_base (378)..(384): a, c, t, g, unknown or other
  misc_feature (378)..(384): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgcagtttattattgtcagcactataacaattggcctcggaaacttttggccaggggaccaagcttgagatcaaacgaactgtggctgcaccatctgtcttcatcttccgccatctgaacgtgcgtgctgagcgggctggcaaggcgcatagnnnnnnn

SEQ ID NO: 185618 - DNA, 428 bp, Homo sapiens
  misc_feature: GYAE6OF01DZ7PF.30.68.G02.1.454.CMB.1.raw
  modified_base (422)..(428): a, c, t, g, unknown or other
  misc_feature (422)..(428): n is a, c, g, or t
tcagcacgctacgtcacgaccggtgctcgatttagtcgatagtgaagggaaagggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctggggcacagcagccctgggctgcctggtcaaggctacttccacgtagcgtgctgagcgggctggcaaggcgcatagnnnnnnn

SEQ ID NO: 185619 - DNA, 424 bp, Homo sapiens
  misc_feature: GYAE6OF01CHCRN.30.68.G02.1.454.CMB.1.raw
  modified_base (420)..(424): a, c, t, g, unknown or other
  misc_feature (420)..(424): n is a, c, g, or t
tcagcacgctacgtcacgaccggtgctcgatttagtcgatagtgaagggaaagggctggaatgggtctcaagtattgctggtagtggtgatagcacatactacgcagccatgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccgggcaccctggtcagcgtctcctcagcctccaccaagggcccatcggtcttccccctggcaccctcctccaagagcacctctggggcacagcagccctgggctgcctggtcaaggctacttccacgtagcgtgctgagcgggctggcaaggcgcatagnnnnn

SEQ ID NO: 185620 - DNA, 450 bp, Homo sapiens
  misc_feature: GYAE6OF01BKK9G.30.68.G02.1.454.CMB.1.raw
  modified_base (431)..(450): a, c, t, g, unknown or other
  misc_feature (431)..(450): n is a, c, g, or t
tcagcacgctacgtcacgaccggtgctcgatttagtcgatagtgaagggaaaggggtcgtggaatgggtctcaagtattgctggtagtggtgatacgcacatactacgcagcccatcgtgaagggccggttcaccatctccagggacagttcgaagaacacactgtttctgcaaatgaacagccctgagagttcgaggacacgggccgtatattactgtgcgctttcaccctggagtgggagttacaaggcatacttccaccactgggccgggcaccctggtcagcgtctcctcagcctccaccaagggcccatcggtccttccccctggccaccctcctccaagacgcacctctggggcacagcagccctgggctgcctggtcaaggctacttccacgtagcgtgctgagcgggctggcaaggcgcatgnnnnnnnnnnnnnnnnnnnn

SEQ ID NO: 185621 - DNA, 428 bp, Homo sapiens
  misc_feature: GYAE6OF01D8AIL.30.68.G02.1.454.CMB.1.raw
  modified_base (424)..(428): a, c, t, g, unknown or other
  misc_feature (424)..(428): n is a, c, g, or t
tcagcacgctacgtcacgaccggtgctcgatttagtcgatagtgaagggaaagggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagagcacctctgggggcacagcagccctgggctgcctggtcaaggctacttccacgtagcgtgctgagcgggctggcaaggcgcatagnnnnn

SEQ ID NO: 185622 - DNA, 428 bp, Homo sapiens
  misc_feature: GYAE6OF01B9ZCH.30.68.G02.1.454.CMB.1.raw
  modified_base (423)..(428): a, c, t, g, unknown or other
  misc_feature (423)..(428): n is a, c, g, or t
tcagcacgctacgtcacgaccggtgctcgatttagtcgatagtgaagggaaagggctggaatgggtctcaagtattgctggtagtggtgatagcacatactacgcagccatcgtgaagggccggttcaccatctccagggacagttcgaagaacacactgttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagagcacctctggggcacagcagccctgggctgcctggtcaaggactacttccacgtagcgtgctgagcgggctggcaaggcgcatagnnnnnn

SEQ ID NO: 185623 - DNA, 445 bp, Homo sapiens
  misc_feature: GYAE6OF01D9VYX.30.68.G02.1.454.CMB.1.raw
  modified_base (427)..(445): a, c, t, g, unknown or other
  misc_feature (427)..(445): n is a, c, g, or t
tcagcacgctacgtcacgaccggtgctcgatttagtcgatagtgaagggaaaggggcgtggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgcttttcaccctggagtgggagttacaaggcatacttccaccactgggccggggcaccctggtcagcgtctcctcagcctccaccaagggcccatcggtcttccccctggcaccctcctccaagagcacctctgggggcacagcagccctgggctgcctggtcaaggctacttccacgtagcgtgctgagcggggctggcaaggcgcatagnnnnnnnnnnnnnnnnnnn

SEQ ID NO: 185624 - DNA, 575 bp, Homo sapiens
  misc_feature: GYAE6OF01EOC8Y.30.68.G02.1.454.CMB.1.raw
  modified_base (394)..(394): a, c, t, g, unknown or other
  misc_feature (394)..(394): n is a, c, g, or t
  modified_base (415)..(415): a, c, t, g, unknown or other
  misc_feature (415)..(415): n is a, c, g, or t
  modified_base (503)..(503): a, c, t, g, unknown or other
  misc_feature (503)..(503): n is a, c, g, or t
  modified_base (507)..(507): a, c, t, g, unknown or other
  misc_feature (507)..(507): n is a, c, g, or t
  modified_base (511)..(511): a, c, t, g, unknown or other
  misc_feature (511)..(511): n is a, c, g, or t
  modified_base (519)..(519): a, c, t, g, unknown or other
  misc_feature (519)..(519): n is a, c, g, or t
  modified_base (528)..(528): a, c, t, g, unknown or other
  misc_feature (528)..(528): n is a, c, g, or t
  modified_base (537)..(537): a, c, t, g, unknown or other
  misc_feature (537)..(537): n is a, c, g, or t
  modified_base (541)..(541): a, c, t, g, unknown or other
  misc_feature (541)..(541): n is a, c, g, or t
  modified_base (546)..(546): a, c, t, g, unknown or other
  misc_feature (546)..(546): n is a, c, g, or t
  modified_base (554)..(554): a, c, t, g, unknown or other
  misc_feature (554)..(554): n is a, c, g, or t
  modified_base (557)..(557): a, c, t, g, unknown or other
  misc_feature (557)..(557): n is a, c, g, or t
  modified_base (567)..(567): a, c, t, g, unknown or other
  misc_feature (567)..(567): n is a, c, g, or t
  modified_base (571)..(571): a, c, t, g, unknown or other
  misc_feature (571)..(571): n is a, c, g, or t
tcagcacgctacgtcacgaccggtgctcgattttagtcgatagtgaaggggaaaggggactggaatgggtcttcgaacgtattggacctggtaggtaggtccgatagcacattactacgtccacgccatccgttgaaggggcccggtttccaccaatctccagggacgagttacgaagaacacactgtttctgcaaatggaacacgcctgagagttcgacggacgaacggccgtactacttactgtgcgcgtttccaccctggagtgggagtttacaacggctagtaccttccgaccacgtgggccggggaccacccgtcggtcgacgccgtcgtcctcacgcctcctaccaagggcccatcggtccttcccccgtggccaccctctccaacgngcctacctcgtcggggcacgngcaggccctgggcttcgcctcgtcaacgactactccgacgtagccgtgcctggagtcgggactcggcaaggtcgtactagttgcagcngtanatancgctcgtntacgttcgngacgacagnggancgtanacgcgtgngcncgcactctcntctntctc

SEQ ID NO: 185625 - DNA, 425 bp, Homo sapiens
  misc_feature: GYAE6OF01DJ7RD.30.68.G02.1.454.CMB.1.raw
  modified_base (334)..(334): a, c, t, g, unknown or other
  misc_feature (334)..(334): n is a, c, g, or t
  modified_base (420)..(425): a, c, t, g, unknown or other
  misc_feature (420)..(425): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttcaccactgggccggggcaccctggtcagcgtctcctcagcctcaccaagggcccatcggtcttcccctggcaccctcctcaagngcacctctggggcacagcacgccctgggctgcctggtcaaggctacttccacgtagcgtgctgagcgggctggcaaggcgcatagnnnnnn

SEQ ID NO: 185626 - DNA, 429 bp, Homo sapiens
  misc_feature: GYAE6OF01C3J3N.30.68.G02.1.454.CMB.1.raw
  modified_base (424)..(429): a, c, t, g, unknown or other
  misc_feature (424)..(429): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagagcacctctggggcacagcagccctgggctgcctggtcaaggctacttccacgtagcgtgctgagcgggctggcaaggcgcatagnnnnnn

SEQ ID NO: 185627 - DNA, 431 bp, Homo sapiens
  misc_feature: GYAE6OF01AMCNG.30.68.G02.1.454.CMB.1.raw
  modified_base (424)..(431): a, c, t, g, unknown or other
  misc_feature (424)..(431): n is a, c, g, or t
tcagcacgctacgtcacgaccggtgctcgatttagtcgatagtgaagggaaagggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctgacaccctcctccaagagcacctctgggggcacagcagccctgggctgcctggtcaaggctacttccacgtagcgtgctgagcgggctggcaaggcgcatagnnnnnnnn

SEQ ID NO: 185628 - DNA, 385 bp, Homo sapiens
  misc_feature: GYAE6OF01ARTNV.30.68.G02.1.454.CMB.1.raw
  modified_base (378)..(385): a, c, t, g, unknown or other
  misc_feature (378)..(385): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgcagtttattattgtcagcactataacaattggcctccggaaacttttggccaggggaccaagcttgagatcaaacgaactgtgctgcacatctgtcttcatcttcccgcatctgaacgtagcgtgctgagcgggctggcaaggcgcatagnnnnnnnn

SEQ ID NO: 185629 - DNA, 429 bp, Homo sapiens
  misc_feature: GYAE6OF01BTK5L.30.68.G02.1.454.CMB.1.raw
  modified_base (424)..(429): a, c, t, g, unknown or other
  misc_feature (424)..(429): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttcccctggcaccctcctccaagagcacctctggggcacagcagccctgggctgcctggtcaaggactacttccacgtagtgtgctgagcgggctggcaaggcgcatagnnnnnn

SEQ ID NO: 185630 - DNA, 429 bp, Homo sapiens
  misc_feature: GYAE6OF01DJHDE.30.68.G02.1.454.CMB.1.raw
  modified_base (423)..(429): a, c, t, g, unknown or other
  misc_feature (423)..(429): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctgggggcacagcagccctgggctgcctggtcaggctacttccacgtagcgtgctgagcgggctggcaaggcgcatagnnnnnnn

SEQ ID NO: 185631 - DNA, 436 bp, Homo sapiens
  misc_feature: GYAE6OF01BK5DC.30.68.G02.1.454.CMB.1.raw
  modified_base (356)..(356): a, c, t, g, unknown or other
  misc_feature (356)..(356): n is a, c, g, or t
  modified_base (426)..(436): a, c, t, g, unknown or other
  misc_feature (426)..(436): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagagcacctctgggggcacngcagccctgggctgcctggtcaaggctacttccacgtagcgtgctgagcgggctggcaaggcgcatacgnnnnnnnnnnn

SEQ ID NO: 185632 - DNA, 443 bp, Homo sapiens
  misc_feature: GYAE6OF01CFAFO.30.68.G02.1.454.CMB.1.raw
  modified_base (424)..(424): a, c, t, g, unknown or other
  misc_feature (424)..(424): n is a, c, g, or t
  modified_base (426)..(443): a, c, t, g, unknown or other
  misc_feature (426)..(443): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttcaccactgggccggggcacctggtcagcgtctcctcagcctcaccaagggcccatcggtcttccccctggcaccctcctccaagagcacctctgggggcacagcagccctgggctgcctgggtcaagggactacttccacgtagcgtgctgagcgggctggcaaggcgcatagngnnnnnnnnnnnnnnnnnn

SEQ ID NO: 185633 - DNA, 431 bp, Homo sapiens
  misc_feature: GYAE6OF01EZEP4.30.68.G02.1.454.CMB.1.raw
  modified_base (423)..(431): a, c, t, g, unknown or other
  misc_feature (423)..(431): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctggggcacagcagccctgggctgcctggtcaaggctacttccacgtagcgtgctgagcgggctggcaaggcgcatagnnnnnnnnn

SEQ ID NO: 185634 - DNA, 466 bp, Homo sapiens
  misc_feature: GYAE6OF01DC8E4.30.68.G02.1.454.CMB.1.raw
  modified_base (421)..(421): a, c, t, g, unknown or other
  misc_feature (421)..(421): n is a, c, g, or t
  modified_base (437)..(455): a, c, t, g, unknown or other
  misc_feature (437)..(455): n is a, c, g, or t
  modified_base (457)..(466): a, c, t, g, unknown or other
  misc_feature (457)..(466): n is a, c, g, or t
tcagcacgctacgtcacgaccggtgctcgatttagtcgatagtgaaggggaaagggctggaatgggtcctcaaggtattgctggtagtggtgatagcgaccatactacgcagcccagtcgtgaagggccggttcaccatctccagggcagttcgaagaacacactgtttctgcaaaatgaacagcctgagagtcgaggcacggcgtatattactgtgcgctttcaccctggatgggattacaaggcatacttccacatgggccgggcaccctggtcagcgtctctcagcctccaaccaagggcccagtccggtcttccccctgggcctaccctcctaccaagagcacctcgtcgggggacacgagcagccctgggctggcctggtcaaggactacttccacgttgacgtgcctgagcgggntggcaaggcgcatagnnnnnnnnnnnnnnnnnnngnnnnnnnnnn

SEQ ID NO: 185635 - DNA, 396 bp, Homo sapiens
  misc_feature: GYAE6OF01B2M67.30.68.G02.1.454.CMB.1.raw
  modified_base (295)..(295): a, c, t, g, unknown or other
  misc_feature (295)..(295): n is a, c, g, or t
  modified_base (376)..(396): a, c, t, g, unknown or other
  misc_feature (376)..(396): n is a, c, g, or t
tcagcacgctacgtcacgaccggtgctcgatttagtcgatagtgaagggaaagggcgagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgctagtttattattgtcagcactataacaattggcctcggaaacttttggccagggaccaagcttganatcaaacgaatgtggctcgcaccatctgtcttcatctccgcatctgaactgcgtgctgagcggctggcaaggcgcagtagnnnnnnnnnnnnnnnnnnnnn

SEQ ID NO: 185636 - DNA, 386 bp, Homo sapiens
  misc_feature: GYAE6OF01CMZGK.30.68.G02.1.454.CMB.1.raw
  modified_base (381)..(386): a, c, t, g, unknown or other
  misc_feature (381)..(386): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgctagtttattattgtcagcactataacaattggcctccggaaacttttggccaggggaccaagcttgagatcaaacgaactgtggctgcaccatctgtcttcatcttcccgcatctgaacgtagcgtgctgagcgggctggcaaggcgcatagnnnnnn

SEQ ID NO: 185637 - DNA, 434 bp, Homo sapiens
  misc_feature: GYAE6OF01BTHT0.30.68.G02.1.454.CMB.1.raw
  modified_base (425)..(434): a, c, t, g, unknown or other
  misc_feature (425)..(434): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnnnnnn

SEQ ID NO: 185638 - DNA, 383 bp, Homo sapiens
  misc_feature: GYAE6OF01BCIND.30.68.G02.1.454.CMB.1.raw
  modified_base (377)..(383): a, c, t, g, unknown or other
  misc_feature (377)..(383): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgcagtttattattgtcagcactataacaattggcctcggaaacttttggccaggggaccaagcttgagatcaaacgaactgtggctgcaccatctgtcttcatcttccgatctgaacgtagcgtgctgagcgggctggcaaggcgcatagnnnnnnn

SEQ ID NO: 185639 - DNA, 429 bp, Homo sapiens
  misc_feature: GYAE6OF01ADE5C.30.68.G02.1.454.CMB.1.raw
  modified_base (424)..(429): a, c, t, g, unknown or other
  misc_feature (424)..(429): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctcaccaagggcccatcggtcttccccctggcaccctcctccaagagcacctctgggggcacagcagccctgggctgcctggtcaaggactacttccacgtagcgtgctgagcgggctggcaaggcgcatagnnnnnn

SEQ ID NO: 185640 - DNA, 430 bp, Homo sapiens
  misc_feature: GYAE6OF01CW4P1.30.68.G02.1.454.CMB.1.raw
  modified_base (422)..(430): a, c, t, g, unknown or other
  misc_feature (422)..(430): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctacaaatgaacagcctgagagtcgaggacacggccgtatattactgtgcgctttcaccctggagtgggagttacaaggcatacttcaccactgggccggggcaccctggtcagcgtctcctcagcctccaccaagggccccatcggtctcccctggcaccctctccaagagcacctctggggcacagcagcccctgggctgccctggtcaaggactacttcacgtagcgtgctgagcgggctggcaaggcgcatagnnnnnnnnn

SEQ ID NO: 185641 - DNA, 384 bp, Homo sapiens
  misc_feature: GYAE6OF01DL2WV.30.68.G02.1.454.CMB.1.raw
  modified_base (378)..(384): a, c, t, g, unknown or other
  misc_feature (378)..(384): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgcagtttattattgtcagcactataacaattggcctcggaaacttttggccaggggaccaagcttgagatcaaacgaactgtggctgcacatctgtcttcatcttcccgcatctgaacgtagcgtgctgagcgggctggcaaggcgcatagnnnnnnn

SEQ ID NO: 185642 - DNA, 389 bp, Homo sapiens
  misc_feature: GYAE6OF01A5XD6.30.68.G02.1.454.CMB.1.raw
  modified_base (383)..(389): a, c, t, g, unknown or other
  misc_feature (383)..(389): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgctagtttattattgtcagcactataacaattggcctccggaaacttttggcctaggggaccaagcttcgagatcaaacgactgtggctgcaccatctgtcttcatcttcccgcatctgaacgtagcgtgctgagcgggactgcaaggcgcatacgnnnnnnn

SEQ ID NO: 185643 - DNA, 427 bp, Homo sapiens
  misc_feature: GYAE6OF01CADKW.30.68.G02.1.454.CMB.1.raw
  modified_base (419)..(427): a, c, t, g, unknown or other
  misc_feature (419)..(427): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcacctggagtgggattacaaggcatacttcaccactgggccgggcaccctggtcagcgtctcctcagcctccaccaagggcccatcggtcttccccctggcaccctcctccaagacgcacctctggggcacagcagccctgggctgcctggtcaaggctactccacgtagcgtgctgagcgggctggcaaggcgcatagnnnnnnnnn

SEQ ID NO: 185644 - DNA, 448 bp, Homo sapiens
  misc_feature: GYAE6OF01DRGWX.30.68.G02.1.454.CMB.1.raw
  modified_base (438)..(448): a, c, t, g, unknown or other
  misc_feature (438)..(448): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccggggcaccctggtcagcgtctcctcagcctccaccaacgggcccatcggtccttccccctggccaccctcctccaagacgccacctcgtcggggcacagcacgccctgggctcgcctggtcaaggactacttccacgtagcgtgctgagcgggctggcgaaggcgcgatacgnnnnnnnnnnn

SEQ ID NO: 185645 - DNA, 523 bp, Homo sapiens
  misc_feature: GYAE6OF01BX7LZ.30.68.G02.1.454.CMB.1.raw
  modified_base (407)..(407): a, c, t, g, unknown or other
  misc_feature (407)..(407): n is a, c, g, or t
  modified_base (485)..(496): a, c, t, g, unknown or other
  misc_feature (485)..(496): n is a, c, g, or t
  modified_base (498)..(502): a, c, t, g, unknown or other
  misc_feature (498)..(502): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
  modified_base (510)..(523): a, c, t, g, unknown or other
  misc_feature (510)..(523): n is a, c, g, or t
tcagcacgctacgtcacgaccggtgctcgatttagtcgatagtgaaggggaaagggctggaatgggtctcaagtattcgctggtagtggtgatagcacataactacgcagccatcgtgaagggccgggttcgaccatctccaggggacagttcgaagaacacactggtttctgcaaatcgaacagcctgtagagtcgaggacacgggccgtatattactgtgcgcgtttcaccctgggagtagggtagttacaaggcgatacttccaccactggggccgggggtcaccctggtccagcgtctcctcaggcctccaccaaaggggcccccagtaccgggtctttccccccttgggccacccgtcctcccgaagacgccaaccctcttggggggcacaggcaagccccnggggcctagccctgggtcaagggactacttcccaacgtgcgtggcctggacgcggggctgggcaaggcgtcattaggnnnnnnnnnnnntnnnnngngngngnnnnnnnnnnnnnn

SEQ ID NO: 185646 - DNA, 432 bp, Homo sapiens
  misc_feature: GYAE6OF01AD7IJ.30.68.G02.1.454.CMB.1.raw
  modified_base (428)..(432): a, c, t, g, unknown or other
  misc_feature (428)..(432): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccacccaagggcccatcggtcttccccctggcaccctcctcccaacgagcacctctgggggcacagcagccctgggctgcctggtcaaggactacttccacgtagcgtgctgagcgggctggcaaggcgcatagnnnnn

SEQ ID NO: 185647 - DNA, 383 bp, Homo sapiens
  misc_feature: GYAE6OF01B66NC.30.68.G02.1.454.CMB.1.raw
  modified_base (378)..(383): a, c, t, g, unknown or other
  misc_feature (378)..(383): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgcagtttattattgtcagcactataacaattgcctccggaaacttttggccaggggaccaagcttgagatcaaacgactgtggctgcaccatctgtcttcatcttccgccatctgaacgtagcgtgctgagcgggctggcaaggcgcatagnnnnnn

SEQ ID NO: 185648 - DNA, 429 bp, Homo sapiens
  misc_feature: GYAE6OF01C0FR8.30.68.G02.1.454.CMB.1.raw
  modified_base (424)..(429): a, c, t, g, unknown or other
  misc_feature (424)..(429): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccatggggccggggcaccctggtcagcgtctcctcagcctccaccaagggcccatcggtcttccccctggcaccctcctccaaagagcacctctggggcacagcagccctgggctgcctggtcaaggactacttcacgtagcgtgctgagcgggctggcaaggcgcatagnnnnnn

SEQ ID NO: 185649 - DNA, 427 bp, Homo sapiens
  misc_feature: GYAE6OF01ENBWX.30.68.G02.1.454.CMB.1.raw
  modified_base (424)..(427): a, c, t, g, unknown or other
  misc_feature (424)..(427): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctgggggcacagcagccctgggctgcctggtcaggactacttccacgtagcgtgctgagcgggctggcaaggcgcatagnnnn

SEQ ID NO: 185650 - DNA, 384 bp, Homo sapiens
  misc_feature: GYAE6OF01ADTV7.30.68.G02.1.454.CMB.1.raw
  modified_base (379)..(384): a, c, t, g, unknown or other
  misc_feature (379)..(384): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgctagtttattattgtcagcactataacaattggcctccggaaacttttggccaggggaccaagctttgagatcaaacgactgtggctgcaccatctgtcttcatcttcccgcatctgacgtagcgtgctgagcgggctggcaaggcgcatgnnnnnn

SEQ ID NO: 185651 - DNA, 389 bp, Homo sapiens
  misc_feature: GYAE6OF01DBQAC.30.68.G02.1.454.CMB.1.raw
  modified_base (383)..(389): a, c, t, g, unknown or other
  misc_feature (383)..(389): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgctagtttattattgtcagcactataacaattggcctccggaacttttggccaggggaccaagctttgagatcaaacgaactgtggctgcaccatctgtcttcatcttcccgcatctagaacgtagcgtgctggagcgggctggcaaggcgcatagnnnnnnn

SEQ ID NO: 185652 - DNA, 425 bp, Homo sapiens
  misc_feature: GYAE6OF01D38SY.30.68.G02.1.454.CMB.1.raw
  modified_base (353)..(353): a, c, t, g, unknown or other
  misc_feature (353)..(353): n is a, c, g, or t
  modified_base (383)..(387): a, c, t, g, unknown or other
  misc_feature (383)..(387): n is a, c, g, or t
  modified_base (389)..(425): a, c, t, g, unknown or other
  misc_feature (389)..(425): n is a, c, g, or t
tcagcacgctacgtcacgaccggtgctcgatttagtcgatagtgaagggaaagggcgagagtgttagcagcaacttagcctggtaccagcagaaacctggccaggctcccaggctcctcatctatgatgcgttccaccagggtcactggtatcccagccaggtttcagcggcagtgggtctggggacagagttcagtctcaccatcagcagcctgcgagtctgaagtattttgctagttttattattgtcagcactataacaattggctccggaaacttttgccagggaccaagcttgagatcaaacgaactgtggctgcaccatctgtcttcatcttccgcatctgaacgtncgtgctgagcggctggcaaggcgcagtagnnnnntnnnnnnnnnnnnnnnnnnnnnnnnnnnnnnnnnnnnn

SEQ ID NO: 185653 - DNA, 434 bp, Homo sapiens
  misc_feature: GYAE6OF01DRYJU.30.68.G02.1.454.CMB.1.raw
  modified_base (425)..(434): a, c, t, g, unknown or other
  misc_feature (425)..(434): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagagcacctctggggcacagcagccctgggctgcctggtcaaggactacttccacgtagcgtgctgagcgggctggcaaggcgcatagnnnnnnnnnn

SEQ ID NO: 185654 - DNA, 430 bp, Homo sapiens
  misc_feature: GYAE6OF01DARNR.30.68.G02.1.454.CMB.1.raw
  modified_base (425)..(430): a, c, t, g, unknown or other
  misc_feature (425)..(430): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagagcacctctggggcacagcagccctgggctgcctggtcaaggactacttccacgtagcgtgctgagcgggctggcaaggcgcatagnnnnnn

SEQ ID NO: 185655 - DNA, 428 bp, Homo sapiens
  misc_feature: GYAE6OF01EM5A4.30.68.G02.1.454.CMB.1.raw
  modified_base (415)..(415): a, c, t, g, unknown or other
  misc_feature (415)..(415): n is a, c, g, or t
  modified_base (421)..(428): a, c, t, g, unknown or other
  misc_feature (421)..(428): n is a, c, g, or t
tcagcacgctacgtcacgaccggtgctcgatttagtcgatagtgaagggaaagggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctggggcacagcagccctgggctgcctggtcaggactactccacgtagcgtgctgagcgggctggcaaggcncatagnnnnnnnn

SEQ ID NO: 185656 - DNA, 442 bp, Homo sapiens
  misc_feature: GYAE6OF01DC9EZ.30.68.G02.1.454.CMB.1.raw
  modified_base (426)..(426): a, c, t, g, unknown or other
  misc_feature (426)..(426): n is a, c, g, or t
  modified_base (432)..(442): a, c, t, g, unknown or other
  misc_feature (432)..(442): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttcaccactgggccgggcaccgtggtcagcgtctcctcagcctccaccaagggcccatccggtccttccccctggccacccctcctccaagcgccacctcgtcggggcacagcacgccctgggctgcctggtcaacggactacgttccacgtagcgtgctgagcgggctggcaaggcncatagnnnnnnnnnnn

SEQ ID NO: 185657 - DNA, 430 bp, Homo sapiens
  misc_feature: GYAE6OF01A8P8C.30.68.G02.1.454.CMB.1.raw
  modified_base (425)..(430): a, c, t, g, unknown or other
  misc_feature (425)..(430): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagacgcacctctggggcacagcagccctgggctgcctggtcaaggactacttccacgtagcgtgctgagcgggctggcaaggcgcatagnnnnnn

SEQ ID NO: 185658 - DNA, 427 bp, Homo sapiens
  misc_feature: GYAE6OF01B4CRO.30.68.G02.1.454.CMB.1.raw
  modified_base (423)..(427): a, c, t, g, unknown or other
  misc_feature (423)..(427): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctgggggcacagcagccctgggctgcctggtcaagactacttccacgtagcgtgctgagcgggctggcaaggcgcatagnnnnn

SEQ ID NO: 185659 - DNA, 431 bp, Homo sapiens
  misc_feature: GYAE6OF01A6K04.30.68.G02.1.454.CMB.1.raw
  modified_base (425)..(431): a, c, t, g, unknown or other
  misc_feature (425)..(431): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgcttttcaccctggagtgggagttacaaggcatacttccaccactggggccggggcaccctggtcagcgtctcctcagcctccaccaagggcccatcggtcttccccctggcaccctcctccaagagcacctctggggcacagcagccctgggctgcctggtcaaggctacttccacgtagcgtgctgagcgggctggcaaggcgcatagnnnnnnn

SEQ ID NO: 185660 - DNA, 433 bp, Homo sapiens
  misc_feature: GYAE6OF01B3DCG.30.68.G02.1.454.CMB.1.raw
  modified_base (424)..(433): a, c, t, g, unknown or other
  misc_feature (424)..(433): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccgggcaccctggtcagcgtctcctcagcctccaccaagggccatcggtcttccccctggccaccctcctccaagacgcacctctggggcacagcagccctgggctgcctggtcaaggactactccacgtagcgtgctgagcgggctggcaaggcgcatagnnnnnnnnnn

SEQ ID NO: 185661 - DNA, 432 bp, Homo sapiens
  misc_feature: GYAE6OF01CYT76.30.68.G02.1.454.CMB.1.raw
  modified_base (427)..(432): a, c, t, g, unknown or other
  misc_feature (427)..(432): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggccaccctcctccaagagcacctctggggcacagcagccctgggctgcctggtcaaggactacttccacgtagcgtgctgagcgggctgggcaaggcgcatagnnnnnn

SEQ ID NO: 185662 - DNA, 452 bp, Homo sapiens
  misc_feature: GYAE6OF01AFH75.30.68.G02.1.454.CMB.1.raw
  modified_base (443)..(443): a, c, t, g, unknown or other
  misc_feature (443)..(443): n is a, c, g, or t
  modified_base (448)..(452): a, c, t, g, unknown or other
  misc_feature (448)..(452): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggcccggggcaccctggtcagcgtctcctcagcctccaccaagggccccatccggtccttcccccctgggccacccctcctcccaagacgccaccctcgtcgggggccaccagccacgccccgtgggcctgcctgggtccaaggactacttccacgtacgcgtgctgagcgggctggcaaggcncatgnnnnn

SEQ ID NO: 185663 - DNA, 427 bp, Homo sapiens
  misc_feature: GYAE6OF01DTSNZ.30.68.G02.1.454.CMB.1.raw
  modified_base (421)..(427): a, c, t, g, unknown or other
  misc_feature (421)..(427): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctggggcacagcagccctgggctgcctggtcaaggacacttcacgtagcgtgctgagcggctggcaaggcgcatagnnnnnnn

SEQ ID NO: 185664 - DNA, 430 bp, Homo sapiens
  misc_feature: GYAE6OF01BMB70.30.68.G02.1.454.CMB.1.raw
  modified_base (423)..(430): a, c, t, g, unknown or other
  misc_feature (423)..(430): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggccatcggtcttccccctggcaccctcctccaagagcacctctggggcacagcagccctgggctgcctggtcaaggctacttccacgtagcgtgctgagcgggctggcaaggcgcatacgnnnnnnnn

SEQ ID NO: 185665 - DNA, 431 bp, Homo sapiens
  misc_feature: GYAE6OF01BAFMZ.30.68.G02.1.454.CMB.1.raw
  modified_base (424)..(431): a, c, t, g, unknown or other
  misc_feature (424)..(431): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctggggcacagcagccctgggctgcctggtcaaggactacttccacgtagcgtgctgagcgggctggcaaggcgcatagnnnnnnnn

SEQ ID NO: 185666 - DNA, 432 bp, Homo sapiens
  misc_feature: GYAE6OF01C6BZ1.30.68.G02.1.454.CMB.1.raw
  modified_base (424)..(432): a, c, t, g, unknown or other
  misc_feature (424)..(432): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccgggcaccctggtcagcgtctcctcagcctccaccaagggcccatcggtcttccccctcggcaccctcctccaagagcacctctggggcacagcagccctgggctgcctggtcaaggactacttccacgtagcgtgctgagcgggctggcaaggcgcatagnnnnnnnnn

SEQ ID NO: 185667 - DNA, 446 bp, Homo sapiens
  misc_feature: GYAE6OF01EJHRZ.30.68.G02.1.454.CMB.1.raw
  modified_base (435)..(446): a, c, t, g, unknown or other
  misc_feature (435)..(446): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccggggcacccgtggtcagcgtctcctcagcctccaccaagggcccatcggtccttccccctggccaccctcctccaagacgcacctcgtcgggggcacagcacgccctgggctcgcctggtcaggactacttccacgtagcgtgctgacgcgggctggcaaggcgcatagnnnnnnnnnnnn

SEQ ID NO: 185668 - DNA, 432 bp, Homo sapiens
  misc_feature: GYAE6OF01A9A3G.30.68.G02.1.454.CMB.1.raw
  modified_base (424)..(432): a, c, t, g, unknown or other
  misc_feature (424)..(432): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccagagcacctctgggggcacagcagccctgggctgcctggtcaaggactacttccacgtagcgtgctgagcgggctggcaaggcgcatagnnnnnnnnn

SEQ ID NO: 185669 - DNA, 437 bp, Homo sapiens
  misc_feature: GYAE6OF01A3XRJ.30.68.G02.1.454.CMB.1.raw
  modified_base (420)..(437): a, c, t, g, unknown or other
  misc_feature (420)..(437): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagtttcgaagaacacactgtttctgcaaatgaacagcctgagagtcgaggacacggccgtatattactgtgcgctttcaccctggagtgggattacaaggcatacttccaccactggggccgggcaccctggtcagcgtctcctcagcctccaccagggccatcggtctcccctggccaccctcctccagacgcacctctggggcacagcagccctgggctgcctggtcaaggctactccacgtagcgtgctgacgcgggctggcaaggcgcatagnnnnnnnnnnnnnnnnnn

SEQ ID NO: 185670 - DNA, 429 bp, Homo sapiens
  misc_feature: GYAE6OF01DFRQX.30.68.G02.1.454.CMB.1.raw
  modified_base (425)..(429): a, c, t, g, unknown or other
  misc_feature (425)..(429): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaaggggcccatcggtcttccccctggcaccctcctccaagagcacctctggggcacagcagccctgggctgcctggtcaaggactacttccacgtagcgtgctgagcgggctggcaaggcgcatagnnnnn

SEQ ID NO: 185671 - DNA, 430 bp, Homo sapiens
  misc_feature: GYAE6OF01DHZKT.30.68.G02.1.454.CMB.1.raw
  modified_base (424)..(430): a, c, t, g, unknown or other
  misc_feature (424)..(430): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctgggggcacagcagccctgggctgcctggtcaggactacttccacgtagcgtgctgagcgggctggcaaggcgcatagnnnnnnn

SEQ ID NO: 185672 - DNA, 429 bp, Homo sapiens
  misc_feature: GYAE6OF01DQNK9.30.68.G02.1.454.CMB.1.raw
  modified_base (425)..(429): a, c, t, g, unknown or other
  misc_feature (425)..(429): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagagcacctctggggcacagcagccctgggctgcctggtcaaggactacttccacgtagcgtgctgagcgggctggcaaggcgcatagnnnnn

SEQ ID NO: 185673 - DNA, 454 bp, Homo sapiens
  misc_feature: GYAE6OF01DHO92.30.68.G02.1.454.CMB.1.raw
  modified_base (427)..(428): a, c, t, g, unknown or other
  misc_feature (427)..(428): n is a, c, g, or t
  modified_base (430)..(431): a, c, t, g, unknown or other
  misc_feature (430)..(431): n is a, c, g, or t
  modified_base (433)..(454): a, c, t, g, unknown or other
  misc_feature (433)..(454): n is a, c, g, or t
tcagcacgctacgtcacgaccggtgctcgatttagtcgatagtgaagggaaaggggctgggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatactccaccactggggccggggcaccctggtcagcgtctcctcagcctccaccaagggcccatcggtcttccccctggcaccctcctccaagagcacctctggggcacagcacgccctgggctgcctggtcaaggacctactccacgtagcgtgctgagcgggctggcaaggcgcagtagnngnngnnnnnnnnnnnnnnnnnnnnnn

SEQ ID NO: 185674 - DNA, 466 bp, Homo sapiens
  misc_feature: GYAE6OF01B3310.30.68.G02.1.454.CMB.1.raw
  modified_base (419)..(419): a, c, t, g, unknown or other
  misc_feature (419)..(419): n is a, c, g, or t
  modified_base (421)..(425): a, c, t, g, unknown or other
  misc_feature (421)..(425): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
  modified_base (435)..(437): a, c, t, g, unknown or other
  misc_feature (435)..(437): n is a, c, g, or t
  modified_base (440)..(440): a, c, t, g, unknown or other
  misc_feature (440)..(440): n is a, c, g, or t
  modified_base (442)..(444): a, c, t, g, unknown or other
  misc_feature (442)..(444): n is a, c, g, or t
  modified_base (447)..(447): a, c, t, g, unknown or other
  misc_feature (447)..(447): n is a, c, g, or t
  modified_base (449)..(450): a, c, t, g, unknown or other
  misc_feature (449)..(450): n is a, c, g, or t
  modified_base (452)..(452): a, c, t, g, unknown or other
  misc_feature (452)..(452): n is a, c, g, or t
  modified_base (454)..(455): a, c, t, g, unknown or other
  misc_feature (454)..(455): n is a, c, g, or t
  modified_base (457)..(457): a, c, t, g, unknown or other
  misc_feature (457)..(457): n is a, c, g, or t
  modified_base (459)..(459): a, c, t, g, unknown or other
  misc_feature (459)..(459): n is a, c, g, or t
  modified_base (462)..(462): a, c, t, g, unknown or other
  misc_feature (462)..(462): n is a, c, g, or t
  modified_base (464)..(464): a, c, t, g, unknown or other
  misc_feature (464)..(464): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaaggccggttcaccatctccagggacagttcgaagacacactgttctgcaaatgaacagcctgagagtcgaggacacggccgtatattactgtgcgctttcaccctggagtgggattacaaggcatacttccaccatgggccgggcaccctggtcagcgtctcctcagcctccaccaagggcccatcggtcttccccctggccaccctcctccaagagcacctctggggcacagcagccctgggctgcctggtcaaggactacttccacgtagcgtgctgagcgggctggcaaggcgcatagntnnnnngntagntgcnnntcngnnngangnncngnngnancantngc

SEQ ID NO: 185675 - DNA, 390 bp, Homo sapiens
  misc_feature: GYAE6OF01C41BQ.30.68.G02.1.454.CMB.1.raw
  modified_base (375)..(375): a, c, t, g, unknown or other
  misc_feature (375)..(375): n is a, c, g, or t
  modified_base (381)..(390): a, c, t, g, unknown or other
  misc_feature (381)..(390): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgcagtttattattgtcagcactataacaattggcctcggaaacttttggccaggggaccaagcttgagatcaaacgaactgtggctgcaccatctgtcttcattcttcccgcatctagaacgtagcgtgctgagcgggctggcaaggcncatagnnnnnnnnnn

SEQ ID NO: 185676 - DNA, 432 bp, Homo sapiens
  misc_feature: GYAE6OF01BAPQU.30.68.G02.1.454.CMB.1.raw
  modified_base (423)..(432): a, c, t, g, unknown or other
  misc_feature (423)..(432): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctggggcacagcagccctgggctgcctggtcaaggctacttccacgtagcgtgctgagcgggctggcaaggcgcatagnnnnnnnnnn

SEQ ID NO: 185677 - DNA, 452 bp, Homo sapiens
  misc_feature: GYAE6OF01DC53I.30.68.G02.1.454.CMB.1.raw
  modified_base (407)..(407): a, c, t, g, unknown or other
  misc_feature (407)..(407): n is a, c, g, or t
  modified_base (438)..(438): a, c, t, g, unknown or other
  misc_feature (438)..(438): n is a, c, g, or t
  modified_base (440)..(452): a, c, t, g, unknown or other
  misc_feature (440)..(452): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccgggcaccctggtcagcgtctcctcagcctccaccaagggcccatcggtccttccccctcggccaccctccctcccaacgacgcacctcgtcggggcacgagcagccctggggctcgcctggtcaaggactacttccacgtacncgtgctgacgcgggctggcaaggcgcatagngnnnnnnnnnnnnn

SEQ ID NO: 185678 - DNA, 433 bp, Homo sapiens
  misc_feature: GYAE6OF01BFI2R.30.68.G02.1.454.CMB.1.raw
  modified_base (426)..(433): a, c, t, g, unknown or other
  misc_feature (426)..(433): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnnnn

SEQ ID NO: 185679 - DNA, 385 bp, Homo sapiens
  misc_feature: GYAE6OF01A81O1.30.68.G02.1.454.CMB.1.raw
  modified_base (364)..(364): a, c, t, g, unknown or other
  misc_feature (364)..(364): n is a, c, g, or t
  modified_base (380)..(385): a, c, t, g, unknown or other
  misc_feature (380)..(385): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgtgtccaccagggtcactggtatcccagccaggttcagcggcagtgggtctgggacagagttcagtctcaccatcagcagcctgcagtctgaagattttgcagtttattattgtcagcactataacaattggcctccggaaacttttggccaggggaccaagcttgagatcaaacgactgtggctgcaccatctgtcttcatcttcccgccatctgaacgtagcgtgctgagcgggntggcaaggcgcatagnnnnnn

SEQ ID NO: 185680 - DNA, 455 bp, Homo sapiens
  misc_feature: GYAE6OF01BEL6C.30.68.G02.1.454.CMB.1.raw
  modified_base (441)..(455): a, c, t, g, unknown or other
  misc_feature (441)..(455): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccgggcacccgtggtcagcgtctcctcagcctccaccaagggcccagtccggtccttccccctggccaccctccctccaagacgcacctcgtggggccacgagcacgcccctgggctgcctggtcaacggactactccacgtagcgtgcgtgagcgggcgtggcgaaggcgcgagtagnnnnnnnnnnnnnnn

SEQ ID NO: 185681 - DNA, 575 bp, Homo sapiens
  misc_feature: GYAE6OF01B7J80.30.68.G02.1.454.CMB.1.raw
  modified_base (210)..(210): a, c, t, g, unknown or other
  misc_feature (210)..(210): n is a, c, g, or t
  modified_base (533)..(533): a, c, t, g, unknown or other
  misc_feature (533)..(533): n is a, c, g, or t
  modified_base (537)..(538): a, c, t, g, unknown or other
  misc_feature (537)..(538): n is a, c, g, or t
  modified_base (540)..(540): a, c, t, g, unknown or other
  misc_feature (540)..(540): n is a, c, g, or t
  modified_base (542)..(543): a, c, t, g, unknown or other
  misc_feature (542)..(543): n is a, c, g, or t
  modified_base (552)..(552): a, c, t, g, unknown or other
  misc_feature (552)..(552): n is a, c, g, or t
  modified_base (554)..(558): a, c, t, g, unknown or other
  misc_feature (554)..(558): n is a, c, g, or t
  modified_base (560)..(560): a, c, t, g, unknown or other
  misc_feature (560)..(560): n is a, c, g, or t
  modified_base (563)..(570): a, c, t, g, unknown or other
  misc_feature (563)..(570): n is a, c, g, or t
  modified_base (572)..(575): a, c, t, g, unknown or other
  misc_feature (572)..(575): n is a, c, g, or t
tcagcacgctacgtcacgaccggtgctcgatttagtcgatagtgaagggaaagggctggaatgggtctcaagtattgctggtagtggtgatagcacatactaacgcagccatcgtgaagggccggttcaccatctccagggacagttcgaagaacacactgtttctgcaaatgaacagcctgagagtcgaggacacggccgtatattacngtgcgctttcaccctggagtgggattacaaggcatacttccaccacgtggggccgggcaccgtggtcagcgtctcctcacgccctccacccgaacgggcccacgtccggtccgttcccccgtggcctaccctccctaccaacgacgccgaccgtcgtcgggggaccaaccgacggaccacggacccgtacgggcctacggcccgtcgggtacgaaacgggtaccttaacccgttacccgaaccggttacgaccggttacgccgttacggaacgggccggggtacgtcgggaccgaaacgggccgacacggttaacgcgcgcangacnncncnncgcgctgcncnnnnngngcnnnnnnnnannnn

SEQ ID NO: 185682 - DNA, 387 bp, Homo sapiens
  misc_feature: GYAE6OF01DK6YZ.30.68.G02.1.454.CMB.1.raw
  modified_base (383)..(387): a, c, t, g, unknown or other
  misc_feature (383)..(387): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgctagtttattattgtcagcactataacaattggcctcggaaactttggcaggggaccaagcttgagatcaaacgactgtggctgcaccatctgtcttcattccttcccgcctatctagaacgtagcgtgctgacgcgggctggcaaggcgcatagnnnnn

SEQ ID NO: 185683 - DNA, 386 bp, Homo sapiens
  misc_feature: GYAE6OF01DRS7X.30.68.G02.1.454.CMB.1.raw
  modified_base (383)..(386): a, c, t, g, unknown or other
  misc_feature (383)..(386): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgcagtttattattgtcagcactataacaattggcctccggaaacttttggccaggggaccaagctttgagatcaaacgaactgtggctgcaccatctgtcttcatcttcccgccatctgaacgtagcgtgctgagcgggctgggcaaggcgcatagnnnn

SEQ ID NO: 185684 - DNA, 428 bp, Homo sapiens
  misc_feature: GYAE6OF01D8XHD.30.68.G02.1.454.CMB.1.raw
  modified_base (424)..(428): a, c, t, g, unknown or other
  misc_feature (424)..(428): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctgggggcacagcagccctgggctgcctggtcaaggctacttccacgtagcgtgctgagcgggctggcaaggcgcatagnnnnn

SEQ ID NO: 185685 - DNA, 388 bp, Homo sapiens
  misc_feature: GYAE6OF01BM2PZ.30.68.G02.1.454.CMB.1.raw
  modified_base (380)..(388): a, c, t, g, unknown or other
  misc_feature (380)..(388): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgcagtttattattgtcagcactataacaattggcctccggaaacttttggccaggggaccaagcttgagatcaaacgaactgtggctgcaccatctgtcttcatcttcccgcatctgaacgtagcgtgctgagcgggctggcaaggcgcatagnnnnnnnnn

SEQ ID NO: 185686 - DNA, 398 bp, Homo sapiens
  misc_feature: GYAE6OF01CZA1Q.30.68.G02.1.454.CMB.1.raw
  modified_base (382)..(382): a, c, t, g, unknown or other
  misc_feature (382)..(382): n is a, c, g, or t
  modified_base (389)..(398): a, c, t, g, unknown or other
  misc_feature (389)..(398): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtcaccagggtcactggtatcccagccaggttcagcggcagtgggtctgggacagagttcagtctcaccatcagcagcctgcagtctgaagtattttgctagtttattattgtcagcactataacaattgcctacggtaaacttttggcctaggggaccaagcttgagatacaaacgaactgtgctgcacatctcgtcttacactcctccgccatctacgaacgtagcgtgcgtggagcgggctggcaaggcncgatagnnnnnnnnnn

SEQ ID NO: 185687 - DNA, 470 bp, Homo sapiens
  misc_feature: GYAE6OF01BAJSO.30.68.G02.1.454.CMB.1.raw
  modified_base (128)..(128): a, c, t, g, unknown or other
  misc_feature (128)..(128): n is a, c, g, or t
  modified_base (447)..(470): a, c, t, g, unknown or other
  misc_feature (447)..(470): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttnaccatctccagggacagttcgaagaacacactgtttctgcaaatgaacagcctgagagtcgaggacacggccgtatattactgtgcgctttcaccctggagtgggagttacaaggcatacttccaccactggggccgggcaccgtggtcagcgtctcctcagcctccaccaagggcccatccggtccttccccctggccaccctcctccaacgcgccacctcgtgggggccacgacgcacgcccgtgggctcggccctggcaacgggactacgttccacgtacgcgtgcgtgacggcgggctggcgaaggcgacatagnnnnnnnnnnnnnnnnnnnnnnnn

SEQ ID NO: 185688 - DNA, 433 bp, Homo sapiens
  misc_feature: GYAE6OF01AGQLX.30.68.G02.1.454.CMB.1.raw
  modified_base (423)..(433): a, c, t, g, unknown or other
  misc_feature (423)..(433): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagagcacctctggggcacagcagccctgggctgcctggtcaaggctactccacgtagcgtgctgagcgggctggcaaggcgcatagnnnnnnnnnnn

SEQ ID NO: 185689 - DNA, 434 bp, Homo sapiens
  misc_feature: GYAE6OF01BRMWS.30.68.G02.1.454.CMB.1.raw
  modified_base (424)..(434): a, c, t, g, unknown or other
  misc_feature (424)..(434): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccatcactgggccggggcaccctggtcagcgtctcctcagcctccaccaagggcccatcggtcttccccctggcaccctcctccaagagcacctctgggggcacagcagccctgggctgcctggtcaaggctacttccacgtagcgtgctgagcgggctggcaaggcgcatagnnnnnnnnnnn

SEQ ID NO: 185690 - DNA, 431 bp, Homo sapiens
  misc_feature: GYAE6OF01D77MR.30.68.G02.1.454.CMB.1.raw
  modified_base (424)..(431): a, c, t, g, unknown or other
  misc_feature (424)..(431): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccgggcaccctggtcagcgtctcctcagcctccaccaagggcccatcggtcttccccctggcaccctcctccaagacgcacctctggggcacagcagccctgggctgcctggtcaaggactacttccacgtagcgtgctgagcgggctggcaaggcgcatagnnnnnnnn

SEQ ID NO: 185691 - DNA, 444 bp, Homo sapiens
  misc_feature: GYAE6OF01BOO3M.30.68.G02.1.454.CMB.1.raw
  modified_base (427)..(427): a, c, t, g, unknown or other
  misc_feature (427)..(427): n is a, c, g, or t
  modified_base (433)..(444): a, c, t, g, unknown or other
  misc_feature (433)..(444): n is a, c, g, or t
tcagcacgctacgtcacgaccggtgctcgatttagtcgatagtgaagggaaaggggatggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggcccggggcaccctggtcagcgtctcctcagcctccaccaagggcccatccggtccttccccctggccaccctcctccaagacgccacctcgtcgggggcacagcagccctggggctgcctggtcaaggctactccacgtagcgtgctgagcgggctggcaaggcncatagnnnnnnnnnnnn

SEQ ID NO: 185692 - DNA, 431 bp, Homo sapiens
  misc_feature: GYAE6OF01DQKEI.30.68.G02.1.454.CMB.1.raw
  modified_base (425)..(431): a, c, t, g, unknown or other
  misc_feature (425)..(431): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagagcacctctggggcacagcagccctgggctgcctggtcaaggactacttccacgtagcgtgctgagcgggctggcaaggcgcatagnnnnnnn

SEQ ID NO: 185693 - DNA, 434 bp, Homo sapiens
  misc_feature: GYAE6OF01C5UIX.30.68.G02.1.454.CMB.1.raw
  modified_base (426)..(434): a, c, t, g, unknown or other
  misc_feature (426)..(434): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggccaccctcctccaagagcacctctggggcacagcagccctgggctgcctggtcaaggactacttccacgtagcgtgctgagcgggctggcaaggcgcatagnnnnnnnnn

SEQ ID NO: 185694 - DNA, 476 bp, Homo sapiens
  misc_feature: GYAE6OF01EJRJM.30.68.G02.1.454.CMB.1.raw
  modified_base (467)..(476): a, c, t, g, unknown or other
  misc_feature (467)..(476): n is a, c, g, or t
tcagcacgctacgtcacgaccggtgctcgatttagtcgatagtgaaggggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccggggcacccgtggtcagcgtctcctcagcctccaccaacgggcccagtccggtccttcccccgtcggccacccctcctaccaagacgccacctcgtcggggccacgagcacgcccgtgggcctgtccgtggtcaacggaccttaccttcccacgttacgcgtgacctggacggcggggctgggcaagggtccacgatagcnnnnnnnnnn

SEQ ID NO: 185695 - DNA, 513 bp, Homo sapiens
  misc_feature: GYAE6OF01COOGR.30.68.G02.1.454.CMB.1.raw
  modified_base (487)..(487): a, c, t, g, unknown or other
  misc_feature (487)..(487): n is a, c, g, or t
  modified_base (489)..(513): a, c, t, g, unknown or other
  misc_feature (489)..(513): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccgggcaccctggtcagccgtctcctcacgccctccacccgaaacgggcccagtcccggtccttcccccgtcggcctacccctcctcccgaaagcgccaccgtcgtcgggggccacgacgcacgcccgtgggctcgccgtcggtacaaaggtacctacttacccgacggttacgccgtagcgtggacggccggggctcgggaccgtaagggccgacgagtaagngnnnnnnnnnnnnnnnnnnnnnnnnn

SEQ ID NO: 185696 - DNA, 467 bp, Homo sapiens
  misc_feature: GYAE6OF01BUHLU.30.68.G02.1.454.CMB.1.raw
  modified_base (449)..(467): a, c, t, g, unknown or other
  misc_feature (449)..(467): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccgggcacccgtggtcagcgtctcctcagcctccaccaacggcccatccggtcttccccctggccaccctcctccaacgacgccacctcgtcggggcacgagcacgcccgtcgggctcgccgtggtacaaggtacctacttccacgtagcgtgctggacggcgggcgtcggcgaacggcgcagtgnnnnnnnnnnnnnnnnnnn

SEQ ID NO: 185697 - DNA, 510 bp, Homo sapiens
  misc_feature: GYAE6OF01B0MHP.30.68.G02.1.454.CMB.1.raw
  modified_base (471)..(471): a, c, t, g, unknown or other
  misc_feature (471)..(471): n is a, c, g, or t
  modified_base (473)..(474): a, c, t, g, unknown or other
  misc_feature (473)..(474): n is a, c, g, or t
  modified_base (476)..(481): a, c, t, g, unknown or other
  misc_feature (476)..(481): n is a, c, g, or t
  modified_base (483)..(493): a, c, t, g, unknown or other
  misc_feature (483)..(493): n is a, c, g, or t
  modified_base (495)..(495): a, c, t, g, unknown or other
  misc_feature (495)..(495): n is a, c, g, or t
  modified_base (497)..(510): a, c, t, g, unknown or other
  misc_feature (497)..(510): n is a, c, g, or t
tcagcacgctacgtcacgaccggtgctcgatttagtcgatagtgaagggaaaggggcgtggaatgggtctcgaagtattgctggtagtggtgatagcacatactacgcagccatcgtgaaggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccgggcaccctggtcagcgtctcctcagccctccaccgaacgggcccatcggtccttcccccgtggcctaccctcctccgaaagcgcaccgtcgtcgggggccacgagccacggccctgggctcgccgtgggtaccaacgggtaccttaccgttccgacggttacgctgctggacggcgggctggaccaacggcgaccgagtagcgngnngnnnnnngnnnnnnnnnnngngnnnnnnnnnnnnnn

SEQ ID NO: 185698 - DNA, 438 bp, Homo sapiens
  misc_feature: GYAE6OF01AMZV4.30.68.G02.1.454.CMB.1.raw
  modified_base (430)..(438): a, c, t, g, unknown or other
  misc_feature (430)..(438): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttcccccctggccaccctcctcccaacgagcacctctgggggcacagcagccctgggctgcctggtcaaggactacttccacgtagcgtgctgagcgggctggcaaggcgcatagnnnnnnnnn

SEQ ID NO: 185699 - DNA, 433 bp, Homo sapiens
  misc_feature: GYAE6OF01C82EX.30.68.G02.1.454.CMB.1.raw
  modified_base (317)..(317): a, c, t, g, unknown or other
  misc_feature (317)..(317): n is a, c, g, or t
  modified_base (374)..(374): a, c, t, g, unknown or other
  misc_feature (374)..(374): n is a, c, g, or t
  modified_base (403)..(403): a, c, t, g, unknown or other
  misc_feature (403)..(403): n is a, c, g, or t
  modified_base (422)..(433): a, c, t, g, unknown or other
  misc_feature (422)..(433): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcacctggagtgggattacaaggcatacttccaccactggggccggggcaccctggtcagcgtctcctcagcctccaccaaggccatcggtctcccccngccacctcctccagagcacctctggggcacagcagccctgggctgcctggtcaaggntacttccacgttagcgtgcgtgagcgggntgggcaagggcgcagtagnnnnnnnnnnnn

SEQ ID NO: 185700 - DNA, 525 bp, Homo sapiens
  misc_feature: GYAE6OF01AIXE9.30.68.G02.1.454.CMB.1.raw
  modified_base (509)..(525): a, c, t, g, unknown or other
  misc_feature (509)..(525): n is a, c, g, or t
tcagcacgctacgtcacgaccggtgctcgatttagtcgatagtgaagggaaggggctgggaatgggtcttcaagtattgcctggtagtggtgatagcgacactactaacgctagcccatcgttgtaaggccggttcaccatctccagggactacgttcggaagaactaccgacctaggtttacctaggtacgaaaaattcgaaaaccgacgtccgttggacgtaggtccgaacggactaccggtccgttattattacctgtccgccgtcttttccacccgtggagtcgggtagttacaaggcagtaccttccgaccgacgtcggggcccgggcacccgtggtcagcgtctcctcacgcctccaccaacggcccatccggtccttccccctggccaccctcctccaagcgcacctcgtcggggcacacgcacgcccgtgggctcgccgtggtcaacggtactactccgacgtagcgtgctgacggcgggctgggcgaaggcgacagtagnnnnnnnnnnnnnnnnn

SEQ ID NO: 185701 - DNA, 462 bp, Homo sapiens
  misc_feature: GYAE6OF01DB1LE.30.68.G02.1.454.CMB.1.raw
  modified_base (454)..(462): a, c, t, g, unknown or other
  misc_feature (454)..(462): n is a, c, g, or t
tcagcacgctacgtcacgaccggtgctcgatttagtcgatagtgaagggaaaggggcgtggaatgggtctcaagtattgctggtagtggtgattagcacatactacgcagccatcgtgaagggccggttcaccatctccagggacagttcgaagaacacactgtttctgcaaatgaacagcctgagagtcgaggacacggccgtatattactgtgcgctttcacctggagtgggagtacaaggcatacttcaccacgtggggccgggaacctggtcagcgtctcctcagcctccaccgaacgggcccatccggtccttccccctggccaccctcctccaagacgcacctcgtcggggcacaacgcacgcccgtggcctcgtcctggtacaacggtccttaacgtccgaacgttacgcgttgcgtagacggcggcgtaggcgaaggcgacatagnnnnnnnnn

SEQ ID NO: 185702 - DNA, 439 bp, Homo sapiens
  misc_feature: GYAE6OF01CGUM1.30.68.G02.1.454.CMB.1.raw
  modified_base (423)..(423): a, c, t, g, unknown or other
  misc_feature (423)..(423): n is a, c, g, or t
  modified_base (429)..(439): a, c, t, g, unknown or other
  misc_feature (429)..(439): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtccttccccctggccaccctcctccaagacgcacctcgtgggggcacagcagccctgggctgcctggtcaaggactactccacgtagcgtgctgagcgggctggcaaggcncatagnnnnnnnnnnn

SEQ ID NO: 185703 - DNA, 451 bp, Homo sapiens
  misc_feature: GYAE6OF01CUNYA.30.68.G02.1.454.CMB.1.raw
  modified_base (431)..(451): a, c, t, g, unknown or other
  misc_feature (431)..(451): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgcttttcaccctggagtgggagttacaaggcatacttcaccactgggccggggcaccctggtcagcgtctcctcagcctccaccaagggcccatcggtctccccctggccaccctcctccaagacgcacctcgtggggcacagcagccctgggctgcctggtcaaggctacttccacgtagcgtgctgacgcgggctgggcaagggcgacagtacgnnnnnnnnnnnnnnnnnnnnn

SEQ ID NO: 185704 - DNA, 445 bp, Homo sapiens
  misc_feature: GYAE6OF01ELFI6.30.68.G02.1.454.CMB.1.raw
  modified_base (433)..(433): a, c, t, g, unknown or other
  misc_feature (433)..(433): n is a, c, g, or t
  modified_base (439)..(445): a, c, t, g, unknown or other
  misc_feature (439)..(445): n is a, c, g, or t
tcagcacgctacgtcacgaccggtgctcgatttagtcgatagtgaagggaaagggggctggaatgggtcctcaagtatttgcgtggtagtgggtgatagcacatactacgcagccatcgtgaagggccggttcaccatcgtccagggacaggttcgaagaacacactgtttctgcaaatgaacacgcctgagagtcgacggaccacggccgtatattactgtgagctttcaccctggagtggggagttacaaggcatacttccaccactggggccggggcaccctggtcagcgtctcctcagcctccaccaagggccatcggtcttccccctggcaccctcctccaagacgcacctctcgggggcacagcagccctgggctgcctggtcaaggactacttccacgtagcgtgctgagcgggctggcaaggcgnagtagnnnnnnn

SEQ ID NO: 185705 - DNA, 445 bp, Homo sapiens
  misc_feature: GYAE6OF01DNJXW.30.68.G02.1.454.CMB.1.raw
  modified_base (429)..(429): a, c, t, g, unknown or other
  misc_feature (429)..(429): n is a, c, g, or t
  modified_base (435)..(445): a, c, t, g, unknown or other
  misc_feature (435)..(445): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtgggccgggcaccctggtcagcgtctcctcagcctccaccaagggcccatcggtccttccccctggccacccctcctccaacgacgccacctcgtggggccacgagcacgccctgggctcgcctggtcaaggactacttccacgtagcgtgctgagcgggctggcaaggcncatagnnnnnnnnnnn

SEQ ID NO: 185706 - DNA, 385 bp, Homo sapiens
  misc_feature: GYAE6OF01DEECN.30.68.G02.1.454.CMB.1.raw
  modified_base (373)..(373): a, c, t, g, unknown or other
  misc_feature (373)..(373): n is a, c, g, or t
  modified_base (379)..(385): a, c, t, g, unknown or other
  misc_feature (379)..(385): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgctagtttattattgtcagcactataacaattggcctccggaaacttttggccaggggaccaagcttgagatcaaacgaactgtggctgcaccatctgtcttcatcttccgcatctgaacgtagcgtgctgagcggctgcgaaggcncatagnnnnnnn

SEQ ID NO: 185707 - DNA, 500 bp, Homo sapiens
  misc_feature: GYAE6OF01ECTYA.30.68.G02.1.454.CMB.1.raw
  modified_base (480)..(500): a, c, t, g, unknown or other
  misc_feature (480)..(500): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaggcatacttccaccacgtggggccgggcacccgtggtcagcgtctcctcagccctccaccaacgggcccatccggttccttccccctcggccaccccgtccctcccaacgacgcctaccgtcgtcgggggcacgagcacgcccgtcgggctcgccgtgggtccgaaacggtacctacttcccgacgtacgcgtcgctaggcggcggggtcgtcgggacgtaagggccgacgtagtacggnnnnnnnnnnnnnnnnnnnnn

SEQ ID NO: 185708 - DNA, 497 bp, Homo sapiens
  misc_feature: GYAE6OF01DJBV1.30.68.G02.1.454.CMB.1.raw
  modified_base (331)..(331): a, c, t, g, unknown or other
  misc_feature (331)..(331): n is a, c, g, or t
  modified_base (459)..(459): a, c, t, g, unknown or other
  misc_feature (459)..(459): n is a, c, g, or t
  modified_base (466)..(466): a, c, t, g, unknown or other
  misc_feature (466)..(466): n is a, c, g, or t
  modified_base (469)..(497): a, c, t, g, unknown or other
  misc_feature (469)..(497): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccgggcacccgtggtcagcgtctcctcacgccctccaccgaacgggcccattccggtcctttcccccngggccaccccttcctccaagacgcctacctcgtgggggccacgacgcacggccccgtgggctcgccgtcgggtacaaacgggaccttactcccgacgtacgcgtgctgacggcgggctggcaagggcncacgtgncgnnnnnnnnnnnnnnnnnnnnnnnnnnnnn

SEQ ID NO: 185709 - DNA, 497 bp, Homo sapiens
  misc_feature: GYAE6OF01BYSQM.30.68.G02.1.454.CMB.1.raw
  modified_base (215)..(215): a, c, t, g, unknown or other
  misc_feature (215)..(215): n is a, c, g, or t
  modified_base (462)..(497): a, c, t, g, unknown or other
  misc_feature (462)..(497): n is a, c, g, or t
tcagcacgctacgtcacgaccggtgctcgatttagtcgatagtgaagggaaaggggctgggaatgggtctacaagtattgctggtagtggtgatagctacatactacgcagccatcgtgaagggccggttcaccgatctccagggacagttccgaagaacacactgtttctgcaaatgaacagcctgagagtcgaggacacggccgtatattacngtgccgctttcacccttggagtgggattaacaaggcatacttccaccagtgggccgggcaccctggtcagcgtctcctcagcctccacctaaggcccatccggtcttcccccgtggccaccctcctccaaagacgccaccgtcgtagggggccacgagcagccccgtgggcctgccctggtaccaaaggtctaacttccacgtagcgtgctggacgacgggcttgggcaaggccgtactagtacggnnnnnnnnnnnnnnnnnnnnnnnnnnnnnnnnnnnn

SEQ ID NO: 185710 - DNA, 442 bp, Homo sapiens
  misc_feature: GYAE6OF01BI7DR.30.68.G02.1.454.CMB.1.raw
  modified_base (429)..(431): a, c, t, g, unknown or other
  misc_feature (429)..(431): n is a, c, g, or t
  modified_base (433)..(442): a, c, t, g, unknown or other
  misc_feature (433)..(442): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttcccccctggccaccctcctccaagacgcacctctgggggcacagcagccctggctgcctggtcaagactacttccacgtagcgtgctgaggcgggctggcaaggcgcgatagnnngnnnnnnnnnn

SEQ ID NO: 185711 - DNA, 391 bp, Homo sapiens
  misc_feature: GYAE6OF01BLZBK.30.68.G02.1.454.CMB.1.raw
  modified_base (384)..(391): a, c, t, g, unknown or other
  misc_feature (384)..(391): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagtattttgctagttttattattgtcagcactataacaattggcctccggaaacttttggccaggggaccaagcttgagatcaaacgaactgtggctgcaccatctgtcttcatcttcccgcatctgaacgtagcgtgctgagcgggctgggcaaggcgcatagnnnnnnnn

SEQ ID NO: 185712 - DNA, 429 bp, Homo sapiens
  misc_feature: GYAE6OF01DSN6C.30.68.G02.1.454.CMB.1.raw
  modified_base (423)..(429): a, c, t, g, unknown or other
  misc_feature (423)..(429): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtctccccctggcaccctcctccaagagcacctctggggcacagcagccctgggctgcctggtcaaggctacttccacgtagcgtgctgagcgggctggcaaggcgcatagnnnnnnn

SEQ ID NO: 185713 - DNA, 439 bp, Homo sapiens
  misc_feature: GYAE6OF01CQ5HS.30.68.G02.1.454.CMB.1.raw
  modified_base (423)..(439): a, c, t, g, unknown or other
  misc_feature (423)..(439): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagtattttgctagtttattattgtcagctaatataacaattggacctacggtaaacttttggacctaggggaccaagcttagacgatacaaacgtaactgtagctgacaccatctagtcttcacttcctcccgccattcgtacgtaacgtacgcgttagcttggagggccgggacgttcgggacgaagggccgacgtaagtagnnnnnnnnnnnnnnnnn

SEQ ID NO: 185714 - DNA, 505 bp, Homo sapiens
  misc_feature: GYAE6OF01BR7EK.30.68.G02.1.454.CMB.1.raw
  modified_base (473)..(473): a, c, t, g, unknown or other
  misc_feature (473)..(473): n is a, c, g, or t
  modified_base (475)..(505): a, c, t, g, unknown or other
  misc_feature (475)..(505): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtggggattacaggcatacttccaccactgggccggggcaccctggtcagcgtctcctcagcctccaccaagggcccactcggtccttccccctcggccacccctcctccaacgacgccacctcgtggggcacgagcacgccctgggctcgccgtggtaccaaaggtacctacttcccgacgtacggccgtagtcctggacggaccgggcggtcgggccgtaaacgggccggaccgagtaaggcngnnnnnnnnnnnnnnnnnnnnnnnnnnnnnnn

SEQ ID NO: 185715 - DNA, 570 bp, Homo sapiens
  misc_feature: GYAE6OF01C9N0Z.30.68.G02.1.454.CMB.1.raw
  modified_base (528)..(528): a, c, t, g, unknown or other
  misc_feature (528)..(528): n is a, c, g, or t
  modified_base (531)..(531): a, c, t, g, unknown or other
  misc_feature (531)..(531): n is a, c, g, or t
  modified_base (533)..(534): a, c, t, g, unknown or other
  misc_feature (533)..(534): n is a, c, g, or t
  modified_base (538)..(538): a, c, t, g, unknown or other
  misc_feature (538)..(538): n is a, c, g, or t
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
  modified_base (547)..(570): a, c, t, g, unknown or other
  misc_feature (547)..(570): n is a, c, g, or t
tcagcacgctacgtcacgaccggtgctcgatttagtcgatagtgaagggaaagggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcacctggagtgggagttacaaggcatacttccaccgacgtggggccgggcacccgtggtcagccgtctcctcacgcctccaccaacgggcccagttccggtcccttcccccgtggccctaccccttcctacccaaacggacgccaaccgtccgtggggaccacgacgcacggcccgtgggctcggccgtcggtaccgaaacgggtaccttaaccgtttacccgaacggttacggcggttacggccggttacgggacgggtccggggtcgttacggggaccgtaaacgggccggaccgtaagtacggacgncgngnngcgngcngngtcnnnnnnnnnnnnnnnnnnnnnnnn

SEQ ID NO: 185716 - DNA, 444 bp, Homo sapiens
  misc_feature: GYAE6OF01BT8EQ.30.68.G02.1.454.CMB.1.raw
  modified_base (422)..(422): a, c, t, g, unknown or other
  misc_feature (422)..(422): n is a, c, g, or t
  modified_base (428)..(444): a, c, t, g, unknown or other
  misc_feature (428)..(444): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaaggccggttcaccatctccagggacagttcgaagaacacactgtttctgcaaatgaacagcctgagagtcgaggacacggccgtatattactgtgcgctttcaccctggagtgggagttacaaggcatacttccaccactggggccgggcaccctggtcagcgtctcctcagcctccaccaagggccatcggtcttccccctggccaccctcctccaagacgcacctcgtggggcacagcacgccctgggcctgccgtggtccaaggctacttccacgtacgcgtctgagcgggctggcaaggcncatagnnnnnnnnnnnnnnnnn

SEQ ID NO: 185717 - DNA, 457 bp, Homo sapiens
  misc_feature: GYAE6OF01DF3OV.30.68.G02.1.454.CMB.1.raw
  modified_base (440)..(457): a, c, t, g, unknown or other
  misc_feature (440)..(457): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggattacaaggcatacttccaccacgtggggccgggcaccctggtccagcgtctcctcagcctccaccaaggcccatcggtccttcccccgtcggccaccctcctccaagacgcacctcgtggggcacacgcacgccctgggctcgccgtggtcaacggactacttccacgtacgcgtgcgtgagcgggctggcaaggcgacagtacgnnnnnnnnnnnnnnnnnn

SEQ ID NO: 185718 - DNA, 456 bp, Homo sapiens
  misc_feature: GYAE6OF01B2KWC.30.68.G02.1.454.CMB.1.raw
  modified_base (437)..(456): a, c, t, g, unknown or other
  misc_feature (437)..(456): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtccttccccctggccaccctcctccaacgacgcacctcgtcgggggccacagcacgccctggctgccctggtcaacgactacttccacgtcgcgtcgctgagcgggcgtggcgaaggcgcactgnnnnnnnnnnnnnnnnnnnn

SEQ ID NO: 185719 - DNA, 649 bp, Homo sapiens
  misc_feature: GYAE6OF01D2MQM.30.68.G02.1.454.CMB.1.raw
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
  modified_base (618)..(649): a, c, t, g, unknown or other
  misc_feature (618)..(649): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggcgtatattactgtgcgtctttcaccctgggagtggagttacaggcatacttccacacgtggggcccgggcacccgtggcacgccgtctccctcacgcccctccgaacccgaacggggcccctaacgttcccgggttccccttcccccccgtacgggccccctaccccccgttccccttaacccgaaacggtaccgtacccctaaccccggttccggtcggggggacccaaccggaacggcccgaaccgggtccccggtggggtcccttccgggcccgttacgggtaaacccgtaaacgggtaaccccttacccgtttcccgaaccgggtttcggtcccgggtcggtacgttccggggaacgggtcccgggggtacgttacgggacccggtaaacggggccgtacctaaagtcggancngnnnnnnnnnnnnnnnnnnnnnnnnnnnnnnnn

SEQ ID NO: 185720 - DNA, 392 bp, Homo sapiens
  misc_feature: GYAE6OF01D9ZEF.30.68.G02.1.454.CMB.1.raw
  modified_base (387)..(392): a, c, t, g, unknown or other
  misc_feature (387)..(392): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagtattttgctagttttattattgtcagcaactataacaattggacctaccggaaacttttggccaggggaccaagcttgagatcaaacgaactgtggctgcacatctgtcttcatcttcccgctatctgaacgtagcgtgctgagcgggctgggcaaggcacatagnnnnnn

SEQ ID NO: 185721 - DNA, 439 bp, Homo sapiens
  misc_feature: GYAE6OF01BBTC3.30.68.G02.1.454.CMB.1.raw
  modified_base (427)..(439): a, c, t, g, unknown or other
  misc_feature (427)..(439): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggccaccctcctccaagcgcacctctggggcacagcagccctgggctcgcctggtcaaggctactccacgtagcgtgctgagcgggctgggcaaggcgcatagcnnnnnnnnnnnnn

SEQ ID NO: 185722 - DNA, 432 bp, Homo sapiens
  misc_feature: GYAE6OF01A0K5A.30.68.G02.1.454.CMB.1.raw
  modified_base (425)..(432): a, c, t, g, unknown or other
  misc_feature (425)..(432): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtggggagttacaaggcatacttccaccactggggccggggcaccctggtcagcgtctcctcagcctccaccaagggcccatcggtcttccccctggcaccctcctccaagagcacctctggggcacagcagccctgggctgcctggtcaaggactactccacgtagcgtgctgagcgggctggcaaggcgcatagnnnnnnnn

SEQ ID NO: 185723 - DNA, 466 bp, Homo sapiens
  misc_feature: GYAE6OF01AQU88.30.68.G02.1.454.CMB.1.raw
  modified_base (344)..(344): a, c, t, g, unknown or other
  misc_feature (344)..(344): n is a, c, g, or t
  modified_base (364)..(364): a, c, t, g, unknown or other
  misc_feature (364)..(364): n is a, c, g, or t
  modified_base (405)..(405): a, c, t, g, unknown or other
  misc_feature (405)..(405): n is a, c, g, or t
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
  modified_base (439)..(466): a, c, t, g, unknown or other
  misc_feature (439)..(466): n is a, c, g, or t
tcagcacgctacgtcacgaccggtgctcgatttagtcgatagtgaagggaaagggggctggaatgggtctcaagtattgctggtagtggtgatagcacatactacgcagccatcgtgaagggccggttcaccatctccagggacagttcgaagaacacactgtttctgcaaatgaacagcctgagagtcgaggaccacggccgtatattactgtgcgctttcaccctggagtgggagttacaaggtcagtacttccaccactggggccggggcaccctggtcagcgtctcctcagcctcaccaacgggccatcggtccttccccctggccaccctcctccaagngccacctcgtggggcaacgngcagccctgggcctgccgtggtcaaggactactccacgtanccgtgctgcgcgggctggcaggcgangtagntgnnnnnnnnnnnnnnnnnnnnnnnnnnnn

SEQ ID NO: 185724 - DNA, 433 bp, Homo sapiens
  misc_feature: GYAE6OF01ES0KR.30.68.G02.1.454.CMB.1.raw
  modified_base (342)..(342): a, c, t, g, unknown or other
  misc_feature (342)..(342): n is a, c, g, or t
  modified_base (427)..(433): a, c, t, g, unknown or other
  misc_feature (427)..(433): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcacgcctccaccaagggcccatcggtcctcccctggccaccctcctccaacgancacctcgtggggcacagcagccctggctgcctgtcaaggactactccacgtacgcgtgcgtgagcgggctggcaaggcgcatagnnnnnnn

SEQ ID NO: 185725 - DNA, 431 bp, Homo sapiens
  misc_feature: GYAE6OF01CYQ1I.30.68.G02.1.454.CMB.1.raw
  modified_base (419)..(419): a, c, t, g, unknown or other
  misc_feature (419)..(419): n is a, c, g, or t
  modified_base (424)..(431): a, c, t, g, unknown or other
  misc_feature (424)..(431): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggccaccctcctccaagacgcacctctggggcacagcagccctggctgcctggtcaaggactactccacgtagcgtgctgagcgggctggcaaggcgnatagnnnnnnnn

SEQ ID NO: 185726 - DNA, 538 bp, Homo sapiens
  misc_feature: GYAE6OF01CFBVV.30.68.G02.1.454.CMB.1.raw
  modified_base (502)..(523): a, c, t, g, unknown or other
  misc_feature (502)..(523): n is a, c, g, or t
  modified_base (525)..(538): a, c, t, g, unknown or other
  misc_feature (525)..(538): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatcctccagggacagttcgaagaacacactgtttctgcaaatgaacagcctgagagtcgaggacacggccgtatattactgtgcgcttttcaccctggagtgggagttacaaggcatacttccaccactggggccggggcacccgtggtcagccgtctcctcagcctccaccgaagggcccagttccggtccttccccccgtggccaccctccctccaacgacgccacctccgtcggggccacagcacgcccgtgggccttcggcctgggtacaaacgggtaccttaaccttacccgaacgttacgccgttcggaccgttagggacggtccggggtacgtcgggaccgaaacggggccgacgagtaacggnnnnnnnnnnnnnnnnnnnnnngnnnnnnnnnnnnnn

SEQ ID NO: 185727 - DNA, 447 bp, Homo sapiens
  misc_feature: GYAE6OF01AQ9ZW.30.68.G02.1.454.CMB.1.raw
  modified_base (435)..(447): a, c, t, g, unknown or other
  misc_feature (435)..(447): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacatactgtttctgcaaatgaacagcctgagagtcgaggacacggccgtatattactgtgcgctttcaccctggagtgggagttacaaggcatacttccaccactggggccgggcaccctggtcagcgtctcctcagcctccaccaagggcccatccggtcttccccctggccacccctcctccaagagccacctctgggggcacagcagccctgggctgcctcggtcaaggactacttccacgtagcgtgctgagcgggctgggcaagggcgacagtacgnnnnnnnnnnnnn

SEQ ID NO: 185728 - DNA, 452 bp, Homo sapiens
  misc_feature: GYAE6OF01DFK8W.30.68.G02.1.454.CMB.1.raw
  modified_base (345)..(345): a, c, t, g, unknown or other
  misc_feature (345)..(345): n is a, c, g, or t
  modified_base (426)..(452): a, c, t, g, unknown or other
  misc_feature (426)..(452): n is a, c, g, or t
tcagcacgctacgtcacgaccggtgctcgatttagtcgatagtgaaggggaaaggggctggaatgggtctcaaggtattgctggtagtggtgatagcacatactacgcagccatcgtgaagggccggttcaccatctccagggacagttcgaagaacacactgttctgcaaatgaacagcctgagagtcgaggacacggccgtatattactgtgcgctttcaccctggagtgggattacaagcatactcacatgggccgggcaccctggtcagcgtctcctcagcctccaccaagggcccatcggtctcccctggcaccctctccaagcgccacctcgtggggcncgagcagccctgggctggccctgggcaaggacttactccacggttagcgttgctgaggcgggctgggacaaggcgcagtgnnnnnnnnnnnnnnnnnnnnnnnnnnn

SEQ ID NO: 185729 - DNA, 502 bp, Homo sapiens
  misc_feature: GYAE6OF01CRBS8.30.68.G02.1.454.CMB.1.raw
  modified_base (479)..(479): a, c, t, g, unknown or other
  misc_feature (479)..(479): n is a, c, g, or t
  modified_base (481)..(502): a, c, t, g, unknown or other
  misc_feature (481)..(502): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgcttttcaccctggagtgggagttacaaggcatacttccaccacgtggggccgggcacccgtggtcagtcgtctcctcacgcctccaccaagggccccagtccggtccttcccccctggccaccctccctccaacgacgcacccgtcgtgggggccacgagcacgcccctgggcctcggccctagggtaaacgacgtaccttaccgtacgtacgtacgtcgtactggacgggacgggcggtggacggaacggacggcgacgtagngnnnnnnnnnnnnnnnnnnnnnn

SEQ ID NO: 185730 - DNA, 428 bp, Homo sapiens
  misc_feature: GYAE6OF01DSESW.30.68.G02.1.454.CMB.1.raw
  modified_base (422)..(428): a, c, t, g, unknown or other
  misc_feature (422)..(428): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaaggcccatcggtctccccctggcacctcctccaagagcacctctggggcacagcagccctgggctgcctggtcaaggctacttccacgtagcgtgctgagcgggctggcaagggcgcatagnnnnnnn

SEQ ID NO: 185731 - DNA, 446 bp, Homo sapiens
  misc_feature: GYAE6OF01ATBKE.30.68.G02.1.454.CMB.1.raw
  modified_base (433)..(446): a, c, t, g, unknown or other
  misc_feature (433)..(446): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaaggggccccatcggtccttccccctggccgccctgcctccaggacgcacctccgagagcacacgcccgccctgggctgcctggtcaaggctacttccacgtagcgtgctgagcgggctggcaaggcgcatagnnnnnnnnnnnnnn

SEQ ID NO: 185732 - DNA, 434 bp, Homo sapiens
  misc_feature: GYAE6OF01B3WDZ.30.68.G02.1.454.CMB.1.raw
  modified_base (425)..(434): a, c, t, g, unknown or other
  misc_feature (425)..(434): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctggggcacgagcagccctgggctgcctggtcaaggctacttccacgtagcgtgctgagcgggctggcaaggcgcatagcnnnnnnnnnn

SEQ ID NO: 185733 - DNA, 437 bp, Homo sapiens
  misc_feature: GYAE6OF01D4ISG.30.68.G02.1.454.CMB.1.raw
  modified_base (426)..(437): a, c, t, g, unknown or other
  misc_feature (426)..(437): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcacccctggagtgggagttacaaggcatacttccaccactggggccggggcaccctggtcagcgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatgnnnnnnnnnnnn

SEQ ID NO: 185734 - DNA, 552 bp, Homo sapiens
  misc_feature: GYAE6OF01AZ2N8.30.68.G02.1.454.CMB.1.raw
  modified_base (513)..(513): a, c, t, g, unknown or other
  misc_feature (513)..(513): n is a, c, g, or t
  modified_base (520)..(525): a, c, t, g, unknown or other
  misc_feature (520)..(525): n is a, c, g, or t
  modified_base (527)..(552): a, c, t, g, unknown or other
  misc_feature (527)..(552): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccgggcacccgtggtcagccgtctcctcacgccctccaccgaagggcccatccggtccttcccccgtggcccacccctcctcccaagacgcacctcgtggggccacacgcagccccgtggggtcctcggcccgtagggtacccaaagggtacccttaaccgtttcccgaacggtttacggccggttcggacgttcgggaacggccgggggccttcggggaccgaaacggggccgtacgtaagttaagggnacgctannnnnncnnnnnnnnnnnnnnnnnnnnnnnnnn

SEQ ID NO: 185735 - DNA, 431 bp, Homo sapiens
  misc_feature: GYAE6OF01ES0PK.30.68.G02.1.454.CMB.1.raw
  modified_base (426)..(431): a, c, t, g, unknown or other
  misc_feature (426)..(431): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagagcacctctcggggcacagcagccctgggctgcctggtcaaggactacttccacgtagcgtgctgagcgggctggcaaggcgcatagnnnnnn

SEQ ID NO: 185736 - DNA, 574 bp, Homo sapiens
  misc_feature: GYAE6OF01D4HT6.30.68.G02.1.454.CMB.1.raw
  modified_base (129)..(129): a, c, t, g, unknown or other
  misc_feature (129)..(129): n is a, c, g, or t
  modified_base (166)..(166): a, c, t, g, unknown or other
  misc_feature (166)..(166): n is a, c, g, or t
  modified_base (206)..(206): a, c, t, g, unknown or other
  misc_feature (206)..(206): n is a, c, g, or t
  modified_base (477)..(477): a, c, t, g, unknown or other
  misc_feature (477)..(477): n is a, c, g, or t
  modified_base (483)..(483): a, c, t, g, unknown or other
  misc_feature (483)..(483): n is a, c, g, or t
  modified_base (499)..(499): a, c, t, g, unknown or other
  misc_feature (499)..(499): n is a, c, g, or t
  modified_base (506)..(506): a, c, t, g, unknown or other
  misc_feature (506)..(506): n is a, c, g, or t
  modified_base (539)..(539): a, c, t, g, unknown or other
  misc_feature (539)..(539): n is a, c, g, or t
tcagcacgctacgtcacgaccggtgctcgatttagtcgatagtgaagggaaagggggctggaatgggtctcaagtattggctggtacgtggtgatagcacatactacgcagccatcgtgagggccgttnaccatctccagggcagttcgaagaacacactgtttcngccaaatgaacagccctgagagtcgaggacacggccgtanattacctgtgcgctttcgaaccctggagtgggattacaaggctagtacttccaccacgtagggcccgggcaccctggtcagcgtctcctcagccctcaccaagggcccatcggtcctccccctggccaccctcctccaacgcgccacctcgtcggggcacagcacgcccgtgggcctgcccgtggtccaacgggaccttaccgttcccgacgtacgccggtagtccgtggacggccggggctagggcgaaacgggtccgaccgagtaaggngcgagngtagtgacgtgacganagtgtcncgtcacgacacgtacgcgcgtacgtcgagtacncgtaccgtacgtaccgtacgcgtactctcgcgtcg

SEQ ID NO: 185737 - DNA, 432 bp, Homo sapiens
  misc_feature: GYAE6OF01B9GA4.30.68.G02.1.454.CMB.1.raw
  modified_base (420)..(432): a, c, t, g, unknown or other
  misc_feature (420)..(432): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaggcccatcggtctccccctggccaccctcctccaagacgcacctctcggggcacagcagccctgggctgcctggtcaagctactccacgtagcgtgctgagcgggctggcaggcgcatagnnnnnnnnnnnnn

SEQ ID NO: 185738 - DNA, 450 bp, Homo sapiens
  misc_feature: GYAE6OF01BX90H.30.68.G02.1.454.CMB.1.raw
  modified_base (429)..(429): a, c, t, g, unknown or other
  misc_feature (429)..(429): n is a, c, g, or t
  modified_base (435)..(450): a, c, t, g, unknown or other
  misc_feature (435)..(450): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgtctttcaccctggagtgggagttacaaggcatacttccaccacgtcggggccgggcaccgtggtcagcgtctcctcacgcctccaccaagggcccatccggtccttcccccgtggccaccctcctccaagcgccacctcgtcggggcacgagcacggcctgggctcgcctggtcaaggtctactcacgtagcgtgctgacgcggctggcaggcncagtgnnnnnnnnnnnnnnnn

SEQ ID NO: 185739 - DNA, 431 bp, Homo sapiens
  misc_feature: GYAE6OF01E3JWY.30.68.G02.1.454.CMB.1.raw
  modified_base (426)..(431): a, c, t, g, unknown or other
  misc_feature (426)..(431): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcacccctcctccaacgagcacctctgggggcacagcagccctgggctgcctggtcaaggactacttccacgtagcgtgctgagcgggctggcaggcgcatagnnnnnn

SEQ ID NO: 185740 - DNA, 723 bp, Homo sapiens
  misc_feature: GYAE6OF01DG6FO.30.68.G02.1.454.CMB.1.raw
  modified_base (695)..(723): a, c, t, g, unknown or other
  misc_feature (695)..(723): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggctgtcacatctcgaggactgttacgaagaacactacttcgtttctcgaactaaagtacgaaacacgtccgtaggaaggtacggtacggaacggaccgaaccgggtaccgttaattaacttacgttggtcggccgttcctttacccacccggtgggtagggttaggggtaacgttaacgaacgggactaacttacccttaccccaaccgtaacgggttcggggggggccccgggggacccaaccccggttcgggttacgacggtccgttcctcccctacgaccggtcccctacccaaccggtaacccggggaccctacggttccggttccccctttccccccggtcgggtaccccctaccccctttaccccgtacccgaaaagggccgacccctaaccccgttcggggtcggggggacccaaccggacggaccgaacccggtccccgggtcgggccgtccggtcccggttcggttaacggaaaccggtaacctttacccttacccggacgttacggtccggtcgccgttaggacggggccgggtcgtcgggacggaacgggccgactaagtagcnnnnnnnnnnnnnnnnnnnnnnnnnnnnn

SEQ ID NO: 185741 - DNA, 528 bp, Homo sapiens
  misc_feature: GYAE6OF01DLO5T.30.68.G02.1.454.CMB.1.raw
  modified_base (502)..(528): a, c, t, g, unknown or other
  misc_feature (502)..(528): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttccaccctggagtgggagttacaaggcataccttccaccgacgtggggccgggcacccgtggtcagcgtctcctcacgcctccaccgaacgggcccagttccggtccttcccccgtcggcctacccctccctacccaacgacgcccgacctccgtcgggggccaacgacgccgaccggccccgtcgggccgtcggcccgtgggtaccgtaaacggtaccttaccgttacccgacgtacggccgtcgcgtggacggcgggcgtggacgacggcgacgagtagcgnnnnnnnnnnnnnnnnnnnnnnnnnnn

SEQ ID NO: 185742 - DNA, 448 bp, Homo sapiens
  misc_feature: GYAE6OF01ATDXD.30.68.G02.1.454.CMB.1.raw
  modified_base (438)..(448): a, c, t, g, unknown or other
  misc_feature (438)..(448): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccgacgtggggccggggcaccctggtcagcgtctcctcagcctccaccagggcccatcggtccttccccctggccacccctcctccaagcgccacctcgtcgggggccacagcagcccgtgggctgcctgggtcaaggactacttccatcgtagcgtgctgagcgggctggacaggcgcagtagnnnnnnnnnnn

SEQ ID NO: 185743 - DNA, 471 bp, Homo sapiens
  misc_feature: GYAE6OF01COERN.30.68.G02.1.454.CMB.1.raw
  modified_base (457)..(471): a, c, t, g, unknown or other
  misc_feature (457)..(471): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgacaaatgaacagcctgagagtcgaggacacggccgtatattactgtgcgctttcacctggagtggagtacaagcatacttcaccacgtggggccgggcaccgtggtcagcgtctcctcacgcctccacccgaacgggcccatccggtccttcccccgtcggcacccctcctaccaacgagccacctcgtaggggcacgagcacgcccgtgggctcgctggtacaacggtactacttaccgacgtagccgtagcgtgacggtcgggcgtggacgaaagggcgtacagtagnnnnnnnnnnnnnnn

SEQ ID NO: 185744 - DNA, 393 bp, Homo sapiens
  misc_feature: GYAE6OF01ALXEJ.30.68.G02.1.454.CMB.1.raw
  modified_base (381)..(393): a, c, t, g, unknown or other
  misc_feature (381)..(393): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctggggacagagttcagtctcaccatcagcagcctgcagtctgaagattttgcagtttattattgtcagcactataacaattggcctcggaaacttttggcctaggggaccaagcttgagatcaaacgaactgtggctgcacatctgtcttcatcttcccgcatctgaacgtagcgtgctgagcgggctggcaaggcgcatacgnnnnnnnnnnnnn

SEQ ID NO: 185745 - DNA, 474 bp, Homo sapiens
  misc_feature: GYAE6OF01B2WV4.30.68.G02.1.454.CMB.1.raw
  modified_base (459)..(474): a, c, t, g, unknown or other
  misc_feature (459)..(474): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcacctggagtgggagttacaaggcatacttccaccacgtggggccgggcacccgtggtcagcgtctcctcagcctccaccacggccagtccggtcctccccctggccaccctcctccaagacgccacctcgtggggccacgagcacggcccgtgggcctcggccctggtacgaaacggtacctaccgttaccgacgtacgcgtgcgtgacggtcgggcgtcggacgaacggcgacagtgnnnnnnnnnnnnnnnn

SEQ ID NO: 185746 - DNA, 468 bp, Homo sapiens
  misc_feature: GYAE6OF01CBJQS.30.68.G02.1.454.CMB.1.raw
  modified_base (447)..(468): a, c, t, g, unknown or other
  misc_feature (447)..(468): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacgaaggcatacttccaccacgtggggccgggcaccctggtcagcgtctcctcagcctccaccaacgggcccatccggtccttccccctcggccaccctcctaccgaagacgccaccgtcgtcgggggccacgacgcacgcccgtgggctcgcctggtcaaggcctactccacgtagcgtgcgtgagcgggctggcgaaggcgcagtagnnnnnnnnnnnnnnnnnnnnnn

SEQ ID NO: 185747 - DNA, 474 bp, Homo sapiens
  misc_feature: GYAE6OF01B3A6H.30.68.G02.1.454.CMB.1.raw
  modified_base (312)..(312): a, c, t, g, unknown or other
  misc_feature (312)..(312): n is a, c, g, or t
  modified_base (316)..(316): a, c, t, g, unknown or other
  misc_feature (316)..(316): n is a, c, g, or t
  modified_base (325)..(325): a, c, t, g, unknown or other
  misc_feature (325)..(325): n is a, c, g, or t
  modified_base (337)..(337): a, c, t, g, unknown or other
  misc_feature (337)..(337): n is a, c, g, or t
  modified_base (417)..(417): a, c, t, g, unknown or other
  misc_feature (417)..(417): n is a, c, g, or t
  modified_base (421)..(422): a, c, t, g, unknown or other
  misc_feature (421)..(422): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
  modified_base (432)..(433): a, c, t, g, unknown or other
  misc_feature (432)..(433): n is a, c, g, or t
  modified_base (437)..(437): a, c, t, g, unknown or other
  misc_feature (437)..(437): n is a, c, g, or t
  modified_base (441)..(441): a, c, t, g, unknown or other
  misc_feature (441)..(441): n is a, c, g, or t
  modified_base (447)..(447): a, c, t, g, unknown or other
  misc_feature (447)..(447): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
  modified_base (460)..(460): a, c, t, g, unknown or other
  misc_feature (460)..(460): n is a, c, g, or t
  modified_base (462)..(463): a, c, t, g, unknown or other
  misc_feature (462)..(463): n is a, c, g, or t
  modified_base (466)..(466): a, c, t, g, unknown or other
  misc_feature (466)..(466): n is a, c, g, or t
  modified_base (468)..(470): a, c, t, g, unknown or other
  misc_feature (468)..(470): n is a, c, g, or t
  modified_base (472)..(474): a, c, t, g, unknown or other
  misc_feature (472)..(474): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaaggccggttcaccatctccagggacagttcgaagacacactgtttctgcaaatgaacagcctgagagtcgaggacacggccgtatattactgtgcgctttcaccctggagtgggagttacaaggcatacttccaccgactggggccgggcaccctggtcagcgtctctcagcctcacaaggccatcggtctcccnggcncctctcagncactctggggcncagcagccctgggctgcctggtcaagggctacttcacgtacgcgtgcttgagtcgggctgggcaagggcgcgattaaggntagnngncgancganncgtncgangctganctancgatnacgncnncancnnncnnn

SEQ ID NO: 185748 - DNA, 446 bp, Homo sapiens
  misc_feature: GYAE6OF01C9TLT.30.68.G02.1.454.CMB.1.raw
  modified_base (435)..(446): a, c, t, g, unknown or other
  misc_feature (435)..(446): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgcttttcaccctggagtgggagttacaaggcatacttccaccactggggccggggcaccctggtcagcgtctcctcagcctccaccaagggcccatccgtctccccctggccaccctcctccaagacgcacctcgtgggggcacacgcacgcccgtgggctcgcctggtcaaggactacttccacgtagcgtgctgacgcgggctggcaaggcgcagtagnnnnnnnnnnnn

SEQ ID NO: 185749 - DNA, 439 bp, Homo sapiens
  misc_feature: GYAE6OF01BCRBT.30.68.G02.1.454.CMB.1.raw
  modified_base (428)..(439): a, c, t, g, unknown or other
  misc_feature (428)..(439): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttcccctggccaccctcctccaagcgcacctctggggcacagcagccctgggcctgccgtggtcaaggacctacttccacgtagcgtgctgagcgggctggcaaggcgcatagnnnnnnnnnnnn

SEQ ID NO: 185750 - DNA, 645 bp, Homo sapiens
  misc_feature: GYAE6OF01DRU3B.30.68.G02.1.454.CMB.1.raw
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtggtctgggacagagttcagtctcaccatcagcagcctgcagtctgaagattttgactagttttattacttgtcagcaactataaacattggcctaccggtaaacttttcggccaggggaccaagtcttggagtacttacaaaacggtactggtcggcttcggaccacctacttcgttcgttacttcctaagttcccgttccccgggactacttcccgtagtaaacccggttaggtccgttacggtccctagggtaaccgggtcggggtaacccttggggaccgttaaacgggccggacccgtaagtttaaccgggatcggtaagtaccgttagtacgtacgttacgtacgtacgtacgtacgtacgtacgtacgtacgtacgtacgtacgtacgtcgtacgacgacgtacgacgtacgtacgacgtacgtacgtacgacgtcgtacgtacacgtactctcgtcgtcgtcgtcg

SEQ ID NO: 185751 - DNA, 546 bp, Homo sapiens
  misc_feature: GYAE6OF01C5ZKH.30.68.G02.1.454.CMB.1.raw
  modified_base (523)..(546): a, c, t, g, unknown or other
  misc_feature (523)..(546): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgtctttccacctggaggtgggagttacgaaggcataccttccaccacgtcggggccgggcacccgtggtcagcgtctcctcacgcctccaccgaacggcccagtccggtccttcccccgtcggcctacccctcctacccaaagtcgccctacctcggtcgggggccaacgacgccgtaacggccccgttggggcccttcggcccgttacgggtacaaacgggtaccttaccgttacccgacggttacggccgtggaccgttcgggacggtccgggtccggtcgggaccgaaacggggcacgtacgaagnnnnnnnnnnnnnnnnnnnnnnnn

SEQ ID NO: 185752 - DNA, 423 bp, Homo sapiens
  misc_feature: GYAE6OF01BTZFW.30.68.G02.1.454.CMB.1.raw
  modified_base (411)..(423): a, c, t, g, unknown or other
  misc_feature (411)..(423): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcaggtgggtctggggacagagttcagtctcaccatcagcagcctgcagtctgaagtattttgctagttttattattgtcagcaactaataacaatttggcccttaccggtaaaactttttggcccgtagggggacccaaaggcctttgagtactacaaaacgaacgtgtggctgcaccgatctgtcttcatccttcccgcatctgaacgtgcgtgctgacgcgggctgggcaaggcgcatagnnnnnnnnnnnnn

SEQ ID NO: 185753 - DNA, 484 bp, Homo sapiens
  misc_feature: GYAE6OF01DWMKM.30.68.G02.1.454.CMB.1.raw
  modified_base (473)..(484): a, c, t, g, unknown or other
  misc_feature (473)..(484): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggattacaggctatactccacacgtggggccgggcaccctggtcagcgtctcctcagtcctccaccgaaggcccagtcggtccttcccccgtcggccaccctcctccgaacgacgccacctcgtcgggggccacgacgccacgcccgtcggggctcggcctcgggtccaaacgggtacctaccgttacccgaacggttacgcgtacggctagggacggcgggcgtgggacagggcgcatagnnnnnnnnnnnn

SEQ ID NO: 185754 - DNA, 449 bp, Homo sapiens
  misc_feature: GYAE6OF01EYZ7B.30.68.G02.1.454.CMB.1.raw
  modified_base (430)..(449): a, c, t, g, unknown or other
  misc_feature (430)..(449): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccgggcaccctggtcagcgtctcctcagcctccaccaagggcccatcggtccttccccctggccaccctcctccaacgacgcacctcgtggggcacagcacgccctgggctgcctggtcaaggactacttccacgtagcgtgctgagcgggctggcaaggcgcatagnnnnnnnnnnnnnnnnnnnn

SEQ ID NO: 185755 - DNA, 446 bp, Homo sapiens
  misc_feature: GYAE6OF01EZZRI.30.68.G02.1.454.CMB.1.raw
  modified_base (399)..(399): a, c, t, g, unknown or other
  misc_feature (399)..(399): n is a, c, g, or t
  modified_base (401)..(403): a, c, t, g, unknown or other
  misc_feature (401)..(403): n is a, c, g, or t
  modified_base (405)..(406): a, c, t, g, unknown or other
  misc_feature (405)..(406): n is a, c, g, or t
  modified_base (408)..(408): a, c, t, g, unknown or other
  misc_feature (408)..(408): n is a, c, g, or t
  modified_base (412)..(446): a, c, t, g, unknown or other
  misc_feature (412)..(446): n is a, c, g, or t
tcagcacgctacgtcacgaccggtgctcgatttagtcgatagtgaagggaaagggcgaggagtgttagcagcaacttagcctggtaccagcagaaacctggccaggcctcccaggctcctccatctatgatgcgtccaccagggtcactggtatcccagccaggttcagcggcagtgggtctgggacagagttcagtctcaccatcagcagcctgcagtctgaagtattttgactagtttattattgtcagcactataacattcggcctccggaaacttttggccgaggggaccagcttgagatacaaacgactgtcggctgcaccatctcgttcttcactcctcccgcctatctagaacgtagcgtgctggagcggcgtggaccgaaggcgagatagnannnanncngacnnnnnnnnnnnnnnnnnnnnnnnnnnnnnnnnnnn

SEQ ID NO: 185756 - DNA, 534 bp, Homo sapiens
  misc_feature: GYAE6OF01DLPCT.30.68.G02.1.454.CMB.1.raw
  modified_base (511)..(534): a, c, t, g, unknown or other
  misc_feature (511)..(534): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgacaaatgaacagcctgagagtcgaggacacggccgtatattactgtgcgtctttcacccgtggaggtgggagttacgaaggctagtaccttccaaccgtacgtcggggcccgggccacccgtggtacgagtccgtcctcctcacgccctaccaccgaacggtccccacgttccgtcccttcccccgcggccctacccctccctaccaacgacgccctaccgtccggtcggggaccacgaccgaccgacgcccgtgggctcggtccgtacggtacgaacggtaccttaccgtccgacgtacgcgtgtcgtggacggcggacgtcggacgacggtcgactagtcgnnnnnnnnnnnnnnnnnnnnnnnn

SEQ ID NO: 185757 - DNA, 488 bp, Homo sapiens
  misc_feature: GYAE6OF01EJMAH.30.68.G02.1.454.CMB.1.raw
  modified_base (455)..(457): a, c, t, g, unknown or other
  misc_feature (455)..(457): n is a, c, g, or t
  modified_base (459)..(488): a, c, t, g, unknown or other
  misc_feature (459)..(488): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccaggggacagttcgaagaacacactgtttctgcaaatgaacagcctgagagtcgaggacacggccgtatattactgtgcgctttcaccctggagtgggagttacaggcatacttccacactggggccgggcaccctggtcagcgtctcctcagcctccaccaagggccccatccggtccttcccccgtcggccacccctcctccaacgacgccacctcgtcgggggcacgagcacgcccctgggctcgccgtggtcaaggactaccttccacggtacgcgtgctgacgcggggctcgggcgaagggccgacgatagcgnnncnnnnnnnnnnnnnnnnnnnnnnnnnnnnnn

SEQ ID NO: 185758 - DNA, 489 bp, Homo sapiens
  misc_feature: GYAE6OF01CAFX8.30.68.G02.1.454.CMB.1.raw
  modified_base (450)..(450): a, c, t, g, unknown or other
  misc_feature (450)..(450): n is a, c, g, or t
  modified_base (456)..(466): a, c, t, g, unknown or other
  misc_feature (456)..(466): n is a, c, g, or t
  modified_base (469)..(489): a, c, t, g, unknown or other
  misc_feature (469)..(489): n is a, c, g, or t
tcagcacgctacgtcacgaccggtgctcgatttagtcgatagtgaagggaaaggggctggaatgggtctcaagtatttgctggtagtggttgatagcacatactacgcagccatcgtgaagggccgggttcaccatctccagggacaggttcgaagaacacactgtttctgcaaatgaacagcctgagagtcgaggacacggccgtatattactgtgcgctttcaccctggagtgggagttacaaggcatacttccaccacgtggggccgggcacccgtggtcagcgtctcctcacgcctccaccgaacgggccccatccggtccttccccctggccacccgtcctcccaagacgccacctcgtcgggggcacgacgcacgcccgtgggctcgccgtggtcgaacggtactacgtccgacgtacgcgtgctggcgcgggctggcgaggcncgatgnnnnnnnnnnngcnnnnnnnnnnnnnnnnnnnnn

SEQ ID NO: 185759 - DNA, 447 bp, Homo sapiens
  misc_feature: GYAE6OF01EM4EU.30.68.G02.1.454.CMB.1.raw
  modified_base (359)..(359): a, c, t, g, unknown or other
  misc_feature (359)..(359): n is a, c, g, or t
  modified_base (432)..(447): a, c, t, g, unknown or other
  misc_feature (432)..(447): n is a, c, g, or t
tcagcacgctacgtcacgaccggtgctcgatttagtcgatagtgaagggaaagggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatactccacacgtggggccgggcaccctggtcagcgtctcctcagctccaccaagggcccatccggtcttccccctggccaccctcctccaagacgcaccctctcggggccacngcacgccctgggctgcatggtacaaggactacttccacgtagcgtgctgagcgggctggcaaggcgcatacgnnnnnnnnnnnnnnnn

SEQ ID NO: 185760 - DNA, 459 bp, Homo sapiens
  misc_feature: GYAE6OF01AQLO2.30.68.G02.1.454.CMB.1.raw
  modified_base (285)..(285): a, c, t, g, unknown or other
  misc_feature (285)..(285): n is a, c, g, or t
  modified_base (439)..(439): a, c, t, g, unknown or other
  misc_feature (439)..(439): n is a, c, g, or t
  modified_base (442)..(459): a, c, t, g, unknown or other
  misc_feature (442)..(459): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtcnccctcacgcctccaccaagggcccatccggtccttccccctggccacccctcctcccaagacgcacctcgtgggggccacgagcacgccctgggctcgcctggtcaaggactacttcccagtagcgtgctgagcgggctggcaaggcgcagtancgnnnnnnnnnnnnnnnnnn

SEQ ID NO: 185761 - DNA, 503 bp, Homo sapiens
  misc_feature: GYAE6OF01EJV7S.30.68.G02.1.454.CMB.1.raw
  modified_base (450)..(450): a, c, t, g, unknown or other
  misc_feature (450)..(450): n is a, c, g, or t
  modified_base (474)..(503): a, c, t, g, unknown or other
  misc_feature (474)..(503): n is a, c, g, or t
tcagcacgctacgtcacgaccggtgctcgatttagtcgatagtgaagggaaaggggctggaatgggtctcagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccggggcaccctggtcagcgtctcctcacgcctccaccgaacgggcccatcggtccttcccccgtggccaccctcctccaagacgccacctcgtcgggggccacgacgacacggccctgggcctcgccgtcggtacaaacgggtacctaccgttccaacggtagccgtagcgtggacggcggggtcgngggtacgaacgggccgcgatagcnnnnnnnnnnnnnnnnnnnnnnnnnnnnnn

SEQ ID NO: 185762 - DNA, 469 bp, Homo sapiens
  misc_feature: GYAE6OF01CIB1G.30.68.G02.1.454.CMB.1.raw
  modified_base (452)..(454): a, c, t, g, unknown or other
  misc_feature (452)..(454): n is a, c, g, or t
  modified_base (456)..(469): a, c, t, g, unknown or other
  misc_feature (456)..(469): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcacgcctccaccaagggccccatccggtccttcccccctggccaccccgtcctccaacgacgccaaccctcgtcggggggccacgacgccagccccgtggggcctcgcctggtccaagggactacttccacgtagcgtgctgagcgggctggcaaggcgcatgnnngnnnnnnnnnnnnnn

SEQ ID NO: 185763 - DNA, 453 bp, Homo sapiens
  misc_feature: GYAE6OF01AEDN7.30.68.G02.1.454.CMB.1.raw
  modified_base (438)..(438): a, c, t, g, unknown or other
  misc_feature (438)..(438): n is a, c, g, or t
  modified_base (440)..(453): a, c, t, g, unknown or other
  misc_feature (440)..(453): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatccggtcttccccctggccaccctcctccaagacgccacctcgtcggggcacgagcacgccctgggctcgcctggtcaaggactactccgacgtagcgtgctgaggcgggtcgtggcaaggcgacatagncnnnnnnnnnnnnnn

SEQ ID NO: 185764 - DNA, 630 bp, Homo sapiens
  misc_feature: GYAE6OF01A426M.30.68.G02.1.454.CMB.1.raw
  modified_base (544)..(544): a, c, t, g, unknown or other
  misc_feature (544)..(544): n is a, c, g, or t
  modified_base (551)..(551): a, c, t, g, unknown or other
  misc_feature (551)..(551): n is a, c, g, or t
  modified_base (623)..(623): a, c, t, g, unknown or other
  misc_feature (623)..(623): n is a, c, g, or t
tcagcacgctacgtcacgaccggtgctcgatttagtcgatagtgaagggaaaggggctggaatgggtctcaagtattgctcggtagtggtgataagcacataactacgcagccatcgtcgaacgggccggttcgaccgatctccacgggacagttcggaagaacacactgttctgcaaatgaacagcctgagagtcgaggactacggccgtagtacttactcgtcgccgctttcaccctggacgtcgggagttacgaaggccatacttccacgtacgtcgggccgggcaccgtggtcgagccgtctccgtcgacgcctaccgaccgaacgggccagttccggtccttaccccgtggcctaccctccgtaccaacggacggccaccgtcgtcggggaccaaccgcgcgacgcccgtacgggctcgccgtggtacgtaacggtactaccgttccgacgtacggaccgtacgtaccgtaggtccgaccggggtcgtacgggacgaacgggtccgacgtaacgtacgacgcgtacgagacgcgacgtntactcgngtcgagacgacgcgtcgtacgtacgtacgagtacgtacgtactacgtcgtacgtacgacgtcgtacgcgcgngacgtcg

SEQ ID NO: 185765 - DNA, 530 bp, Homo sapiens
  misc_feature: GYAE6OF01EDJ2D.30.68.G02.1.454.CMB.1.raw
  modified_base (492)..(493): a, c, t, g, unknown or other
  misc_feature (492)..(493): n is a, c, g, or t
  modified_base (496)..(514): a, c, t, g, unknown or other
  misc_feature (496)..(514): n is a, c, g, or t
  modified_base (516)..(527): a, c, t, g, unknown or other
  misc_feature (516)..(527): n is a, c, g, or t
  modified_base (529)..(530): a, c, t, g, unknown or other
  misc_feature (529)..(530): n is a, c, g, or t
tcagcacgctacgtcacgaccggtgctcgatttagtcgatagtgaagggaaagggggctgggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggattacaaggcatacttccacacgtggggccgggcaccgtggtcagcgtctcctcacgcctcccgaaccgaacggggccccacgtccgggtccttccccccgtggccctacccctcctaccaagtacgcctaacctcgtacggggcacgagccgacgcccgtgggctcgtccgtggtacaacggtacctacgttccgacgtagtccgtgcctagacgggccggggtactcgggacaacgggccgactaacgtacggtnncgnnnnnnnnnnnnnnnnnnngnnnnnnnnnnnngnn

SEQ ID NO: 185766 - DNA, 453 bp, Homo sapiens
  misc_feature: GYAE6OF01CRIIM.30.68.G02.1.454.CMB.1.raw
  modified_base (445)..(453): a, c, t, g, unknown or other
  misc_feature (445)..(453): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggctatacttccaccacgtggggccggggcaccctggtcagcgtctcctcagcctccaccaacgggcccatccggtccttcccccctggccaccctcctccaaacgacgccaccgtcgtgggggccacgacgcagcccgtgggctcgccgtggtcaaggactacctcacgtagcgtgcctgagcgggctggcgaaggcacatgnnnnnnnnn

SEQ ID NO: 185767 - DNA, 588 bp, Homo sapiens
  misc_feature: GYAE6OF01CQWQI.30.68.G02.1.454.CMB.1.raw
  modified_base (210)..(210): a, c, t, g, unknown or other
  misc_feature (210)..(210): n is a, c, g, or t
  modified_base (551)..(551): a, c, t, g, unknown or other
  misc_feature (551)..(551): n is a, c, g, or t
  modified_base (553)..(555): a, c, t, g, unknown or other
  misc_feature (553)..(555): n is a, c, g, or t
  modified_base (557)..(557): a, c, t, g, unknown or other
  misc_feature (557)..(557): n is a, c, g, or t
  modified_base (559)..(564): a, c, t, g, unknown or other
  misc_feature (559)..(564): n is a, c, g, or t
  modified_base (566)..(573): a, c, t, g, unknown or other
  misc_feature (566)..(573): n is a, c, g, or t
  modified_base (575)..(588): a, c, t, g, unknown or other
  misc_feature (575)..(588): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattacngtgcgctttcaccctggagtgggagttacaaggcatacttccaccacgtcggggccgggcacccgtggtcagtccgtctcctcacgcctccaaccgaacggggcccctagttcccgggtcccttcccccgtcgggccctaccctccctaccgaaagacgcctaacccgtcggtcggggccacgacgaccgacgtccccgtagggcctggcccgttgggtaccaaagggtacccttaaccgtttacccgaaccggttacggccggttacggccgttagggaaccgggccggggtcccgttagggaaccggtaaagggcccggactaaacggttaggcacgtngnnngngnnnnnngnnnnnnnngnnnnnnnnnnnnnn

SEQ ID NO: 185768 - DNA, 489 bp, Homo sapiens
  misc_feature: GYAE6OF01EPG2V.30.68.G02.1.454.CMB.1.raw
  modified_base (450)..(450): a, c, t, g, unknown or other
  misc_feature (450)..(450): n is a, c, g, or t
  modified_base (457)..(457): a, c, t, g, unknown or other
  misc_feature (457)..(457): n is a, c, g, or t
  modified_base (459)..(459): a, c, t, g, unknown or other
  misc_feature (459)..(459): n is a, c, g, or t
  modified_base (462)..(462): a, c, t, g, unknown or other
  misc_feature (462)..(462): n is a, c, g, or t
  modified_base (464)..(489): a, c, t, g, unknown or other
  misc_feature (464)..(489): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatactccaccacgtggggccgggcaccctggcagcgtctcctcagcctccaccaagggcccatccggtccttcccccgtggccacccctcctccaacgtacgccacctcgtggggcacgagcacggccctgggctcggccgtggtaccaaacggtctaccttccacgtacgcggtcgcgtgacggtccggggctgggcgaagggcncataggntngcngnnnnnnnnnnnnnnnnnnnnnnnnnn

SEQ ID NO: 185769 - DNA, 466 bp, Homo sapiens
  misc_feature: GYAE6OF01BPVPS.30.68.G02.1.454.CMB.1.raw
  modified_base (455)..(466): a, c, t, g, unknown or other
  misc_feature (455)..(466): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccggggcaccctggtcagcgtctcctcacgcctcccaccaacgggcccatccggtccttccccccgtggccaccccgttccctccaagacgccacctcgtgggggccacagcacgccctggggctcgcctggtccgaaggacctacttcccgacgtagcgtgctggagccggggctggcgaaggcgcatagnnnnnnnnnnnn

SEQ ID NO: 185770 - DNA, 444 bp, Homo sapiens
  misc_feature: GYAE6OF01DP4HG.30.68.G02.1.454.CMB.1.raw
  modified_base (317)..(317): a, c, t, g, unknown or other
  misc_feature (317)..(317): n is a, c, g, or t
  modified_base (416)..(416): a, c, t, g, unknown or other
  misc_feature (416)..(416): n is a, c, g, or t
  modified_base (423)..(444): a, c, t, g, unknown or other
  misc_feature (423)..(444): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccgggcacccgtggtcagcgtctcctcagcctccaccaaggccatcgtctccccngcaccctctccaagagcacctcgtggggcacagcagcccgtgggctgccgtggtcaaggactacttcacgtagcgtgctgagcgggctggacaagggcncatacgnnnnnnnnnnnnnnnnnnnnnn

SEQ ID NO: 185771 - DNA, 475 bp, Homo sapiens
  misc_feature: GYAE6OF01APHY4.30.68.G02.1.454.CMB.1.raw
  modified_base (450)..(475): a, c, t, g, unknown or other
  misc_feature (450)..(475): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccggggcacccgtggtcagcgtctcctcacgcctccaccgaagggccccagtccggtccttcccccgtggccaccctcctccaacgcgccacctcgtcggggcacgacacgccctcggctcgcctggtcaaggacctacctccacgtacgcgtgcgtgacgcgggctggacgaaggcgacagtacgnnnnnnnnnnnnnnnnnnnnnnnnnn

SEQ ID NO: 185772 - DNA, 453 bp, Homo sapiens
  misc_feature: GYAE6OF01ATM4P.30.68.G02.1.454.CMB.1.raw
  modified_base (330)..(330): a, c, t, g, unknown or other
  misc_feature (330)..(330): n is a, c, g, or t
  modified_base (438)..(438): a, c, t, g, unknown or other
  misc_feature (438)..(438): n is a, c, g, or t
  modified_base (444)..(453): a, c, t, g, unknown or other
  misc_feature (444)..(453): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatatactgtgcgctttcaccctggagtggagttacaggcatacttccaccacgtggggccggggcaccctggtccagcgtctcctcagcctccacccaaggggcccatccggtccttccccctggccncccctcctccaagagccacctctcgggggcacagcagccctgggctcgcctggtacaacggtactaccttccgacgtagcgtgctggagcgggctcggcgaaggccgnatacgnnnnnnnnnn

SEQ ID NO: 185773 - DNA, 496 bp, Homo sapiens
  misc_feature: GYAE6OF01DR352.30.68.G02.1.454.CMB.1.raw
  modified_base (466)..(466): a, c, t, g, unknown or other
  misc_feature (466)..(466): n is a, c, g, or t
  modified_base (473)..(475): a, c, t, g, unknown or other
  misc_feature (473)..(475): n is a, c, g, or t
  modified_base (477)..(496): a, c, t, g, unknown or other
  misc_feature (477)..(496): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgtctttcacccgtggagtgggagttacaaggcataccttccaccacgtggggccgggcacccgtggtcagcgtctcctcacgcctccaccgaacggcccagtccgtccttccccgtcggaccaccctcctaccagacgccacctcggtcggggccacgcgccacgcccgtgggctcggcctcggtacaacggaccttacttccgacgtacgcgtcgcgtggacggtccgggcgtgggacgaacgggtccganagtagcnnncnnnnnnnnnnnnnnnnnnnn

SEQ ID NO: 185774 - DNA, 581 bp, Homo sapiens
  misc_feature: GYAE6OF01D1094.30.68.G02.1.454.CMB.1.raw
  modified_base (550)..(551): a, c, t, g, unknown or other
  misc_feature (550)..(551): n is a, c, g, or t
  modified_base (553)..(567): a, c, t, g, unknown or other
  misc_feature (553)..(567): n is a, c, g, or t
  modified_base (569)..(581): a, c, t, g, unknown or other
  misc_feature (569)..(581): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgcttttcaccctggagtgggagttacaaggcatacttccaccacgtcggggccgggcacccgtggtcagcgtctcctcacgccctccaccgaacggccccagttccggtccctttcccccgtcgaccctacccctccctaccgaaacgacgacctacccgtcgtcgggggccacgacgccacggccccgtagggcctcggccgtacgggtaccgaaacgggtaccttaccgttacccgtaacggttacggtccggttcggccgttagggaccggggtccgggggtaccggtacgggaccggtaaacgggcccggacgtaaggttaagcgcgagcgnncnnnnnnnnnnnnnnngnnnnnnnnnnnnn

SEQ ID NO: 185775 - DNA, 586 bp, Homo sapiens
  misc_feature: GYAE6OF01CUY9O.30.68.G02.1.454.CMB.1.raw
  modified_base (543)..(543): a, c, t, g, unknown or other
  misc_feature (543)..(543): n is a, c, g, or t
  modified_base (545)..(545): a, c, t, g, unknown or other
  misc_feature (545)..(545): n is a, c, g, or t
  modified_base (549)..(549): a, c, t, g, unknown or other
  misc_feature (549)..(549): n is a, c, g, or t
  modified_base (553)..(553): a, c, t, g, unknown or other
  misc_feature (553)..(553): n is a, c, g, or t
  modified_base (555)..(555): a, c, t, g, unknown or other
  misc_feature (555)..(555): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (562)..(566): a, c, t, g, unknown or other
  misc_feature (562)..(566): n is a, c, g, or t
  modified_base (568)..(579): a, c, t, g, unknown or other
  misc_feature (568)..(579): n is a, c, g, or t
  modified_base (581)..(586): a, c, t, g, unknown or other
  misc_feature (581)..(586): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgttttctgcaaatgaacagcctgagagtcgaggacacggccgtatattactgtgcgctttcaccctggagtgggagttacaaggcatactccaccacgtggggccgggcaccctggtcagcgtctcctcacgcctccaccaacgggcccatccggtccttccccctggccaccctccctaccaacgacgccaccgtcgtcgggggaccacgacgccgacggcccgtcggggcctcggcccgttcgggtaccgaaaacgggtaaccttaacccgtttacccgaaccggttacggtccggttacgtccggtacgggtaacgggccggggtaccggttacggggaccggtaaaacgggggcccggaccgtaaggttaacggcgagngngcgngcgngnagngngnnnnngnnnnnnnnnnnncnnnnnn

SEQ ID NO: 185776 - DNA, 481 bp, Homo sapiens
  misc_feature: GYAE6OF01BQ22B.30.68.G02.1.454.CMB.1.raw
  modified_base (246)..(246): a, c, t, g, unknown or other
  misc_feature (246)..(246): n is a, c, g, or t
  modified_base (438)..(438): a, c, t, g, unknown or other
  misc_feature (438)..(438): n is a, c, g, or t
  modified_base (442)..(447): a, c, t, g, unknown or other
  misc_feature (442)..(447): n is a, c, g, or t
  modified_base (449)..(481): a, c, t, g, unknown or other
  misc_feature (449)..(481): n is a, c, g, or t
tcagcacgctacgtcacgaccggtgctcgattttagtcgatagtgaagggaaaggggtcggagacgtgttacgcgagtccaacttagccttggtaccagcagaaacatggccaggctcccaggcctcctcatctactgatgtcgtccaccagggtcacgttggtatcccagcctaaggttcagcggcagtggggtctgggacagagttcgagtcgtcacctatcagcaggccctgcagtctgaagnttttgctagttttatattgtcagtcactataacaattggcctcggaaacttttggccgaggggacccaagcttcgaggagtcgaaacgtaactggtggctaggactaacctatctgtcgttcatccttcccgcatccgtgaaccgtagcggtagcctgacgcgggtctaggccaagggccgacaactagacnacgnnnnnnannnnnnnnnnnnnnnnnnnnnnnnnnnnnnnnn

SEQ ID NO: 185777 - DNA, 463 bp, Homo sapiens
  misc_feature: GYAE6OF01AV1Q0.30.68.G02.1.454.CMB.1.raw
  modified_base (445)..(463): a, c, t, g, unknown or other
  misc_feature (445)..(463): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccagttcaccatctccagggacagttcgaagaacacactgtttctgcaaatgaacagcctgagagtcgaggacacggccgtatattactgtgcgctttcaccctggagtgggagttacaaggcatacttccaccactggggccgggcaccctggtcagcgtctcctcacgcctccaccaacgggcccatccggtccttccccctggccacccctcctccaacgacgccacctcgtcgggggccacgacgcacgcccgtgggcctgcctggtcaacggactacttccacgtagcgtgcgtgacggcggctggacaggcgcagtgnnnnnnnnnnnnnnnnnnn

SEQ ID NO: 185778 - DNA, 471 bp, Homo sapiens
  misc_feature: GYAE6OF01C7BHC.30.68.G02.1.454.CMB.1.raw
  modified_base (355)..(355): a, c, t, g, unknown or other
  misc_feature (355)..(355): n is a, c, g, or t
  modified_base (443)..(443): a, c, t, g, unknown or other
  misc_feature (443)..(443): n is a, c, g, or t
  modified_base (451)..(471): a, c, t, g, unknown or other
  misc_feature (451)..(471): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcacctggagtggagttacaggcatactcaccagtgggccgggcaccgtggtcagcgtctcctcagcctccaccgaacgggcccagtccggtccttcccccgtggcctacccgtcctaccaacgacgccaccgtcgnggggcacgagcacgcccgtggcctgcctggacaacggtacctaccttaccgacgtacgcgtgctggacggcgggtcgtggacgaggcncagtacgnnnnnnnnnnnnnnnnnnnnn

SEQ ID NO: 185779 - DNA, 514 bp, Homo sapiens
  misc_feature: GYAE6OF01C35B2.30.68.G02.1.454.CMB.1.raw
  modified_base (494)..(514): a, c, t, g, unknown or other
  misc_feature (494)..(514): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgtctttccaccctggagtgggagttacaaggcataccttccaccacgtggggccgggcacccgtggtcacgcgtctcctcacgccctccaaccgacgggcccagtccggtccttccccctggccaccctcctaccgacgacgcaccgtcgtggggccacgagccacgcccgtgggctcggccgtaggtaccaaacggtccttaccttaccgacggttacggccgttaggccgttagggacgggccggggccgtcgggaccgaaggggccgactagtacgnnnnnnnnnnnnnnnnnnnnn

SEQ ID NO: 185780 - DNA, 569 bp, Homo sapiens
  misc_feature: GYAE6OF01AEDBH.30.68.G02.1.454.CMB.1.raw
  modified_base (532)..(532): a, c, t, g, unknown or other
  misc_feature (532)..(532): n is a, c, g, or t
  modified_base (535)..(536): a, c, t, g, unknown or other
  misc_feature (535)..(536): n is a, c, g, or t
  modified_base (538)..(569): a, c, t, g, unknown or other
  misc_feature (538)..(569): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtcggggcccgggcacccgtggtcagccgtctcctcacgccctcccaccgaacgggccccacgtccggttcccttccccccgtcggaccctaccccctcctacccgaacgacgcccacccgttcggtcgggggccacgacgcgacgcccgtgggcctcggaccgttagggtaaaacggtacctaccgttaccgaccggtacggtccggttggccggttacgggacggggtccgggggtcgtacggggaccgaacggggccgtaacgtagtacggncgnngnnnnnnnnnnnnnnnnnnnnnnnnnnnnnnnn

SEQ ID NO: 185781 - DNA, 493 bp, Homo sapiens
  misc_feature: GYAE6OF01E312I.30.68.G02.1.454.CMB.1.raw
  modified_base (370)..(370): a, c, t, g, unknown or other
  misc_feature (370)..(370): n is a, c, g, or t
  modified_base (465)..(493): a, c, t, g, unknown or other
  misc_feature (465)..(493): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatactccaccactggggccgggcacccgtggtcagcgtctcctcacgcctccaccgaagggccccagtccggtccttcccccgtggcccaccctccctaccaagcgccaccgtcgtcggggccacngcacgccgtgggctcgcctggacaaggtctacttccgacgtagccgtgtcgtcggacggcgggcgttacgggacgaacgggccgacgtagtagcnnnnnnnnnnnnnnnnnnnnnnnnnnnnn

SEQ ID NO: 185782 - DNA, 529 bp, Homo sapiens
  misc_feature: GYAE6OF01CXYD9.30.68.G02.1.454.CMB.1.raw
  modified_base (508)..(529): a, c, t, g, unknown or other
  misc_feature (508)..(529): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagtccgaagaacacactgtttctgcaaatgaacagcctgagagtcgaggacacggccgtatattactgtgcgctttcaccctggagtgggagttacaaggcatacttccaccacgtggggcccggggcacccgtggtcagcgtctcctcagcctccaccaacgggccccatccggtccttcccccctggcccacccctccctcccaacgacgccacccgtcggtcggggccacgagccgacgccccgtggggcctcggcccgttcgggtcgaaacgggtacccttaaccgtttcccaacgggttacgaccggttcgccgttgggacggccggggaccgtgggacgaaacgggccgacgatacggnnnnnnnnnnnnnnnnnnnnnn

SEQ ID NO: 185783 - DNA, 629 bp, Homo sapiens
  misc_feature: GYAE6OF01C40T1.30.68.G02.1.454.CMB.1.raw
  modified_base (162)..(162): a, c, t, g, unknown or other
  misc_feature (162)..(162): n is a, c, g, or t
  modified_base (541)..(541): a, c, t, g, unknown or other
  misc_feature (541)..(541): n is a, c, g, or t
  modified_base (551)..(551): a, c, t, g, unknown or other
  misc_feature (551)..(551): n is a, c, g, or t
  modified_base (611)..(611): a, c, t, g, unknown or other
  misc_feature (611)..(611): n is a, c, g, or t
  modified_base (621)..(621): a, c, t, g, unknown or other
  misc_feature (621)..(621): n is a, c, g, or t
  modified_base (625)..(625): a, c, t, g, unknown or other
  misc_feature (625)..(625): n is a, c, g, or t
tcagcacgctacgtcacgaccggtgctcgatttagtcgatagtgaagggaaggggctggaatgggtctcaagtattgctggtagtggtgatagcacatactacgcagccatcgtgaaggccgtcaccatctcagggacagttcgaagaacacactgtttacngacaaatgaacagcctgagagtcgaaggacacggtccgtaatattactgtgcgtctttcaccgtggaagtgggagttaacgaaggtcaatacgttccaccgaacgtgggggccgggactaccgtggtctagcgtctccgtacacgcctaccgacgaaacgggcccaaatccggtaccttccccgcggacacccttccctacgaaagacggacctaccgtacggtaggggccaacgtaaccgacgaaccggtccccgtaggggactcgaccggtcggttaacgaaacggtccgtaaacgttcccgaacggtacggtcgtacggtccgtagaacggtcgggccggtaggacgaaacggtcgtaacctgtaacgcgaatcgngataccgtancgtcgtatagctagatacgtacgtacgtacgtacgtacgagacgtacgagacgacgacgngtcgtcacanctgngacg

SEQ ID NO: 185784 - DNA, 569 bp, Homo sapiens
  misc_feature: GYAE6OF01D9HM9.30.68.G02.1.454.CMB.1.raw
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (540)..(569): a, c, t, g, unknown or other
  misc_feature (540)..(569): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgtctttcaccctggagtgggagttacaggcatacttccaccacgtcgggggccgggcaccctggtcaggcgtctcctcacgccctccaacccgaacgggcccctacgtccgggttcccttcccccccgtcgggccctacccccttccctacccgaaacgacgacctacccgtccggtcgggggaccaccgagcgacggcccgtgggcctcggcccgttggtaccgaacgggtaccttaccgttacccgacgttacggccgttacggccgttaggacgggccggggtcgtacgggaccgaacgggccgacgtaagtacggcngngcnnnnnnnnnnnnnnnnnnnnnnnnnnnnnn

SEQ ID NO: 185785 - DNA, 455 bp, Homo sapiens
  misc_feature: GYAE6OF01BDLW9.30.68.G02.1.454.CMB.1.raw
  modified_base (342)..(342): a, c, t, g, unknown or other
  misc_feature (342)..(342): n is a, c, g, or t
  modified_base (433)..(433): a, c, t, g, unknown or other
  misc_feature (433)..(433): n is a, c, g, or t
  modified_base (435)..(455): a, c, t, g, unknown or other
  misc_feature (435)..(455): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccggggcaccctggtcagcgtctcctcagcctccaccaagggcccatcggtcttccccctggccaccctcctccaagancacctctgggggccacagcacgccctgggctcgcctggcaaggctacttccacgtacgcgtgctgagcgggctggacaacggcgcatacgngnnnnnnnnnnnnnnnnnnnnn

SEQ ID NO: 185786 - DNA, 523 bp, Homo sapiens
  misc_feature: GYAE6OF01B9HOW.30.68.G02.1.454.CMB.1.raw
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
  modified_base (496)..(523): a, c, t, g, unknown or other
  misc_feature (496)..(523): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgtctttcaccctggagtgggatacaaggcatactcaccacgtcggggccgggcaccgtggtcagcgtctcctcacgcctccaccgaacggcccagtccgtcccttccccgtcgccacccctcctaccaacgacgctaccctcggtcgggggaccacgacgccacggaccccgtgggtcctcggtccgtgggacctaaacgggtaccttaaccgtttcccgaacggttacgccgtgacgtggacggtcggggctgggacgaacgggcgtacgaagtagngngnnnnnnnnnnnnnnnnnnnnnnnnnnnn

SEQ ID NO: 185787 - DNA, 560 bp, Homo sapiens
  misc_feature: GYAE6OF01BQF8A.30.68.G02.1.454.CMB.1.raw
  modified_base (525)..(525): a, c, t, g, unknown or other
  misc_feature (525)..(525): n is a, c, g, or t
  modified_base (529)..(532): a, c, t, g, unknown or other
  misc_feature (529)..(532): n is a, c, g, or t
  modified_base (534)..(560): a, c, t, g, unknown or other
  misc_feature (534)..(560): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggcgtatattactgtgcgctttcacccgtggagtgggagttacaaggcatacttccaccacgtcggggccgggcaccgtggtcagcgtctcctcacgcctccaccgaacggcccacgtccggtcccttcccccgtcggccctacccctcctacccaacgacgccaccgtcggtcgggggaccacgacgccgacgccccgtagggcctcggcccgttagggtaccgaaacggtaccttaacccgtttcccgaaccggtacggtacggtcggtacgtacggacgggtccggggtacgtacggggacgtaaacgggccgacgacgtaagcgnacgnnnncnnnnnnnnnnnnnnnnnnnnnnnnnnn

SEQ ID NO: 185788 - DNA, 383 bp, Homo sapiens
  misc_feature: GYAE6OF01A4TT2.30.68.G02.1.454.CMB.1.raw
  modified_base (326)..(326): a, c, t, g, unknown or other
  misc_feature (326)..(326): n is a, c, g, or t
  modified_base (334)..(334): a, c, t, g, unknown or other
  misc_feature (334)..(334): n is a, c, g, or t
  modified_base (337)..(337): a, c, t, g, unknown or other
  misc_feature (337)..(337): n is a, c, g, or t
  modified_base (340)..(340): a, c, t, g, unknown or other
  misc_feature (340)..(340): n is a, c, g, or t
  modified_base (363)..(363): a, c, t, g, unknown or other
  misc_feature (363)..(363): n is a, c, g, or t
  modified_base (379)..(383): a, c, t, g, unknown or other
  misc_feature (379)..(383): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagtattttgctagtttattattgtcagcactataacaattggcctacggtaactttggccgagggaccagcttgagatcaaacgactgtggctgcacatctgtctcnctctcccnctntcngtacgtgcgtgctggagcgggcnggacgaggcgcatagnnnnn

SEQ ID NO: 185789 - DNA, 518 bp, Homo sapiens
  misc_feature: GYAE6OF01C3J9S.30.68.G02.1.454.CMB.1.raw
  modified_base (490)..(518): a, c, t, g, unknown or other
  misc_feature (490)..(518): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtggggattacaaggcatacttccaccacgtggggccgggcacccgtggtcagccgtctcctcagccctccaccgaacgggcccagtccggtccttcccccgtggcccaccctccctaccaacgacgccaaccgtcgtgggggaccacgacggcacggcccgtggggcctcgcccgtgggtccgaaagggacctaccttccgacggtagccgtgccgtggacggcggggcttcgggacgaaacgggccggactaagtaggcnnnnnnnnnnnnnnnnnnnnnnnnnnnnn

SEQ ID NO: 185790 - DNA, 512 bp, Homo sapiens
  misc_feature: GYAE6OF01ACPCT.30.68.G02.1.454.CMB.1.raw
  modified_base (487)..(487): a, c, t, g, unknown or other
  misc_feature (487)..(487): n is a, c, g, or t
  modified_base (490)..(512): a, c, t, g, unknown or other
  misc_feature (490)..(512): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccggggcacccgtggtcagccgtctcctcagccctccaccgaacgggcccatccggtccttcccccgtggcccacccctccctcccaacgacgccacctcgtcgggggccacacgcacggccccgtgggccgtcgccgtcgggtacaagggtaccttaccgttcccacggttacgcggtggcttggcggccggggtcgtcgggacgaagggccgcgaagtacgncgnnnnnnnnnnnnnnnnnnnnnnn

SEQ ID NO: 185791 - DNA, 456 bp, Homo sapiens
  misc_feature: GYAE6OF01B1HOZ.30.68.G02.1.454.CMB.1.raw
  modified_base (440)..(456): a, c, t, g, unknown or other
  misc_feature (440)..(456): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccggggcaccctggtcagcgtctcctcagcctccaccaagggcccatccggtccttccccctggccaccctcctcccaagacgcacctctgggggccacgacgcagcccgtgggctggcctggtacaggactacttccacgtagcgtgctgacgcgggctggcaaggcgcgatagcnnnnnnnnnnnnnnnnn

SEQ ID NO: 185792 - DNA, 444 bp, Homo sapiens
  misc_feature: GYAE6OF01A4D0J.30.68.G02.1.454.CMB.1.raw
  modified_base (406)..(406): a, c, t, g, unknown or other
  misc_feature (406)..(406): n is a, c, g, or t
  modified_base (428)..(428): a, c, t, g, unknown or other
  misc_feature (428)..(428): n is a, c, g, or t
  modified_base (432)..(444): a, c, t, g, unknown or other
  misc_feature (432)..(444): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcacccctcctccaacgacgcacctcgtgggggcacacgcacgccctgggctgccgtggtcaggactacttccacgtagcgtnctgagcgggctggcgaaggcgnatgnnnnnnnnnnnnn

SEQ ID NO: 185793 - DNA, 523 bp, Homo sapiens
  misc_feature: GYAE6OF01AWD4Q.30.68.G02.1.454.CMB.1.raw
  modified_base (495)..(496): a, c, t, g, unknown or other
  misc_feature (495)..(496): n is a, c, g, or t
  modified_base (499)..(523): a, c, t, g, unknown or other
  misc_feature (499)..(523): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatactccaccacgtggggccgggcaccgtggtcagcgtctcctcacgcctccaccgaacgggcccacgttccggtccttcccccgtcggccacccctcctaccgaacgacgccaccgtcggtcgggggccacgacgccacggcccgtgggctcggccgtggtaccgaacggtaccttaccttcccgacgtacggtcggtacgcgttaggacgggtccggggtcgtcgggacgaacggcggacaacgtagcnngcnnnnnnnnnnnnnnnnnnnnnnnnn

SEQ ID NO: 185794 - DNA, 433 bp, Homo sapiens
  misc_feature: GYAE6OF01CWEFW.30.68.G02.1.454.CMB.1.raw
  modified_base (284)..(284): a, c, t, g, unknown or other
  misc_feature (284)..(284): n is a, c, g, or t
  modified_base (396)..(396): a, c, t, g, unknown or other
  misc_feature (396)..(396): n is a, c, g, or t
  modified_base (423)..(433): a, c, t, g, unknown or other
  misc_feature (423)..(433): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatactccacactgggccgggcaccgtgtcagcgtctcctnacgcctccaaccaaggccatccgtccttccctgcaccctcctcaagagcacctcgtggggcacgacgcagcccgtgggctcgcgtgtacaaggactacttcacgtagcgtgngtgagcggtctggacaggcacagtagnnnnnnnnnnn

SEQ ID NO: 185795 - DNA, 446 bp, Homo sapiens
  misc_feature: GYAE6OF01AT95W.30.68.G02.1.454.CMB.1.raw
  modified_base (437)..(446): a, c, t, g, unknown or other
  misc_feature (437)..(446): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccaggggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcacgcctccaccaagggcccatcggtccttcccctggccaccctcctccaagacgccacctcgtggggcacagcacgcccgtgggctcgcctgggtccaaggacctactccacgtagcgtgctgaggcgggctggcaaggcgcatagnnnnnnnnnn

SEQ ID NO: 185796 - DNA, 431 bp, Homo sapiens
  misc_feature: GYAE6OF01CMRPT.30.68.G02.1.454.CMB.1.raw
  modified_base (326)..(326): a, c, t, g, unknown or other
  misc_feature (326)..(326): n is a, c, g, or t
  modified_base (423)..(431): a, c, t, g, unknown or other
  misc_feature (423)..(431): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatatactgtgcgctttcaccctggagtgggagttacaaggcatacttccaccactggggccggggcacccgtggtcagcgtctcctcagcctcaccaagggccatcggtctcccctggcacccncctcaagagcacctctggggcacgacgcacgccctgggctgcctggtcaaggactacttccacgtagcgtgctgagcgggctggcaaggcgcatagnnnnnnnnn

SEQ ID NO: 185797 - DNA, 482 bp, Homo sapiens
  misc_feature: GYAE6OF01DAZJY.30.68.G02.1.454.CMB.1.raw
  modified_base (443)..(443): a, c, t, g, unknown or other
  misc_feature (443)..(443): n is a, c, g, or t
  modified_base (471)..(471): a, c, t, g, unknown or other
  misc_feature (471)..(471): n is a, c, g, or t
  modified_base (473)..(482): a, c, t, g, unknown or other
  misc_feature (473)..(482): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaaacagcctgagagtcgagacacggccgtatattactgtgcgtctttcacccgtggagtgggagttacgaaggctataccttccaaccgacgtcgggggcccgggcacccgtggtcagccgtactccgtcacgccctaccgaacccgaacgggccctagtccggttaccctccccgtggcccaccctcctaccaaagtcgaccaccgttcggcggggaccacgagcacgcccgtggctcgctggacacggacttaccgtcacgtagcgtnctaggaggcggcgtggacagggcacgangnnnnnnnnnn

SEQ ID NO: 185798 - DNA, 542 bp, Homo sapiens
  misc_feature: GYAE6OF01BDUBW.30.68.G02.1.454.CMB.1.raw
  modified_base (508)..(509): a, c, t, g, unknown or other
  misc_feature (508)..(509): n is a, c, g, or t
  modified_base (511)..(518): a, c, t, g, unknown or other
  misc_feature (511)..(518): n is a, c, g, or t
  modified_base (520)..(542): a, c, t, g, unknown or other
  misc_feature (520)..(542): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccgggcaccgtggtcagcgtctcctcacgcctccaccgaacgggcccagtccggtccttcccccgtggccaccctcctccaacgacgccaccgtcgtcgggggaccacgacgcgacgcccgtgggcctcggccgtggtaccgaaacggtaccttacccgttcccgtaacggtacggtccggtgtccgtcgggaacggccggggtcgtacggggaccgaaacggggccgacgaacgtaggacgcgnngnnnnnnnncnnnnnnnnnnnnnnnnnnnnnnn

SEQ ID NO: 185799 - DNA, 578 bp, Homo sapiens
  misc_feature: GYAE6OF01DGZ5B.30.68.G02.1.454.CMB.1.raw
  modified_base (544)..(544): a, c, t, g, unknown or other
  misc_feature (544)..(544): n is a, c, g, or t
  modified_base (546)..(578): a, c, t, g, unknown or other
  misc_feature (546)..(578): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatccccagccaggttcagcggcaggtgggtctgggacagagttcagtctcaccatcagcagcctgcagtctagaagtatttttgcttagttttattattgtcagtctaactaataaactaatttcggtaccttacccgggtaaacgtttttcgggacccggaagggggtacccctaaaggtcctttaggaacgtaactaccgaaaacggtaaccgttggttcggccttacggcctaaccgtacttaccgtttcgttcctttaccgtaactttcccccgtttcccccggtaccctacgtttaccgttacggtaaaaccggttcggttcggtcggtaccgtcggggtaacgggtcggggtccgttggggacccgtaaacgggccggacaacggtaggngnnnnnnnnnnnnnnnnnnnnnnnnnnnnnnnnn

SEQ ID NO: 185800 - DNA, 536 bp, Homo sapiens
  misc_feature: GYAE6OF01D71L8.30.68.G02.1.454.CMB.1.raw
  modified_base (334)..(334): a, c, t, g, unknown or other
  misc_feature (334)..(334): n is a, c, g, or t
  modified_base (512)..(536): a, c, t, g, unknown or other
  misc_feature (512)..(536): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgcttttcaccctggagtgggagttacgaaggcatacttcccaccacgtggggccgggcacctggtcagcgtctcctcagcctccaccaacgggcccatccggtccttcccccgtcggccncccctcctccaacgacgcacctcgtcgggggcacgagccgacgtcccgtggggcctcggtcccgtcgggtacgaaacggtacccttacctttcccgaaccggttacggccggttacggtccttacgggacgggccgggggtccgtacgggaccggtaaagggccggaccgaatacggnnnnnnnnnnnnnnnnnnnnnnnnn

SEQ ID NO: 185801 - DNA, 434 bp, Homo sapiens
  misc_feature: GYAE6OF01DZE2L.30.68.G02.1.454.CMB.1.raw
  modified_base (425)..(434): a, c, t, g, unknown or other
  misc_feature (425)..(434): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagacgcacctctggggcacagcagccctgggctgcctggtcaaggactacttccacgtagcgtgctgagcgggctggcaaggcgcatgnnnnnnnnnn

SEQ ID NO: 185802 - DNA, 557 bp, Homo sapiens
  misc_feature: GYAE6OF01B08OJ.30.68.G02.1.454.CMB.1.raw
  modified_base (382)..(382): a, c, t, g, unknown or other
  misc_feature (382)..(382): n is a, c, g, or t
  modified_base (525)..(557): a, c, t, g, unknown or other
  misc_feature (525)..(557): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccgttcaccatctcaggacagttcgaagaacacactgttctgacaaatgaacagcctgagagtcgaggacacggtcgtatattacgtgtcgcgtctttccaccgtgggagtagggtacttaacgaacggtctaacttaccttccgaaccgtacggtcgggggcccgggcctacccgtggtacacggtccgtcctccgtcacgtccctaccgaccgaacggcccacgttccgtcctccccgtcgccaccctcctacaacgcnccgtaccgtcgtcggggaccacgacgaccgtacgcccgtgggcctacgccgtacggacaaacggtaccttaccgtaccgacggtacgtccgtagtcgtaggacgggcgggtacgtacggacgtaacggcgtacgacgtagcgnnnnnnnnnnnnnnnnnnnnnnnnnnnnnnnnn

SEQ ID NO: 185803 - DNA, 517 bp, Homo sapiens
  misc_feature: GYAE6OF01DED2N.30.68.G02.1.454.CMB.1.raw
  modified_base (304)..(304): a, c, t, g, unknown or other
  misc_feature (304)..(304): n is a, c, g, or t
  modified_base (467)..(467): a, c, t, g, unknown or other
  misc_feature (467)..(467): n is a, c, g, or t
  modified_base (486)..(486): a, c, t, g, unknown or other
  misc_feature (486)..(486): n is a, c, g, or t
  modified_base (492)..(492): a, c, t, g, unknown or other
  misc_feature (492)..(492): n is a, c, g, or t
  modified_base (494)..(517): a, c, t, g, unknown or other
  misc_feature (494)..(517): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgtctttccacccgtgggagtggagttacaaggcattacttccaccgacgtcggggcccgggccacccgtggtccagtcgtcctcctcacnccctcccgaaccgacgggccctacgttccggtcccttcccccgtggccctaccccttccctaccaacgacgcccaccgtcggtcggggccacgacgcgacgcccgtggctcggccgtagtccaaggtacctacttccgacgtcgtcgtcgcgtcggcggcggntacgggcgaacggccgacngtagcngnnnnnnnnnnnnnnnnnnnnnnnn

SEQ ID NO: 185804 - DNA, 436 bp, Homo sapiens
  misc_feature: GYAE6OF01C6TOY.30.68.G02.1.454.CMB.1.raw
  modified_base (427)..(436): a, c, t, g, unknown or other
  misc_feature (427)..(436): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggattacaaggcatacttccaccactgggcgggcaccctggtcagcgtctcctcagcctccaccaagggccccatccggtcttccccctcggcaccctcctccaacgagcacctctgggggcacgagcagccctgggctgcctggtcaggactacttccacgtagcgtgctgagcgggctggcaaggcgcagtagnnnnnnnnnn

SEQ ID NO: 185805 - DNA, 830 bp, Homo sapiens
  misc_feature: GYAE6OF01DPM0J.30.68.G02.1.454.CMB.1.raw
  modified_base (187)..(187): a, c, t, g, unknown or other
  misc_feature (187)..(187): n is a, c, g, or t
  modified_base (658)..(658): a, c, t, g, unknown or other
  misc_feature (658)..(658): n is a, c, g, or t
  modified_base (719)..(719): a, c, t, g, unknown or other
  misc_feature (719)..(719): n is a, c, g, or t
  modified_base (734)..(734): a, c, t, g, unknown or other
  misc_feature (734)..(734): n is a, c, g, or t
  modified_base (820)..(820): a, c, t, g, unknown or other
  misc_feature (820)..(820): n is a, c, g, or t
  modified_base (823)..(823): a, c, t, g, unknown or other
  misc_feature (823)..(823): n is a, c, g, or t
tcagcacgctacgtcacgaccggtgctcgatttagtcgatagtgaaggggaaagggcgtggaatgggtctcaagtattgctggtagtggtgatagcacatactacgcagccatcgtgaaggccggttcaccagtctccgagggactagttcgaagaacactactgttttcaggacaaagtgaaacgngccgtgacggtagtacggaggtaaccgtaccgggtccgttaattacgttaaccgtggtcgtaccgtcttttccgaccccgtaaggggtcggttaggggtaacgttaaccgaagggtaccgtacttacccttacccgaacccgtaacgggttccggggcccggggtctaaaccccggtggggttaaacccgcgggttcccggttaccgtacccggttcaacccggcccccgttaaccgggtaaccggggaaaccccgggtccccgtacggtttcccggttccccggttaacccccttcgggacccctaaccccgtcccccgttaaagaaccgccgtacccgtaaccgttccggggacgggtacctaaccgaggttacccgccggtcccggttagggacccggtcgtcccggttaacggaaccgttaaaaccggtccgtttaaccgaccggtttaacgggacctccgggtaancgggttaacgggtccaacccggggtgtaaccgggaaccgggagacccgttagaaacgggtnacgttcgactttcgnacgacgcgtacgcgtacgtacgtacgacgacgacgacgtacgacgtacgacgacgtcgtacgtagtgtgtagtacgtacgtacgancgngtcgtcg

SEQ ID NO: 185806 - DNA, 550 bp, Homo sapiens
  misc_feature: GYAE6OF01BCRQB.30.68.G02.1.454.CMB.1.raw
  modified_base (283)..(283): a, c, t, g, unknown or other
  misc_feature (283)..(283): n is a, c, g, or t
  modified_base (360)..(360): a, c, t, g, unknown or other
  misc_feature (360)..(360): n is a, c, g, or t
  modified_base (513)..(513): a, c, t, g, unknown or other
  misc_feature (513)..(513): n is a, c, g, or t
  modified_base (517)..(517): a, c, t, g, unknown or other
  misc_feature (517)..(517): n is a, c, g, or t
  modified_base (521)..(522): a, c, t, g, unknown or other
  misc_feature (521)..(522): n is a, c, g, or t
  modified_base (524)..(528): a, c, t, g, unknown or other
  misc_feature (524)..(528): n is a, c, g, or t
  modified_base (530)..(550): a, c, t, g, unknown or other
  misc_feature (530)..(550): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggcagttcgaagaacacactgtttctgcaaatgaacagcctgagagtcgagacacggccgtatattactgtgcgtctttccacctggagtgggattacgaagctatacctccaccacgtggggcccggcaccgtggcagcgtcncctcacgcctccaccgacgggcccctagtccggttcccttccccccgtggcccctaccctccctaccgaacggtacncctaaccccgtcggtcggggccaaccgacgaccacggccccgtgggcctcgccgtcgggacaacgggtacctaccttcccgacgtacggccgtacggcctaggacggccgggtactcgggacgaacgggtccacgtaacgtagcgtactgcgntacngcgnngnnnnngnnnnnnnnnnnnnnnnnnnnn

SEQ ID NO: 185807 - DNA, 550 bp, Homo sapiens
  misc_feature: GYAE6OF01DQ5YL.30.68.G02.1.454.CMB.1.raw
  modified_base (520)..(550): a, c, t, g, unknown or other
  misc_feature (520)..(550): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggattacaaggcatacttccaccacgtggggccgggcacccgtggtcagcgtctcctcacgccctaccaccgaacgggcccagttcccggttcccttccccccgtggccctaccccgtccctaccgaaagcgccaccgtcggtggggccacgacgccacggccccgtggggcctcggcccgttacgggtaccgaacgggtaccttaccgttcccgaacgggttacgccggtcggccgttagggacgggtccggggtcgtgggaccgaaacgggccgacgaagttaggcnnnnnnnnnnnnnnnnnnnnnnnnnnnnnnn

SEQ ID NO: 185808 - DNA, 441 bp, Homo sapiens
  misc_feature: GYAE6OF01DRV1A.30.68.G02.1.454.CMB.1.raw
  modified_base (370)..(370): a, c, t, g, unknown or other
  misc_feature (370)..(370): n is a, c, g, or t
  modified_base (407)..(407): a, c, t, g, unknown or other
  misc_feature (407)..(407): n is a, c, g, or t
  modified_base (430)..(441): a, c, t, g, unknown or other
  misc_feature (430)..(441): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggattacaaggcatacttccaccacgtggggccggggcaccctggtcagcgtctcctcagcctccaccaagggcccatccggtccttcccccgtggccaccctcctccaagacgccacctcgtggggcacagcagcccnggctgctgcaacggctacttccacgtacgcgtgctgngcgggctggacaggcgcgatagnnnnnnnnnnnn

SEQ ID NO: 185809 - DNA, 796 bp, Homo sapiens
  misc_feature: GYAE6OF01B64M0.30.68.G02.1.454.CMB.1.raw
  modified_base (757)..(757): a, c, t, g, unknown or other
  misc_feature (757)..(757): n is a, c, g, or t
  modified_base (783)..(783): a, c, t, g, unknown or other
  misc_feature (783)..(783): n is a, c, g, or t
tcagcacgctacgtcacgaccggtgctcgatttagtcgatagtgaagggaaaggggtctggaatgggtctcaagtattgctggtagtggtgatagcacatactacgcagccatcgtgaaggccggttcaccatctccgagggacagttcgaagaacactactgttctgacaaatgaacagcctgaggagtcgaggacacggctagtattacgtgtgcgtctttcaccgtggaaggtggaagttaacgaacggtacaattaacctttccgaaccgaccggttcgggggacccgggacctaacccggttggtacgaacggtcccgttaactttcccgcgaacgacccgttaccgaaccggaacggggtcccctaacgttccggtcccctttcccccggagggtaccctaaccccgttcccgttaacgaaagttaccgggtacccaaccgtacgggtaccggggaaccaaaccgacggaccgttaacggacccccggtaagggtccgtaccggtacccggttacgggttaacgaaaaccggggactttaaccccggtaaccgtaaccggtttcgggaccgttacgggaaccgttaccgggaacgggtaacccgggggtacgtaaccggggaaaccggtaaaacccgggggtcaaaccggttaagggttaaggcccgtagggaaacgacgttaacgagtacgtacgacgacgacgacgtacgacgacgtacgtacgtacgtacgtacgtacgacgtacganacgtcgacgtacgacgtacgacgtanacgtcgtcgtacg

SEQ ID NO: 185810 - DNA, 595 bp, Homo sapiens
  misc_feature: GYAE6OF01DJVEW.30.68.G02.1.454.CMB.1.raw
  modified_base (313)..(313): a, c, t, g, unknown or other
  misc_feature (313)..(313): n is a, c, g, or t
  modified_base (561)..(561): a, c, t, g, unknown or other
  misc_feature (561)..(561): n is a, c, g, or t
  modified_base (563)..(573): a, c, t, g, unknown or other
  misc_feature (563)..(573): n is a, c, g, or t
  modified_base (575)..(595): a, c, t, g, unknown or other
  misc_feature (575)..(595): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacacttgtttctgacaaatgaacagcctgagagtcgaggacacggccgtatattactgtgcgtctttccaccgtggaggtgggagttacgaaggcataccgttccaccgacggtcggggcccgggaccacccgtggtccacgtcgtcctcctacgacnccctacccgaaccgaaccggccctagttcccggtacccttcccccgtggccctacccctccctaccaaagacgtaccacccgtcggtcggggaccaacgacgccgaccgtcccggtagggccgtccgtaccgttggtaaccgtaaacggtacccttaccgttacccggaacggttacgggccgttacggtccgtacggacgggtccgggggtactcggggaaccgtaacgggccaacgtagtagctancnnnnnnnnnnnannnnnnnnnnnnnnnnnnnnn

SEQ ID NO: 185811 - DNA, 479 bp, Homo sapiens
  misc_feature: GYAE6OF01CGM67.30.68.G02.1.454.CMB.1.raw
  modified_base (458)..(458): a, c, t, g, unknown or other
  misc_feature (458)..(458): n is a, c, g, or t
  modified_base (464)..(479): a, c, t, g, unknown or other
  misc_feature (464)..(479): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgtctttccaccctggagtgggagttacgaaggcatactccaccagtcggggccgggcacccgtggtcagcgtctcctcagccctccaccgaacggcccactcggtcccttcccccgtcggcccaccctccctaccgaacgacgccaccgtcggtcggggccacgacgcacggcccgtgggctcgccgtggtccaaaggaccttaccttccgacgtacgcgtgctggcgcgggcgtggcaggcanagtagnnnnnnnnnnnnnnnn

SEQ ID NO: 185812 - DNA, 542 bp, Homo sapiens
  misc_feature: GYAE6OF01BTGQ4.30.68.G02.1.454.CMB.1.raw
  modified_base (210)..(210): a, c, t, g, unknown or other
  misc_feature (210)..(210): n is a, c, g, or t
  modified_base (502)..(502): a, c, t, g, unknown or other
  misc_feature (502)..(502): n is a, c, g, or t
  modified_base (505)..(505): a, c, t, g, unknown or other
  misc_feature (505)..(505): n is a, c, g, or t
  modified_base (508)..(508): a, c, t, g, unknown or other
  misc_feature (508)..(508): n is a, c, g, or t
  modified_base (514)..(514): a, c, t, g, unknown or other
  misc_feature (514)..(514): n is a, c, g, or t
  modified_base (516)..(536): a, c, t, g, unknown or other
  misc_feature (516)..(536): n is a, c, g, or t
  modified_base (538)..(542): a, c, t, g, unknown or other
  misc_feature (538)..(542): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattacngtgcgctttcaccctggagtgggattacaaggcatacttccacacgtggggccgggcacccgtggtcagtccgtctcctcacgcctaccaccgaacgggcccatccggtccttccccgtggccaccctcctccaagcgcacctcgtcggggcacgacgcacgccccgtggggcctacggcccgtgggtaccaaacgggtaccttaaccttacccgaacggttacgccggttacgccgttggacggtccgggggtccttaggggaccgaaacgggcccgacgaacgttaggcngcncgnctgctnannnnnnnnnnnnnnnnnnnnncnnnnn

SEQ ID NO: 185813 - DNA, 514 bp, Homo sapiens
  misc_feature: GYAE6OF01C7LYT.30.68.G02.1.454.CMB.1.raw
  modified_base (494)..(514): a, c, t, g, unknown or other
  misc_feature (494)..(514): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgttttctgacaaatgaacagcctgagagtcgaggacacggccgtatattactgtgcgtctttccaccctgggagtgggagttacaggcatacttccaccgagtcggggccgggcaccgtggtcagcgtctcctcacgcctccaccaacgggcccagtccggtccttcccccgtggccctaccctccctaccaacgacgccctaccgtcgtcggggccacgacgcacgcccgtggctcgccgtggccgaaacggtaccttaccgttccgacggttacggccggttacgccgttagggacggccggggcgttagggaccgaaggccgacagtacgnnnnnnnnnnnnnnnnnnnnn

SEQ ID NO: 185814 - DNA, 680 bp, Homo sapiens
  misc_feature: GYAE6OF01A0G1N.30.68.G02.1.454.CMB.1.raw
  modified_base (564)..(564): a, c, t, g, unknown or other
  misc_feature (564)..(564): n is a, c, g, or t
  modified_base (596)..(596): a, c, t, g, unknown or other
  misc_feature (596)..(596): n is a, c, g, or t
  modified_base (601)..(601): a, c, t, g, unknown or other
  misc_feature (601)..(601): n is a, c, g, or t
  modified_base (620)..(620): a, c, t, g, unknown or other
  misc_feature (620)..(620): n is a, c, g, or t
  modified_base (634)..(634): a, c, t, g, unknown or other
  misc_feature (634)..(634): n is a, c, g, or t
  modified_base (673)..(673): a, c, t, g, unknown or other
  misc_feature (673)..(673): n is a, c, g, or t
  modified_base (675)..(675): a, c, t, g, unknown or other
  misc_feature (675)..(675): n is a, c, g, or t
tcagcacgctacgtcacgaccggtgctcgatttagtcgatagtgaaggggaaaggggctgggaatgggtctcgaagttattgcttggtagtggtgatagcacatactacgcagccatcgtgaagggccggttcaccatctccgagggtactagttcgaagaacactactgttctgcaaatgaacagctgagagtcggacggacaccggccgtatattaccgtggtcgcgtctttacacccgttggagttcggacgttacaaggctacttacctttaccaccgacggtcgggggcccgggcctaccgtacgggtcacggtccgttccgtcccgtcgacgtcctacccgaaccgggaaacgggtcccctagttccgggttccctttccccccgtggaccctaccctccctaccgaagtaccgacctaccgtcggtcggggaccacgacgccgtaccgccgtcggtcgtacgtccgtggtaaccggacgttaaccgttccctaaccgttaccggtagacggttaaccgtacggttaccgggaacggtcccggggtataacccggggngttaaccgggacctaccgaaagttggacccgngtacngtcgcgacgtcgaactcgntagatcgatcaggngtacgtcgcgcgcgacgcgcgcgtcgtcgtcgtgagcgngngtacg

SEQ ID NO: 185815 - DNA, 521 bp, Homo sapiens
  misc_feature: GYAE6OF01BW2R1.30.68.G02.1.454.CMB.1.raw
  modified_base (499)..(521): a, c, t, g, unknown or other
  misc_feature (499)..(521): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgtctttcaccctggagtgggagttacaaggcatactccaccacgtggggccgggcaccctggtcagcgtctcctcagcctccaccaaggcccactccggtccttcccccgtcggcctaccctccctccaagacgccaccgtcgtcgggggccacgacgcacgccccgtggggcctcggcccgtgggtaccgaaacggtaccttaccgttcccgaaccggttacggccgttggccgttggaacgggtcccggggcgtcgggacgtaacgggccggacagtaaggcnnnnnnnnnnnnnnnnnnnnnnn

SEQ ID NO: 185816 - DNA, 555 bp, Homo sapiens
  misc_feature: GYAE6OF01B831P.30.68.G02.1.454.CMB.1.raw
  modified_base (523)..(528): a, c, t, g, unknown or other
  misc_feature (523)..(528): n is a, c, g, or t
  modified_base (530)..(555): a, c, t, g, unknown or other
  misc_feature (530)..(555): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgtctttccacccgtgggagtgggagttacaaggcatacttccaccacgtcggggcccggggcacccgtggtcagcgtctcctcacgccctccaccgaacgggccccatccggtcccttccccccgtggcccacccctccctacccaagacgccaccgtcgtgggggccacacgcacgcccgtgggctcgcccgtgggtaccaaacgggtacccttaccgttcccgaacgggttacgccggttcggtccgtagggacgggtccgggggtcgtcggggaccgtaaacggggcccgtacgtaagtaggcagnnnnnngnnnnnnnnnnnnnnnnnnnnnnnnnn

SEQ ID NO: 185817 - DNA, 377 bp, Homo sapiens
  misc_feature: GYAE6OF01EUF2P.30.68.G02.1.454.CMB.1.raw
  modified_base (291)..(292): a, c, t, g, unknown or other
  misc_feature (291)..(292): n is a, c, g, or t
  modified_base (355)..(355): a, c, t, g, unknown or other
  misc_feature (355)..(355): n is a, c, g, or t
  modified_base (365)..(365): a, c, t, g, unknown or other
  misc_feature (365)..(365): n is a, c, g, or t
  modified_base (371)..(377): a, c, t, g, unknown or other
  misc_feature (371)..(377): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgctagtttatattgtcagcactataacaattggcctcgaacttttggccaggggacagctgagannaaacgactgtaggctgcaccatctgtcttcatctcccgcatctgaactgcgtgctgagcgggntggcaaggcncatagnnnnnnn

SEQ ID NO: 185818 - DNA, 610 bp, Homo sapiens
  misc_feature: GYAE6OF01C1NEY.30.68.G02.1.454.CMB.1.raw
  modified_base (448)..(448): a, c, t, g, unknown or other
  misc_feature (448)..(448): n is a, c, g, or t
  modified_base (479)..(479): a, c, t, g, unknown or other
  misc_feature (479)..(479): n is a, c, g, or t
  modified_base (556)..(556): a, c, t, g, unknown or other
  misc_feature (556)..(556): n is a, c, g, or t
  modified_base (561)..(561): a, c, t, g, unknown or other
  misc_feature (561)..(561): n is a, c, g, or t
  modified_base (566)..(568): a, c, t, g, unknown or other
  misc_feature (566)..(568): n is a, c, g, or t
  modified_base (571)..(571): a, c, t, g, unknown or other
  misc_feature (571)..(571): n is a, c, g, or t
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
  modified_base (579)..(579): a, c, t, g, unknown or other
  misc_feature (579)..(579): n is a, c, g, or t
  modified_base (582)..(582): a, c, t, g, unknown or other
  misc_feature (582)..(582): n is a, c, g, or t
  modified_base (585)..(588): a, c, t, g, unknown or other
  misc_feature (585)..(588): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
  modified_base (594)..(594): a, c, t, g, unknown or other
  misc_feature (594)..(594): n is a, c, g, or t
  modified_base (597)..(604): a, c, t, g, unknown or other
  misc_feature (597)..(604): n is a, c, g, or t
  modified_base (606)..(610): a, c, t, g, unknown or other
  misc_feature (606)..(610): n is a, c, g, or t
tcagcacgctacgtcacgaccggtgctcgatttagtcgatagtgaagggaaaggggcgtggaatgggtctcaagtattgctggtagtggtgatagcacatacctacgcacgcccatcgtgaagggccgttcaccatctccagggacagttcgaagaacacacttgttctgacaaatcgaaccagccgtagacgaggttaccggaacggaccgacgggtacctaattacgttactgtcgcgtctttaccgaccgtgggagtgggtaactaacgagtacctactaccgttaccaccggtacgggtccgggggcccgggtacctacccggtggtaccacggtccctacctcccaccgtacccgtccccgtacccgaaaccgtaaccgggccccttacggtttcccgtttaccccgttaccccgcggtaccctacccgtccacgaaacggcncccgtaaccggtcggtacggccagtacgccnccggtcctggctcgaccggttagactaaacgcctacttacggctagcgtgtcggcgcgggcgtcgaggacgagtacncgtancgcannncancngngagngcntcnnnngngngncgnnnnnnnncnnnnn

SEQ ID NO: 185819 - DNA, 542 bp, Homo sapiens
  misc_feature: GYAE6OF01DOOOR.30.68.G02.1.454.CMB.1.raw
  modified_base (392)..(392): a, c, t, g, unknown or other
  misc_feature (392)..(392): n is a, c, g, or t
  modified_base (521)..(542): a, c, t, g, unknown or other
  misc_feature (521)..(542): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacacttgtttctgcaaatgaacagcctgagagtcgaggacacggccgtatattactgtgcgtcttttccaccctggagtggttagttacgaaggcattaccttccaccacgtcggggccgggccacccgtggtcagccgtctcctcacgccctccaccgaacgggcccagttccggtccctttcccccgtcggcccacccctccctaccaacgacgccaccgtcggtcggggccacncgcaccggccccgtggggccctacgtccgtacgggtaccaacgggtaaccttccgttacccgtaccggtacgccggttgcccgttgggaccggtcggggcgtacgggacgtaaacgggcgacgatacgnnnnnnnnnnnnnnnnnnnnnn

SEQ ID NO: 185820 - DNA, 552 bp, Homo sapiens
  misc_feature: GYAE6OF01D1KCZ.30.68.G02.1.454.CMB.1.raw
  modified_base (277)..(277): a, c, t, g, unknown or other
  misc_feature (277)..(277): n is a, c, g, or t
  modified_base (519)..(552): a, c, t, g, unknown or other
  misc_feature (519)..(552): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccgttcaccatctccagggacagttcgaagaacacactgtttctgcaaatgaacagcctgagagtcgaggacacggccgtatattactgtgcgctttccacctggagtgggattacaggcactacttccacacgtcggggccgggcaccgtggtcngtccgtctcctcacgcctccaaccgacggcccagtccggttccttcccccgtcggcccacccctccctaccctaaacgacgcccaccgttcgtcggggggaccacgacgaccacggtccccgtgggtcctcggcccgttagggtacgaaggtaccttaaccttcccgaacggtacggtaccgtcggccgtaaggacgggccgggtcggttcgggaacgtaacgggccgagtaccgtagcgcnnnnnnnnnnnnnnnnnnnnnnnnnnnnnnnnnn

SEQ ID NO: 185821 - DNA, 506 bp, Homo sapiens
  misc_feature: GYAE6OF01DC720.30.68.G02.1.454.CMB.1.raw
  modified_base (210)..(210): a, c, t, g, unknown or other
  misc_feature (210)..(210): n is a, c, g, or t
  modified_base (482)..(506): a, c, t, g, unknown or other
  misc_feature (482)..(506): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattacngtgcgctttccacctggagtggatacagcatctccaccagtcggggccgggcacccgtggtcacgcgtcctcctcacgcctccaccgaacgggccccagtcccggtcctcccccgtggccctaccctccctacgaaagacgccaccgtcggtggggccacgacgcacggcccgtgggctcgccgtacgggactaacggacgttaccttcccgacgtcgtcgtacgcggtaggacgggccggtcgtagggaccggaaggccgtacgagtacgnnnnnnnnnnnnnnnnnnnnnnnnn

SEQ ID NO: 185822 - DNA, 437 bp, Homo sapiens
  misc_feature: GYAE6OF01E00AH.30.68.G02.1.454.CMB.1.raw
  modified_base (398)..(398): a, c, t, g, unknown or other
  misc_feature (398)..(398): n is a, c, g, or t
  modified_base (426)..(437): a, c, t, g, unknown or other
  misc_feature (426)..(437): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccacactggggccgggcaccctggtcagcgtctcctcgctccaccaaggccatcgtcttcccctcggcaccctcctccaagagcacctctggggcacagcacgccctggctcgcctcggtcaaacggaccttactcctacgtagcgtncgtgagcgggcctggcaaggcgcatagnnnnnnnnnnnn

SEQ ID NO: 185823 - DNA, 550 bp, Homo sapiens
  misc_feature: GYAE6OF01A6PPR.30.68.G02.1.454.CMB.1.raw
  modified_base (466)..(466): a, c, t, g, unknown or other
  misc_feature (466)..(466): n is a, c, g, or t
  modified_base (517)..(517): a, c, t, g, unknown or other
  misc_feature (517)..(517): n is a, c, g, or t
  modified_base (519)..(520): a, c, t, g, unknown or other
  misc_feature (519)..(520): n is a, c, g, or t
  modified_base (522)..(550): a, c, t, g, unknown or other
  misc_feature (522)..(550): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcacctggagtgggatacaggcatactccacacgtggggccgggcaccgtggtcagcgtctctcacgccctccaccgaacgggccccagttcccggttcccctttccccccgtgggacccctacccccttccccgtaccgaaacggtccgccctaaccgtccgggtcggggaccacgacgccaacggccccggtgggccttcggacccgtaggtaccgaaacggtaccttaccctaccgaaccgggtnccggttagcctaggggacgtcgggacgtggaaccgacggtcgagactaggncnntnnnnnnnnnnnnnnnnnnnnnnnnnnnnn

SEQ ID NO: 185824 - DNA, 617 bp, Homo sapiens
  misc_feature: GYAE6OF01BW7BS.30.68.G02.1.454.CMB.1.raw
  modified_base (325)..(325): a, c, t, g, unknown or other
  misc_feature (325)..(325): n is a, c, g, or t
  modified_base (581)..(581): a, c, t, g, unknown or other
  misc_feature (581)..(581): n is a, c, g, or t
  modified_base (586)..(586): a, c, t, g, unknown or other
  misc_feature (586)..(586): n is a, c, g, or t
  modified_base (588)..(617): a, c, t, g, unknown or other
  misc_feature (588)..(617): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaggccggtcaccatctccagggacagttcgaagaacacacttgtttctgacaaatgaacagcctgagagtcgaggacgacggtccgtatattactgtgacgtctttccaccgtgggacggtgggtaagttacgaaggtcaacttaccttccaacccgtacggccgggggccgggtacccaccggtggtcgacggtccgtcctcccgtcnccgtacccctaccgaacccggacggtcccctacgttcccggtccccttcccccgtccggtccctacccctccctaaccgaacgaccgtccctacccgttcgggcggggaccacggacgccgtaccggcccggtggaccgtccgccgtaaccggtcgaaaccgggttaccttaccccgtacgtaaccggtacggtcggtcgtcggttacggacggggtccgggttacgacggaacgggaccggtaccagggtaacgngcgantnnnnnnnnnnnnnnnnnnnnnnnnnnnnnn

SEQ ID NO: 185825 - DNA, 575 bp, Homo sapiens
  misc_feature: GYAE6OF01C52EM.30.68.G02.1.454.CMB.1.raw
  modified_base (481)..(481): a, c, t, g, unknown or other
  misc_feature (481)..(481): n is a, c, g, or t
  modified_base (540)..(540): a, c, t, g, unknown or other
  misc_feature (540)..(540): n is a, c, g, or t
  modified_base (544)..(544): a, c, t, g, unknown or other
  misc_feature (544)..(544): n is a, c, g, or t
  modified_base (546)..(575): a, c, t, g, unknown or other
  misc_feature (546)..(575): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacactactgtttctgcaaaatgaaacagcctgagagtcggagacgacggccgtatattactgtgcgtctttcacccgtggagtgggagttacaagcatactccaccacggtcggggccggcacccgtggtcgagtccgtctccgtcacgccctaccaaccgaacggccccacttccggtccccttcccccgtcggccctaccccgtccccgtaccgaaacggccgtacccgacccgttcgggacggggccaaccgacgcgaccggtcccgtcgggccttcggccgttcgggtactaaacgggtacccttaccttaaccgtacggtacnccgggttgaccggtggaacgggtcggggccgttaggggaccgaacggtacggcgtaaanggcngnnnnnnnnnnnnnnnnnnnnnnnnnnnnnn

SEQ ID NO: 185826 - DNA, 519 bp, Homo sapiens
  misc_feature: GYAE6OF01AWQZN.30.68.G02.1.454.CMB.1.raw
  modified_base (375)..(375): a, c, t, g, unknown or other
  misc_feature (375)..(375): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
  modified_base (488)..(519): a, c, t, g, unknown or other
  misc_feature (488)..(519): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccggggcacccgtggtcagcgtctcctcacgcctccaccgaacgggcccatccggtccttcccccgtggccacccctcctaccgaacgacgccaccgtcgtcggggccacgngcacgcccgtgggctcgccgtacggtaccaaacggtaccttaccttacccgacggttacgccgttgcgttcggacggcggggctgggaccgaagggccgacagtacggncngnnnnnnnnnnnnnnnnnnnnnnnnnnnnnnnn

SEQ ID NO: 185827 - DNA, 456 bp, Homo sapiens
  misc_feature: GYAE6OF01A6QUU.30.68.G02.1.454.CMB.1.raw
  modified_base (320)..(320): a, c, t, g, unknown or other
  misc_feature (320)..(320): n is a, c, g, or t
  modified_base (356)..(356): a, c, t, g, unknown or other
  misc_feature (356)..(356): n is a, c, g, or t
  modified_base (430)..(431): a, c, t, g, unknown or other
  misc_feature (430)..(431): n is a, c, g, or t
  modified_base (433)..(456): a, c, t, g, unknown or other
  misc_feature (433)..(456): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccggggcaccctggtcagccgtctcctcagcctccaccaggcccatcggcttccccnggcaccctcctccaagacgcacctcgtcggggcacngcacgccctggggcctgcctggtcaaggctactccacgtaggcgtgctgagcgggctggcaagggcgcagtagnngnnnnnnnnnnnnnnnnnnnnnnnn

SEQ ID NO: 185828 - DNA, 459 bp, Homo sapiens
  misc_feature: GYAE6OF01CFI79.30.68.G02.1.454.CMB.1.raw
  modified_base (224)..(224): a, c, t, g, unknown or other
  misc_feature (224)..(224): n is a, c, g, or t
  modified_base (239)..(239): a, c, t, g, unknown or other
  misc_feature (239)..(239): n is a, c, g, or t
  modified_base (420)..(421): a, c, t, g, unknown or other
  misc_feature (420)..(421): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (428)..(459): a, c, t, g, unknown or other
  misc_feature (428)..(459): n is a, c, g, or t
tcagcacgctacgtcacgaccggtgctcgatttagtcgatagtgaagggaaagggcagagtgttagctagcaacttagcctggtaccagcagaaacctggccaggctcccaggctcctcatctatgatgcgtccaaccagggtcactggtatcccagccaggttcagcggcagtgggtctgggacagagttcagtctcaccatcagcagcctgcagtctgagtnttttgctagtttatnttgtcagcactataacaagttggccttccggaaactttttgggcctagggggaccctaaggcctttaggacgtataccaaaacggtacctggtacggctgccacatctggtacttcacttccttcccgcctatctacgaacgtgccgtgctggacgcggctgggcaagggtcagtactagnntcntngnnnnnnnnnnnnnnnnnnnnnnnnnnnnnnnn

SEQ ID NO: 185829 - DNA, 462 bp, Homo sapiens
  misc_feature: GYAE6OF01DUCHW.30.68.G02.1.454.CMB.1.raw
  modified_base (347)..(347): a, c, t, g, unknown or other
  misc_feature (347)..(347): n is a, c, g, or t
  modified_base (451)..(462): a, c, t, g, unknown or other
  misc_feature (451)..(462): n is a, c, g, or t
tcagcacgctacgtcacgaccggtgctcgatttagtcgatagtgaagggaaaggggctggaatggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcacccgtggtcagcgtctcctcagcctccaccgaagggccccatccggtccttcccccgtggccaccctcctccaagacnccaccctcgtgggggccacgacgcacgcccgtgggctcgcccgtggtccaaaggtctacgttccacgtagcgtgctgacggcgggctggcaaggcgcagtacgnnnnnnnnnnnn

SEQ ID NO: 185830 - DNA, 682 bp, Homo sapiens
  misc_feature: GYAE6OF01CNGGV.30.68.G02.1.454.CMB.1.raw
  modified_base (632)..(632): a, c, t, g, unknown or other
  misc_feature (632)..(632): n is a, c, g, or t
  modified_base (666)..(666): a, c, t, g, unknown or other
  misc_feature (666)..(666): n is a, c, g, or t
  modified_base (675)..(675): a, c, t, g, unknown or other
  misc_feature (675)..(675): n is a, c, g, or t
  modified_base (677)..(677): a, c, t, g, unknown or other
  misc_feature (677)..(677): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggcggttcaccatctccagggacagttcgaagaacacactgttctgcaaatgaacagcctgagagtcgaggacacggccgtatatactgtgcgctttcacctggagtgggagttacgaaggcatacttcaccacgtggggccgggacaccgtggtcaggtcgtctccgtacacgcctaccaaccgaacgggccccaagttccggtcccgtttcccccgtaggcctaaccccctccctaccaaacggacgaccgtaaccgttccgtcgggggccaaacgaccgacgtaacggcccgtcggggtcctacggtccgttacgggtaaccaaaaggggttaaccttaaccgtttacccaaacggggttaccgtaccgggtttacggacgttacgggaaacggtcccgggggaccgttaccggggaaccggtaaaacgggggcccgtaccgaaaacggttaacgggtacgactagacgtacgtacgtagagagacgtacgtacgactagacgtacgtanacgtcgacgcgtacgtcgagtcacgtaacgaganacacagacngngtacg

SEQ ID NO: 185831 - DNA, 496 bp, Homo sapiens
  misc_feature: GYAE6OF01DI45X.30.68.G02.1.454.CMB.1.raw
  modified_base (192)..(192): a, c, t, g, unknown or other
  misc_feature (192)..(192): n is a, c, g, or t
  modified_base (320)..(320): a, c, t, g, unknown or other
  misc_feature (320)..(320): n is a, c, g, or t
  modified_base (417)..(417): a, c, t, g, unknown or other
  misc_feature (417)..(417): n is a, c, g, or t
  modified_base (457)..(457): a, c, t, g, unknown or other
  misc_feature (457)..(457): n is a, c, g, or t
  modified_base (462)..(462): a, c, t, g, unknown or other
  misc_feature (462)..(462): n is a, c, g, or t
  modified_base (468)..(496): a, c, t, g, unknown or other
  misc_feature (468)..(496): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctcaggacagttcgaagaacacactgttctgacaaatgaacagcctgagacgcgagacncggctatatctgtgcgtctttcaccgtggagtggatacgagcatacctcaccgacggtcggggccggcaccgtggcagtccgtctcctcacgccctaccaccgaacggcctagtccgtcccttcccgngccctaccctctaccgaagcctaccacgttcggcgggaccagaccgatccgccggtaggcctcggcgttaggacacgggtacctccgtcgtaacggngcgtgcgtgggacggtccgggctacggacgaaggcgaacngtagnagcagnnnnnnnnnnnnnnnnnnnnnnnnnnnnn

SEQ ID NO: 185832 - DNA, 522 bp, Homo sapiens
  misc_feature: GYAE6OF01BZF2F.30.68.G02.1.454.CMB.1.raw
  modified_base (292)..(292): a, c, t, g, unknown or other
  misc_feature (292)..(292): n is a, c, g, or t
  modified_base (329)..(329): a, c, t, g, unknown or other
  misc_feature (329)..(329): n is a, c, g, or t
  modified_base (351)..(351): a, c, t, g, unknown or other
  misc_feature (351)..(351): n is a, c, g, or t
  modified_base (369)..(369): a, c, t, g, unknown or other
  misc_feature (369)..(369): n is a, c, g, or t
  modified_base (384)..(384): a, c, t, g, unknown or other
  misc_feature (384)..(384): n is a, c, g, or t
  modified_base (485)..(485): a, c, t, g, unknown or other
  misc_feature (485)..(485): n is a, c, g, or t
  modified_base (490)..(492): a, c, t, g, unknown or other
  misc_feature (490)..(492): n is a, c, g, or t
  modified_base (494)..(522): a, c, t, g, unknown or other
  misc_feature (494)..(522): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgtctttccaccctggagtgggagttacaaggcataccttccaccacgtcggggccgggcacccgtggtcagctctccncacgccctccaccgacggcccatccggtccttccccnggccacccgtccctacaagacnccacctcggtcggggacncgacgcacgtcccgnggggtccctcggtccttgaccgaacggaccttaccgttcccaggtacgcgtcgctggacgggtcgggccgtgggaccgaagggcccgagaattacgggctngtcgnnngnnnnnnnnnnnnnnnnnnnnnnnnnnnnn

SEQ ID NO: 185833 - DNA, 553 bp, Homo sapiens
  misc_feature: GYAE6OF01B2JTV.30.68.G02.1.454.CMB.1.raw
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
  modified_base (385)..(385): a, c, t, g, unknown or other
  misc_feature (385)..(385): n is a, c, g, or t
  modified_base (518)..(519): a, c, t, g, unknown or other
  misc_feature (518)..(519): n is a, c, g, or t
  modified_base (522)..(553): a, c, t, g, unknown or other
  misc_feature (522)..(553): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaaagaacacactgtttctgacaaatgaacagcctgagaggtcgaggacaccggccgtatattactgtgccgtctttccacctggaaggtcggggattacaaggctataccgttccaccgtacgtcgggggccggcacccgtggtcacgtcgtcctacccgtcacgcctaccgaaccgaacgggccctagtcccggttcccttccccccgnggacctaccccncctaccaaaggtcncccgactcggtacggggccaacgagcgtaccggtcccgtcgggcttccggcctggttaccgaaagaccttaccgtccacggtacgcgtcgtagtcggaaggccgggacgcgggaactaagggcctagattagnntgnnnnnnnnnnnnnnnnnnnnnnnnnnnnnnnn

SEQ ID NO: 185834 - DNA, 648 bp, Homo sapiens
  misc_feature: GYAE6OF01DNAR5.30.68.G02.1.454.CMB.1.raw
  modified_base (605)..(605): a, c, t, g, unknown or other
  misc_feature (605)..(605): n is a, c, g, or t
  modified_base (607)..(607): a, c, t, g, unknown or other
  misc_feature (607)..(607): n is a, c, g, or t
  modified_base (609)..(611): a, c, t, g, unknown or other
  misc_feature (609)..(611): n is a, c, g, or t
  modified_base (613)..(614): a, c, t, g, unknown or other
  misc_feature (613)..(614): n is a, c, g, or t
  modified_base (616)..(616): a, c, t, g, unknown or other
  misc_feature (616)..(616): n is a, c, g, or t
  modified_base (618)..(623): a, c, t, g, unknown or other
  misc_feature (618)..(623): n is a, c, g, or t
  modified_base (625)..(648): a, c, t, g, unknown or other
  misc_feature (625)..(648): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtactcccagccaggttcagcggcaggtgggtctgggacagagttcagtctccaccatcagcagcctgcagtctagtaagtatttttgacttagttttattatttgtactagtcaacttaataaactaagttttcgggacccgttaccgggttaaaaccgtttttcgggacccgaaagggggggtaaccctaaaggtccgttttagggaacggtaactttaaaccgaaaaaacccggtaacgtttacggggttacgggaccgtttacgacccgtaaccccgttaagttaccgtttcggtttacctttaccgttaacttccccgtttacccccggtaccctaacgttacccgttaaggtaaaccggtacggtcccggtttacggtaccgttagggtacgggaccggggtccggttacggggacccgaaacggggtccgaaccgtaagttacggagtgtgngngnnnannangnnnnnncnnnnnnnnnnnnnnnnnnnnnnnn

SEQ ID NO: 185835 - DNA, 686 bp, Homo sapiens
  misc_feature: GYAE6OF01EZ0C9.30.68.G02.1.454.CMB.1.raw
  modified_base (107)..(107): a, c, t, g, unknown or other
  misc_feature (107)..(107): n is a, c, g, or t
  modified_base (130)..(130): a, c, t, g, unknown or other
  misc_feature (130)..(130): n is a, c, g, or t
  modified_base (645)..(646): a, c, t, g, unknown or other
  misc_feature (645)..(646): n is a, c, g, or t
  modified_base (648)..(648): a, c, t, g, unknown or other
  misc_feature (648)..(648): n is a, c, g, or t
  modified_base (650)..(651): a, c, t, g, unknown or other
  misc_feature (650)..(651): n is a, c, g, or t
  modified_base (654)..(654): a, c, t, g, unknown or other
  misc_feature (654)..(654): n is a, c, g, or t
  modified_base (658)..(658): a, c, t, g, unknown or other
  misc_feature (658)..(658): n is a, c, g, or t
  modified_base (660)..(686): a, c, t, g, unknown or other
  misc_feature (660)..(686): n is a, c, g, or t
tcagcacgctacgtcacgaccggtgctcgatttagtcgatagtgaagggaaaggggctggaatgggtctcaagtattgctggtagtggtgatagcacatactacgcngcatcgtgaagggccgttcaccntctccgagggacagttcgaagaacacacttgtttctgacaaagtagaaacgcgccgtggagagtcggaaggacaccggtccgttaattactttacgtggtcgccgttcctttccgacccgtagggtaggtagggtaacgttaacgaacggactacttaccgtacccaaccgtacgggtccgggggacccggccgtacccggtcggtaccgtacggtccgttcctccgtaccgtaccgtccccgtaacccggaacccggtaaccgggccccgttaccggtttcccccggttacccccgttcccccgtacccgtaacccccttacccccttacccgtaaccgaaccgacccggtaccccgtaccggtccgggaccgggaaccaacggtccgaccggcccggtacccggtcggtccgtccggtaccgtacggtacccgtaacgttaccttacccgtacgtacggtcgtcggtacgcggcgggacggtcgggacggtacgggacggacgcggtacaggnngncnngtnacgngnnnnnnnnnnnnnnnnnnnnnnnnnnn

SEQ ID NO: 185836 - DNA, 437 bp, Homo sapiens
  misc_feature: GYAE6OF01A3LD8.30.68.G02.1.454.CMB.1.raw
  modified_base (425)..(437): a, c, t, g, unknown or other
  misc_feature (425)..(437): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagagcacctctgggggcacagcagccctgggctgcctggtcaaggctacttccacgtagcgtgctgagcgggctggcaaggcgcatagnnnnnnnnnnnnn

SEQ ID NO: 185837 - DNA, 518 bp, Homo sapiens
  misc_feature: GYAE6OF01BI6KD.30.68.G02.1.454.CMB.1.raw
  modified_base (484)..(484): a, c, t, g, unknown or other
  misc_feature (484)..(484): n is a, c, g, or t
  modified_base (488)..(518): a, c, t, g, unknown or other
  misc_feature (488)..(518): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaggcatactccacacgtgggccgggcacccgtgtcgagcgtcctcctcacgcctccaccaacgggcccacgtccggtccttcccccgtggccaccactccctaccgaagacgccgaccgtccgtcgggggcacgacggccggcccgtgggcctcggccgtgggtaccgaacggtacctaccttcccgacggtacgcgtcgtcgtggacggccgggtcgtacgggacgtaagggcgacgagtaggnacgnnnnnnnnnnnnnnnnnnnnnnnnnnnnnnn

SEQ ID NO: 185838 - DNA, 516 bp, Homo sapiens
  misc_feature: GYAE6OF01D0TGM.30.68.G02.1.454.CMB.1.raw
  modified_base (421)..(421): a, c, t, g, unknown or other
  misc_feature (421)..(421): n is a, c, g, or t
  modified_base (468)..(468): a, c, t, g, unknown or other
  misc_feature (468)..(468): n is a, c, g, or t
  modified_base (474)..(474): a, c, t, g, unknown or other
  misc_feature (474)..(474): n is a, c, g, or t
  modified_base (478)..(478): a, c, t, g, unknown or other
  misc_feature (478)..(478): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (501)..(516): a, c, t, g, unknown or other
  misc_feature (501)..(516): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggtccgtatattactgtcgcgtctttccacccgtggaggtgggagttaacgaggctattaccttccaccgacggtcggggcccggggcacccgtcggtcacgtccgtcctccctcacgcccctacccaaccgaacgggcccctacgttcccggttcccgttccccccgtcggccctaccccttccctaccgaacgaccgtcccacccgtcggtcggggaccacgngccgtcgcccgtggcctcgccgtgtacgagtacctactaccagtacncgtcgngtgnggcggtcgcgacgaggcncnagnnnnnnnnnnnnnnnn

SEQ ID NO: 185839 - DNA, 489 bp, Homo sapiens
  misc_feature: GYAE6OF01AKM1L.30.68.G02.1.454.CMB.1.raw
  modified_base (282)..(282): a, c, t, g, unknown or other
  misc_feature (282)..(282): n is a, c, g, or t
  modified_base (462)..(489): a, c, t, g, unknown or other
  misc_feature (462)..(489): n is a, c, g, or t
tcagcacgctacgtcacgaccggtgctcgatttagtcgatagtgaagggaaaggggctggaatgggtctcaagttattgctggtagtggtgatagcacatactacgcagccatcgtgaagggccggttcaccatctccagggacagttcgaagaacacactgttttctgcaaatgaacagcctgagagtcgaggacacggccgtatattactgtgcgctttcaccctgggagtgggagttacaaggcataccttccaccacgtggggcccggggcaccccgnggtcagcgtctccctcacgcctccaccacgggcccagtccgtccttccccctggcccacccctccctccaacgacgtccaccctcgtcgggggccacgcgccagcccgtgggctggcctggccaaggcctacgtccacgtagcgtgcgtggacgcgggctggaccgaggcgcgatacggnnnnnnnnnnnnnnnnnnnnnnnnnnnn

SEQ ID NO: 185840 - DNA, 510 bp, Homo sapiens
  misc_feature: GYAE6OF01CYPLE.30.68.G02.1.454.CMB.1.raw
  modified_base (210)..(210): a, c, t, g, unknown or other
  misc_feature (210)..(210): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (481)..(510): a, c, t, g, unknown or other
  misc_feature (481)..(510): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattacngtgcgctttcacctggagtgggagttacaaggcatactccaccacgtggggccgggcaccctggtcagcgtctcctcacgcctccaccaacggcccatccggtccttcccccgcggcctaccctcctaccaagcgcctaccgtcgtcggggaccacgacgcacgcccgtgggcctcggccgtcggtacaaacggtacttaccgttaccaccggtagtccggtgcgtaggacgggcggggctcggacgaacgggtccgactaagtcgntngnnnnnnnnnnnnnnnnnnnnnnnnnnnnnn

SEQ ID NO: 185841 - DNA, 592 bp, Homo sapiens
  misc_feature: GYAE6OF01A856J.30.68.G02.1.454.CMB.1.raw
  modified_base (165)..(165): a, c, t, g, unknown or other
  misc_feature (165)..(165): n is a, c, g, or t
  modified_base (185)..(185): a, c, t, g, unknown or other
  misc_feature (185)..(185): n is a, c, g, or t
  modified_base (301)..(301): a, c, t, g, unknown or other
  misc_feature (301)..(301): n is a, c, g, or t
  modified_base (553)..(553): a, c, t, g, unknown or other
  misc_feature (553)..(553): n is a, c, g, or t
  modified_base (556)..(556): a, c, t, g, unknown or other
  misc_feature (556)..(556): n is a, c, g, or t
  modified_base (558)..(559): a, c, t, g, unknown or other
  misc_feature (558)..(559): n is a, c, g, or t
  modified_base (561)..(562): a, c, t, g, unknown or other
  misc_feature (561)..(562): n is a, c, g, or t
  modified_base (565)..(566): a, c, t, g, unknown or other
  misc_feature (565)..(566): n is a, c, g, or t
  modified_base (568)..(568): a, c, t, g, unknown or other
  misc_feature (568)..(568): n is a, c, g, or t
  modified_base (571)..(573): a, c, t, g, unknown or other
  misc_feature (571)..(573): n is a, c, g, or t
  modified_base (575)..(585): a, c, t, g, unknown or other
  misc_feature (575)..(585): n is a, c, g, or t
  modified_base (587)..(592): a, c, t, g, unknown or other
  misc_feature (587)..(592): n is a, c, g, or t
tcagcacgctacgtcacgaccggtgctcgatttagtcgatagtgaagggaaagggctggaatgggtctcaagtattgctggtagtggtgatagcacatactacgcagccatcgtgaaggccggttcaccatctccagggacagttcgaagaacacacttgtttcngacaaatgaacagcctgagngtcgaggacacggccgtatattactgtgcgtctttccacccgtggagtgggtattacgaaggcattacctccaccgacggtcgggggccggtcacccgtggccagccgtcctctcncgtccctccgaaccgaacggccctacgtccggtccccttccccgtggacccctcccgtcctcccgaagccgtaccctaccgtcggtcggggaccaacgcggtaccaccggtcccggtcgggtactcgtaccggtacggtaacgaaccggttaaccgtcccttaccggacggtttaccgcggttcgtccggtaggccgggtacgggtacggtcggaaccggtaacggtaccgacgtaaagtcgcgtgactcgnagngnngnntanngngcnnncnnnnnnnnnnncnnnnnn

SEQ ID NO: 185842 - DNA, 774 bp, Homo sapiens
  misc_feature: GYAE6OF01B67UW.30.68.G02.1.454.CMB.1.raw
  modified_base (175)..(175): a, c, t, g, unknown or other
  misc_feature (175)..(175): n is a, c, g, or t
  modified_base (210)..(210): a, c, t, g, unknown or other
  misc_feature (210)..(210): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccgtcaccatctccagggacagttcgaagaacacactgttctgacaaatgaacngcctgagagtcgaggacacggcgtatattactgtncgtcttcaccgtggagtaggtagtacgaaggtctataccttccaacgacggtacggggcccgggtcgtacccgtggtacgtacggtcgtacctcctacgtcgtaccccgtaccgaacccgaacggaccccgtacggttcccggttaccccttcccccggtcggtaccctaccccgttcccgtaacccgtaaacggaaccgtacccgaacccgttaccggtaccgggggacctaacgtaccggtaccgtaacccggtcccggtacgggtcctacggttacccggtacggtaaccgtaaacggtaacccgtttaaccgttaaccccgtaacggtaccggtaccgttacggaccgttacggggtaacgggtcccgggttaccgggtaccgggtaaccgaaacggggtacccgtaccgtaaagggttaacgcggtacggaacgtcgtagtaccgtagcgtaagtacgtccgtacgacggtaattaacggcttaccggtaatacgtacgtacgtacgtacgtagtacgtcgtacgtacgtacgtacgtacgtagtacgtacgtcgtacg

SEQ ID NO: 185843 - DNA, 520 bp, Homo sapiens
  misc_feature: GYAE6OF01C65RC.30.68.G02.1.454.CMB.1.raw
  modified_base (488)..(520): a, c, t, g, unknown or other
  misc_feature (488)..(520): n is a, c, g, or t
tcagcacgctacgtcacgaccggtgctcgatttagtcgatagtgaagggaaagggcagagtgttagcagcaacttagcctggtaccagcaagaaacctggccaggctcccaggctcctcatctatgatgccgtccaccgagggtcactggtactcccagccgaggttcagcggcaggttgggtctggggacagtagtttcagtctcaccatcagcagcctgcagttcagtaagtattttgattagtttattattgctagactactaactaatacgttccggaccttaccggttaaacgttttcggaaccggtacggggaacctagtacgttagaagtactaaccgaaacggtaactggtcggctcgacctactacttcttacgtcttacgtactttcccttccccgtacctattacgtacggtaacgtcggtccggtcgtacgtcggacgggtcgggtcgtacgggaccgaaggtccgactagagtgnnnnnnnnnnnnnnnnnnnnnnnnnnnnnnnnn

SEQ ID NO: 185844 - DNA, 652 bp, Homo sapiens
  misc_feature: GYAE6OF01DQGIO.30.68.G02.1.454.CMB.1.raw
  modified_base (610)..(610): a, c, t, g, unknown or other
  misc_feature (610)..(610): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
  modified_base (619)..(623): a, c, t, g, unknown or other
  misc_feature (619)..(623): n is a, c, g, or t
  modified_base (625)..(627): a, c, t, g, unknown or other
  misc_feature (625)..(627): n is a, c, g, or t
  modified_base (629)..(629): a, c, t, g, unknown or other
  misc_feature (629)..(629): n is a, c, g, or t
  modified_base (632)..(652): a, c, t, g, unknown or other
  misc_feature (632)..(652): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccgttcaccatctccagggacagttcgaaagaacacacttgtttctgacaaatgaacagcctgagagtcgacggacgaccggtccgtaatattacgtgtcgccgtcctttccaacccgtgggaggtgggtaagttaacgaacggctaacttaccttcccacccgtacggtcgggggcccgggccacccgtggtccacgtccgttcctccctcaccgtcccctacccgaacccgaaccgggtcccctaacggttcccggttccccttaccccccggtcggacccctaccccgtaccctacccgaacgccgaccccgtaccggtccggtacggggaccctacgacggccgaccggcccggttcgggccttcggtccgtacgggtaacccgtaaaggtccctttaccccgttaccggaccgtttacggccggtttacggccgtagggacgggtacccgggtgtaccgggaccgaacgggccacgtaacggtnacgngnctnnnnncnnncncannnnnnnnnnnnnnnnnnnnn

SEQ ID NO: 185845 - DNA, 530 bp, Homo sapiens
  misc_feature: GYAE6OF01DOSPD.30.68.G02.1.454.CMB.1.raw
  modified_base (297)..(297): a, c, t, g, unknown or other
  misc_feature (297)..(297): n is a, c, g, or t
  modified_base (486)..(487): a, c, t, g, unknown or other
  misc_feature (486)..(487): n is a, c, g, or t
  modified_base (491)..(491): a, c, t, g, unknown or other
  misc_feature (491)..(491): n is a, c, g, or t
  modified_base (494)..(494): a, c, t, g, unknown or other
  misc_feature (494)..(494): n is a, c, g, or t
  modified_base (497)..(497): a, c, t, g, unknown or other
  misc_feature (497)..(497): n is a, c, g, or t
  modified_base (500)..(500): a, c, t, g, unknown or other
  misc_feature (500)..(500): n is a, c, g, or t
  modified_base (502)..(505): a, c, t, g, unknown or other
  misc_feature (502)..(505): n is a, c, g, or t
  modified_base (507)..(511): a, c, t, g, unknown or other
  misc_feature (507)..(511): n is a, c, g, or t
  modified_base (513)..(513): a, c, t, g, unknown or other
  misc_feature (513)..(513): n is a, c, g, or t
  modified_base (515)..(530): a, c, t, g, unknown or other
  misc_feature (515)..(530): n is a, c, g, or t
tcagcacgctacgtcacgaccggtgctcgatttagtcgatagtgaagggaaagggctggaatgggtctcaagtattgctggtagtggtgatagcacatactacgcagccatcgtgaagggccggttcaccatctccagggacagttcgaagaacacactgtttctgacaaatgaacagcctgagagtcgaggaccacggccgtatcttactgtgctctttaccaccgtggagtggtagtacaggcatctccacgacgtcggggccgggctaccgtggtccacggtctcctcctcacnccctaccaccgaacgggccctagtccgttcccttcccgtcgaccctccctaccgtaccagtacgcctaccgtcggtggggacctacgacgacgaccgtccgacgggtctcgccgtaggacgacgtactcttacggacaggtcgtagcgtggaacgtcgggtactaggacgaaggccgtacagtcggaannacgngcnacncgnannnncnnnnngngnnnnnnnnnnnnnnnn

SEQ ID NO: 185846 - DNA, 566 bp, Homo sapiens
  misc_feature: GYAE6OF01EGZQ4.30.68.G02.1.454.CMB.1.raw
  modified_base (305)..(305): a, c, t, g, unknown or other
  misc_feature (305)..(305): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (534)..(537): a, c, t, g, unknown or other
  misc_feature (534)..(537): n is a, c, g, or t
  modified_base (539)..(566): a, c, t, g, unknown or other
  misc_feature (539)..(566): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgttttctgacaaatgaacagcctgagagtcgaggacacggccgtatattactgtgcgtctttcacccgtggagtgggagttacgaaggcataccttccaccgacgtcggggcccgggccacccgtggtcacgccgtcctcctccncgccctcccaacccgaacggcccacgtcccggtccctttcccccgtcggaccctacccctccctaccgaacgacgaccctacccgtcggtcggggaccacgacgccgacgccccgtggccgtcgtccgtacggtacgaacgtacctaccgttaccgtacgtacgtcgtcgcgtaggacgggtccggggtcgtacgggaccggtaacgggaccgtacgaagtagntncgnnnngnnnnnnnnnnnnnnnnnnnnnnnnnnnn

SEQ ID NO: 185847 - DNA, 633 bp, Homo sapiens
  misc_feature: GYAE6OF01CRIO2.30.68.G02.1.454.CMB.1.raw
  modified_base (396)..(396): a, c, t, g, unknown or other
  misc_feature (396)..(396): n is a, c, g, or t
  modified_base (555)..(555): a, c, t, g, unknown or other
  misc_feature (555)..(555): n is a, c, g, or t
  modified_base (563)..(563): a, c, t, g, unknown or other
  misc_feature (563)..(563): n is a, c, g, or t
  modified_base (575)..(575): a, c, t, g, unknown or other
  misc_feature (575)..(575): n is a, c, g, or t
  modified_base (586)..(586): a, c, t, g, unknown or other
  misc_feature (586)..(586): n is a, c, g, or t
  modified_base (601)..(601): a, c, t, g, unknown or other
  misc_feature (601)..(601): n is a, c, g, or t
  modified_base (612)..(612): a, c, t, g, unknown or other
  misc_feature (612)..(612): n is a, c, g, or t
  modified_base (624)..(624): a, c, t, g, unknown or other
  misc_feature (624)..(624): n is a, c, g, or t
  modified_base (626)..(626): a, c, t, g, unknown or other
  misc_feature (626)..(626): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
tcagcacgctacgtcacgaccggtgctcgatttagtcgatagtgaagggaaagggctggaatgggtctcaagtatttgctggtagtggtgatagcacatactacgcagccatcgtgaaggccgttcacatctccaggacagttcgaagaacacacttgtttctgacaaatgaacagcctagagagtcgaaggacacggaccgttatagttactgtgtcgtaccttttccgacccgtgggtacggttgggtaacgtttaacgaaggtctaacgttaccttaccgaaccgacggtcgggggtccccgggactacccggtggtaccgacggtccgttacctccgtacgaccgtccctaccgaaccgaaccggccctacgttccggttcccttcccccgnggtccctaccctcccgtaaccgaaacgaccgccctaccgttcggacgggaccacgacgtcgaccggtccgtaggcctcgccgtaggaccgaacgcctacctcgacgtgccgtgacgtacggacgtcggacgtcggaacgaacgggtccaatacggacgngacgtgancgcgtgaatcgngaacgtgcgcncgcgcgacgacgcgngcgacgagacncacgagactcananacngnga

SEQ ID NO: 185848 - DNA, 595 bp, Homo sapiens
  misc_feature: GYAE6OF01B07D2.30.68.G02.1.454.CMB.1.raw
  modified_base (556)..(556): a, c, t, g, unknown or other
  misc_feature (556)..(556): n is a, c, g, or t
  modified_base (560)..(560): a, c, t, g, unknown or other
  misc_feature (560)..(560): n is a, c, g, or t
  modified_base (562)..(595): a, c, t, g, unknown or other
  misc_feature (562)..(595): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcaggtgggtcgtgggacagagttcacgtcctaccacatacacgcgtacgtccgttagttacgttacgttaggtaagtttagttttacgtacgttttagttttaattttagttacgttacgtactacctaaacgttaacttaaacgttaacgttaccggtacccggtttaaccggttaacggttttcgggaaccggggtaacgggaaccgtacgtacgttagtaacgaaacctaacgtaaaaccggtaagttcgggtacggcgtacacctaaccttcttcgttcgttcttacctccttcccctccgaccttactaccgtacgaacggttcggtcggttacggagggtacgggcggtacggacgggacgaacggggtccgataacgggtngtcngnnnnnnnnnnnnnnnnnnnnnnnnnnnnnnnnnn

SEQ ID NO: 185849 - DNA, 485 bp, Homo sapiens
  misc_feature: GYAE6OF01AWUDP.30.68.G02.1.454.CMB.1.raw
  modified_base (471)..(485): a, c, t, g, unknown or other
  misc_feature (471)..(485): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgcttttcaccctggagtgggagttacaaggcatacttccaccactggggccggggcaccctggtcagcgtctcctcagccctccacccaagggccccatccggtccttccccccgtggccacccctccctacccaagacgccaccctcgtcggggggccacgacgccacggccccgtcggggctcggccctgggtacaacggtacctacttccgacggtacgcgtgctggacgcgggctggcgaacggcgcgatcgnnnnnnnnnnnnnnn

SEQ ID NO: 185850 - DNA, 447 bp, Homo sapiens
  misc_feature: GYAE6OF01EQ0H3.30.68.G02.1.454.CMB.1.raw
  modified_base (435)..(435): a, c, t, g, unknown or other
  misc_feature (435)..(435): n is a, c, g, or t
  modified_base (441)..(447): a, c, t, g, unknown or other
  misc_feature (441)..(447): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacctggggccgggcaccctggtcagcgtctcctcagcctccaccaagggcccattcggtcttccccctcggcaccctcctccaagagcaccgtctgggggccacgagcagccctggggctcggcctgggtcaaggtactacctttccacgtagcgtcgctggagcggggctggcaaggcncatagnnnnnnn

SEQ ID NO: 185851 - DNA, 652 bp, Homo sapiens
  misc_feature: GYAE6OF01DLX9A.30.68.G02.1.454.CMB.1.raw
  modified_base (154)..(154): a, c, t, g, unknown or other
  misc_feature (154)..(154): n is a, c, g, or t
  modified_base (353)..(353): a, c, t, g, unknown or other
  misc_feature (353)..(353): n is a, c, g, or t
  modified_base (560)..(560): a, c, t, g, unknown or other
  misc_feature (560)..(560): n is a, c, g, or t
  modified_base (603)..(603): a, c, t, g, unknown or other
  misc_feature (603)..(603): n is a, c, g, or t
  modified_base (605)..(606): a, c, t, g, unknown or other
  misc_feature (605)..(606): n is a, c, g, or t
  modified_base (608)..(608): a, c, t, g, unknown or other
  misc_feature (608)..(608): n is a, c, g, or t
  modified_base (611)..(611): a, c, t, g, unknown or other
  misc_feature (611)..(611): n is a, c, g, or t
  modified_base (613)..(613): a, c, t, g, unknown or other
  misc_feature (613)..(613): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
  modified_base (621)..(621): a, c, t, g, unknown or other
  misc_feature (621)..(621): n is a, c, g, or t
  modified_base (623)..(623): a, c, t, g, unknown or other
  misc_feature (623)..(623): n is a, c, g, or t
  modified_base (625)..(625): a, c, t, g, unknown or other
  misc_feature (625)..(625): n is a, c, g, or t
  modified_base (629)..(629): a, c, t, g, unknown or other
  misc_feature (629)..(629): n is a, c, g, or t
  modified_base (632)..(633): a, c, t, g, unknown or other
  misc_feature (632)..(633): n is a, c, g, or t
  modified_base (635)..(635): a, c, t, g, unknown or other
  misc_feature (635)..(635): n is a, c, g, or t
  modified_base (637)..(638): a, c, t, g, unknown or other
  misc_feature (637)..(638): n is a, c, g, or t
  modified_base (640)..(640): a, c, t, g, unknown or other
  misc_feature (640)..(640): n is a, c, g, or t
  modified_base (642)..(643): a, c, t, g, unknown or other
  misc_feature (642)..(643): n is a, c, g, or t
  modified_base (647)..(652): a, c, t, g, unknown or other
  misc_feature (647)..(652): n is a, c, g, or t
tcagcacgctacgtcacgaccggtgctcgatttagtcgatagtgaagggaaaggggctggaagtgggtctcaagtattgctggtagtggtgatagcacatactacgcagccatcgtgaaggccggtcaccatcctccgagggacagttcgaaanaaacacacttgttctgacaaatgaaacagcctaggagacgtacgaacgggacctacggaccgttaattaattaccgtgtgcccgtcttccgaccgtagggaggtcggtaacgtacgaacgtactacgttaccttcccaaccgtacgggtcggggcccggccgtaccggttcggaactcggtccgttctaccctcgaccnccccgtaaccgaacccggaccggaccaacgtttcccgtcccttccccccgtaggacccctcccctaccaccgaacgccgtaccctaccggttccggacgggacctaaacgaccgtacggcccgtacggtccggtacgcggtacgtacggacgtaaacgtaacccgttcgttaccgtacggtcgtacggtctacggtgggaacccggnggtacccgtcgggaacacgggttaccgaacgcgaagcttcgangnngngcncncgntncgngncncgcngcnngngnncncnnctcnnnnnn

SEQ ID NO: 185852 - DNA, 558 bp, Homo sapiens
  misc_feature: GYAE6OF01DX679.30.68.G02.1.454.CMB.1.raw
  modified_base (177)..(177): a, c, t, g, unknown or other
  misc_feature (177)..(177): n is a, c, g, or t
  modified_base (524)..(524): a, c, t, g, unknown or other
  misc_feature (524)..(524): n is a, c, g, or t
  modified_base (527)..(535): a, c, t, g, unknown or other
  misc_feature (527)..(535): n is a, c, g, or t
  modified_base (537)..(558): a, c, t, g, unknown or other
  misc_feature (537)..(558): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgacaaatgaanagcctgagagtcgaggacacggcctatattactgtgcgtctttcacccgtggagtgggagttacgaaggcattaccttccaccacgtggggccgggccacccgtggtcagcgtctcctcacgccctcccaccgaacgggccctacgtcccggttccttcccccgtcggccctacccctccctacctaacgacgcctaccgtccggtcggggccacgacgccacggtccccgtcgggccgttcgacccgttcggtacgaaacggtaccttaccttcccgaacggttacggccgttggtcctagggacgggccgggtcggtgggaccgaaggggcccgacgtacgtagnagnnnnnnnnngnnnnnnnnnnnnnnnnnnnnnn

SEQ ID NO: 185853 - DNA, 618 bp, Homo sapiens
  misc_feature: GYAE6OF01B02DJ.30.68.G02.1.454.CMB.1.raw
  modified_base (137)..(137): a, c, t, g, unknown or other
  misc_feature (137)..(137): n is a, c, g, or t
  modified_base (166)..(166): a, c, t, g, unknown or other
  misc_feature (166)..(166): n is a, c, g, or t
  modified_base (310)..(310): a, c, t, g, unknown or other
  misc_feature (310)..(310): n is a, c, g, or t
  modified_base (473)..(473): a, c, t, g, unknown or other
  misc_feature (473)..(473): n is a, c, g, or t
  modified_base (568)..(568): a, c, t, g, unknown or other
  misc_feature (568)..(568): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
  modified_base (577)..(577): a, c, t, g, unknown or other
  misc_feature (577)..(577): n is a, c, g, or t
  modified_base (580)..(580): a, c, t, g, unknown or other
  misc_feature (580)..(580): n is a, c, g, or t
  modified_base (584)..(584): a, c, t, g, unknown or other
  misc_feature (584)..(584): n is a, c, g, or t
  modified_base (587)..(587): a, c, t, g, unknown or other
  misc_feature (587)..(587): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
  modified_base (594)..(595): a, c, t, g, unknown or other
  misc_feature (594)..(595): n is a, c, g, or t
  modified_base (597)..(602): a, c, t, g, unknown or other
  misc_feature (597)..(602): n is a, c, g, or t
  modified_base (604)..(610): a, c, t, g, unknown or other
  misc_feature (604)..(610): n is a, c, g, or t
  modified_base (612)..(618): a, c, t, g, unknown or other
  misc_feature (612)..(618): n is a, c, g, or t
tcagcacgctacgtcacgaccggtgctcgatttagtcgatagtgaagggaaaggggctggaactgggtctcaagtattggctggtagtggtgatagcacaatactacgcagccagtctgaagggccgttcaccatcnccaggcagtcgaagaacacacttgtttcngacaaatacgaacacgtcctggagacgtcgaaggacgaccggccgtatacgttactgcgcgtctttcaccgtgggtacgagggtaactacgaaggtcacttaccgtccaaccgacggtcggggaccggccaccccgtggtaccncggtccttccgtccctacacgccctaccgaaacccgtacgggccctacgttcccggtcccttacccccgtcggacccctacccttcccgaaccaaccggacgtccccttaccgtcgggccggaccacgaacggccgtccggacccggtggccgtacggttccncggggttaccaagtacccgtttaccgtaccgaacgttacgccggtacgtcgtagggccgtaccgggtcggacgtacgaaaccggtcagtaccggngncngctancgncgtnacntcncncnncnnnnnngnnnnnnntnnnnnnn

SEQ ID NO: 185854 - DNA, 519 bp, Homo sapiens
  misc_feature: GYAE6OF01EO668.30.68.G02.1.454.CMB.1.raw
  modified_base (215)..(215): a, c, t, g, unknown or other
  misc_feature (215)..(215): n is a, c, g, or t
  modified_base (380)..(380): a, c, t, g, unknown or other
  misc_feature (380)..(380): n is a, c, g, or t
  modified_base (465)..(465): a, c, t, g, unknown or other
  misc_feature (465)..(465): n is a, c, g, or t
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
  modified_base (476)..(476): a, c, t, g, unknown or other
  misc_feature (476)..(476): n is a, c, g, or t
  modified_base (480)..(480): a, c, t, g, unknown or other
  misc_feature (480)..(480): n is a, c, g, or t
  modified_base (482)..(482): a, c, t, g, unknown or other
  misc_feature (482)..(482): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
  modified_base (490)..(492): a, c, t, g, unknown or other
  misc_feature (490)..(492): n is a, c, g, or t
  modified_base (494)..(494): a, c, t, g, unknown or other
  misc_feature (494)..(494): n is a, c, g, or t
  modified_base (498)..(499): a, c, t, g, unknown or other
  misc_feature (498)..(499): n is a, c, g, or t
  modified_base (501)..(502): a, c, t, g, unknown or other
  misc_feature (501)..(502): n is a, c, g, or t
  modified_base (506)..(506): a, c, t, g, unknown or other
  misc_feature (506)..(506): n is a, c, g, or t
  modified_base (508)..(513): a, c, t, g, unknown or other
  misc_feature (508)..(513): n is a, c, g, or t
  modified_base (515)..(518): a, c, t, g, unknown or other
  misc_feature (515)..(518): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctcccaggggacagttcgaagaacacactgtttctgcaaatgaacagcctgagagtcgaggacacggccgtatattactgtncgctttcaccctggagtgggagttacaagcaatacttccaccgacgtggggccgggccaccctggtcagcgtctctcacgcctccaccaaggcccatcggtcctccccctggccacccctcctccaagagccacctccgtggggcacacgcacgcccgtgggtcnggccctggtcgaacggtactaccttaccgacgtagccgtcgcgtgacggcgggactcggacgaacgggccgactaagtaacggtnacgngntacgnacgnangtncngtnnncntacnngnngagntnnnnnnannnng

SEQ ID NO: 185855 - DNA, 541 bp, Homo sapiens
  misc_feature: GYAE6OF01B2BNS.30.68.G02.1.454.CMB.1.raw
  modified_base (213)..(213): a, c, t, g, unknown or other
  misc_feature (213)..(213): n is a, c, g, or t
  modified_base (336)..(336): a, c, t, g, unknown or other
  misc_feature (336)..(336): n is a, c, g, or t
  modified_base (378)..(378): a, c, t, g, unknown or other
  misc_feature (378)..(378): n is a, c, g, or t
  modified_base (475)..(475): a, c, t, g, unknown or other
  misc_feature (475)..(475): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
  modified_base (510)..(541): a, c, t, g, unknown or other
  misc_feature (510)..(541): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacacttgtttctgacaaatgaacagccgtgagagtcgagacacggctatattactgtncgtctttcaccgtggagtggtatacaggctatactccaccgagtcggggcccggcaccgtggtcagtcgtctcctacgacgtccctccgaaccgacgggccctacgtccgttcccttccccgnggccctacccctccgtacaacgcgcctccgtcggtgggaccncgtacgccgacggcccgtggccgtacgtccggtgacgtaacggtaccttaccgttaccgacgtaggaccgtggtaccgtgggtacggccgggttacncgggaaccgagggccgacgaggtagctacgngntnnnnnnnnnnnnnnnnnnnnnnnnnnnnnnnn

SEQ ID NO: 185856 - DNA, 596 bp, Homo sapiens
  misc_feature: GYAE6OF01DYMPX.30.68.G02.1.454.CMB.1.raw
  modified_base (489)..(489): a, c, t, g, unknown or other
  misc_feature (489)..(489): n is a, c, g, or t
  modified_base (552)..(552): a, c, t, g, unknown or other
  misc_feature (552)..(552): n is a, c, g, or t
  modified_base (558)..(558): a, c, t, g, unknown or other
  misc_feature (558)..(558): n is a, c, g, or t
  modified_base (562)..(562): a, c, t, g, unknown or other
  misc_feature (562)..(562): n is a, c, g, or t
  modified_base (564)..(564): a, c, t, g, unknown or other
  misc_feature (564)..(564): n is a, c, g, or t
  modified_base (567)..(569): a, c, t, g, unknown or other
  misc_feature (567)..(569): n is a, c, g, or t
  modified_base (571)..(578): a, c, t, g, unknown or other
  misc_feature (571)..(578): n is a, c, g, or t
  modified_base (581)..(587): a, c, t, g, unknown or other
  misc_feature (581)..(587): n is a, c, g, or t
  modified_base (589)..(591): a, c, t, g, unknown or other
  misc_feature (589)..(591): n is a, c, g, or t
  modified_base (593)..(594): a, c, t, g, unknown or other
  misc_feature (593)..(594): n is a, c, g, or t
  modified_base (596)..(596): a, c, t, g, unknown or other
  misc_feature (596)..(596): n is a, c, g, or t
tcagcacgctacgtcacgaccggtgctcgatttagtcgatagtgaagggaaagggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgtctttcaccctggagtgggattacaggcataccttcaccacgtcggggccgggcacccgtggtcgagtcgtctccctcacgcccctaccgaccgaacgggcccctagttcccggttccctttccccccgcggccctaccccgtccctacccgaaacgacgccctaacccgtcggtcgggggaccacgacgcccgacggtcccccggtgggccgtccggcccgttaggggtaccgaaacgggtacccttaccgttacccgaacggttcgccgggtntacggttcgggaccgggtcggggtcctcggggaaccgtaacggggccacgtaacgtagcgtancgcagncagngncgnnngnnnnnnnngcnnnnnnncnnncnngn

SEQ ID NO: 185857 - DNA, 601 bp, Homo sapiens
  misc_feature: GYAE6OF01A0UFG.30.68.G02.1.454.CMB.1.raw
  modified_base (564)..(564): a, c, t, g, unknown or other
  misc_feature (564)..(564): n is a, c, g, or t
  modified_base (569)..(583): a, c, t, g, unknown or other
  misc_feature (569)..(583): n is a, c, g, or t
  modified_base (585)..(585): a, c, t, g, unknown or other
  misc_feature (585)..(585): n is a, c, g, or t
  modified_base (587)..(601): a, c, t, g, unknown or other
  misc_feature (587)..(601): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaaagaacactacttgtttctgacaaatgaacagcctgagagtcgaggacgaccggccgttatattactgtgcgtctttccaccgtggagtgggagttacaggcatacctccaccgacgtgggggcccgggcctacccgtggtaccagtccgtcctcccttcaccgtcccctaccaaccgaccggggccctagttcccggtccccttcccccgtcggcccctaccccttcccgtaccaaacggccgtaccctacccgttcgggccggggaccaaccgtacgcccacgggtccccggttgggtcccctcgacccgttacgggtacccgtaacggttacttacccttaccgaacggttacgcgttacgcggtaggtcggggcgtaccggtggaaccggaacggtccgctaaagtgccngacgnnnnnnnnnnnnnnngncnnnnnnnnnnnnnnn

SEQ ID NO: 185858 - DNA, 562 bp, Homo sapiens
  misc_feature: GYAE6OF01BO5O3.30.68.G02.1.454.CMB.1.raw
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (335)..(335): a, c, t, g, unknown or other
  misc_feature (335)..(335): n is a, c, g, or t
  modified_base (530)..(548): a, c, t, g, unknown or other
  misc_feature (530)..(548): n is a, c, g, or t
  modified_base (550)..(562): a, c, t, g, unknown or other
  misc_feature (550)..(562): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaaggccggttcaccatctccagggacagttcgaagaacacactgtttctgcaaatgaacagcctgagagtcgaggacacggccgtatattactgtgcgtctttcaccctggagtgggaattacgaggcatctccacacgtggggccgggcacccgtggtcgagcgtctccncncgccctccacccgaagggccctacgttccggttccctttcccccgnggtccctaacccctccctaccgaaacggccgtaccctcccttcggtacgggggccaacgaacgccaacgggccccgttgggcctcggtccgtcgggtaccgaaaggtaccttacctaccgtaccgtaacgggcgttacggcttacggacgggtcgggacgttacgggaccgaagggtcccgactaaggtgcagtnnnnnnnnnnnnnnnnnnngnnnnnnnnnnnnn

SEQ ID NO: 185859 - DNA, 606 bp, Homo sapiens
  misc_feature: GYAE6OF01AP6S8.30.68.G02.1.454.CMB.1.raw
  modified_base (108)..(108): a, c, t, g, unknown or other
  misc_feature (108)..(108): n is a, c, g, or t
  modified_base (159)..(159): a, c, t, g, unknown or other
  misc_feature (159)..(159): n is a, c, g, or t
  modified_base (205)..(205): a, c, t, g, unknown or other
  misc_feature (205)..(205): n is a, c, g, or t
  modified_base (358)..(358): a, c, t, g, unknown or other
  misc_feature (358)..(358): n is a, c, g, or t
  modified_base (538)..(538): a, c, t, g, unknown or other
  misc_feature (538)..(538): n is a, c, g, or t
  modified_base (548)..(549): a, c, t, g, unknown or other
  misc_feature (548)..(549): n is a, c, g, or t
  modified_base (552)..(553): a, c, t, g, unknown or other
  misc_feature (552)..(553): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (567)..(567): a, c, t, g, unknown or other
  misc_feature (567)..(567): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (589)..(589): a, c, t, g, unknown or other
  misc_feature (589)..(589): n is a, c, g, or t
  modified_base (605)..(605): a, c, t, g, unknown or other
  misc_feature (605)..(605): n is a, c, g, or t
tcagcacgctacgtcacgaccggtgctcgatttagtcgatagtgaagggaaaggggcgtggaatgggtcgtcaagtattgctggtagtggtgatagcacatactacgnagccatcgtgaaggccggttcaccatctcaggcagttcgaagaacacagtntttgtgacaatagaacagcctgagagtcgagacgacggccgtaatnttacgtgcgtcgctttccaccgtgggatagggtgttaacaggaccagtaccttccaccgacggtcgggaccggccgtaccgtcgtcgagccgtccgtcctagtccgcctaccgaccgacggaccgcgttcccgtccgttccccgaggttcccncccttacccgtctaaacggctccaccgtcgggacgggtccacgacgccggtaaccccggtaggcccgaggtcctgggtaccctaaaccggacttttacccgtaccggtacgtaccgtcggtccgtcggaacgggtcgggaaccgggtcggtcgaaccggtcggacgttaccgcgtggtcncgttagcgtnngcnngngngtcgtgcgcncgagngngacgtgngngcgtcngacagtgtcgatgcgnc

SEQ ID NO: 185860 - DNA, 461 bp, Homo sapiens
  misc_feature: GYAE6OF01ADEXE.30.68.G02.1.454.CMB.1.raw
  modified_base (431)..(431): a, c, t, g, unknown or other
  misc_feature (431)..(431): n is a, c, g, or t
  modified_base (446)..(446): a, c, t, g, unknown or other
  misc_feature (446)..(446): n is a, c, g, or t
  modified_base (450)..(450): a, c, t, g, unknown or other
  misc_feature (450)..(450): n is a, c, g, or t
  modified_base (452)..(461): a, c, t, g, unknown or other
  misc_feature (452)..(461): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggcccgggcacccgtggtcagcgtctcctcacgccctccaccgaagggccccatccggtccttcccccgtggcccaccctcctcccgaagacgccacctcgtcgggggaccacgacgcacgcccgtgggcctcggcctggtcaaggtacctactccgacgtgcgtgctgngcgggctggcaggcngtangnnnnnnnnnn

SEQ ID NO: 185861 - DNA, 510 bp, Homo sapiens
  misc_feature: GYAE6OF01CI9UO.30.68.G02.1.454.CMB.1.raw
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
  modified_base (361)..(361): a, c, t, g, unknown or other
  misc_feature (361)..(361): n is a, c, g, or t
  modified_base (452)..(452): a, c, t, g, unknown or other
  misc_feature (452)..(452): n is a, c, g, or t
  modified_base (470)..(470): a, c, t, g, unknown or other
  misc_feature (470)..(470): n is a, c, g, or t
  modified_base (475)..(476): a, c, t, g, unknown or other
  misc_feature (475)..(476): n is a, c, g, or t
  modified_base (480)..(485): a, c, t, g, unknown or other
  misc_feature (480)..(485): n is a, c, g, or t
  modified_base (487)..(489): a, c, t, g, unknown or other
  misc_feature (487)..(489): n is a, c, g, or t
  modified_base (491)..(496): a, c, t, g, unknown or other
  misc_feature (491)..(496): n is a, c, g, or t
  modified_base (498)..(510): a, c, t, g, unknown or other
  misc_feature (498)..(510): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtcgcgtctttcacccgtggagtgggtagttacgagcatacttccaccgcggtcggggccgggacctaccgtcgtcgacgtccgtcctccncncgccctaccaccgaacggccagtccgtccttccccgnggcccnccctcctacacgacnccaccgtcgtgggccacgcgcacgccgtcggctcgcgtcgcaacgctactccgacgtacgcgttcgcgtggacggtccggagtcggaacgnggtcccgagtagtgctgntgagnngacnnnnnngnnngnnnnnngnnnnnnnnnnnnn

SEQ ID NO: 185862 - DNA, 642 bp, Homo sapiens
  misc_feature: GYAE6OF01BMCUR.30.68.G02.1.454.CMB.1.raw
  modified_base (597)..(598): a, c, t, g, unknown or other
  misc_feature (597)..(598): n is a, c, g, or t
  modified_base (600)..(602): a, c, t, g, unknown or other
  misc_feature (600)..(602): n is a, c, g, or t
  modified_base (610)..(610): a, c, t, g, unknown or other
  misc_feature (610)..(610): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
  modified_base (616)..(617): a, c, t, g, unknown or other
  misc_feature (616)..(617): n is a, c, g, or t
  modified_base (619)..(642): a, c, t, g, unknown or other
  misc_feature (619)..(642): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccgagggacagttcgaaagaacacacttgtttctgacaaaatgaacagcctggagaggtcggaggaccgaccggtccgttaattattacgtggtcgtcgtcctttccacccgtgggagtggggagttaacgaggctacttaccttaccaccgtacggtcgggggcccggggcctacccgtggtccacgtccgtcctacctcgaccgcccctacccgaacccgaacgggcccctacggttcccggttcccttcccccggtcggccctacccctccctaccaacggcgcctacccggtcgggtcggggaccacgacgctacggtcccgtaggggtcctcggtcccggttcgggtaaccgtaacgggtacccttaccgttacccgtacgggttacggtccggtcggtacggtcgggtacgggtccggggtacggtcgggtacggaacgggcggacgtacgtacgnngnnntttttttncngncnncnnnnnnnnnnnnnnnnnnnnnnnn

SEQ ID NO: 185863 - DNA, 667 bp, Homo sapiens
  misc_feature: GYAE6OF01CGOJR.30.68.G02.1.454.CMB.1.raw
  modified_base (636)..(667): a, c, t, g, unknown or other
  misc_feature (636)..(667): n is a, c, g, or t
tcagcacgctacgtcacgaccggtgctcgatttagtcgatagtgaagggaaagggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgtctttccacccgtgggaggtagggtacgttaacgaggcacttacctccaccgacggtcgggggcccggggccctacccgtcggtaccgacggtccggtcctacccgtccgacgtacccccgtaccccaacccggtaaccgggcccccgtaacgtttccccgggtttcccccttacccccccggtccgggtaccccctaacccccttaccccgtacccgtaaacggaccggtacccctaaccccggttccgggtacggggggtaccaacccgcggacccgaccggtcccggtcgggccgtcggtcccgtacgggtaccgaaacggtacccgttacccgttacccgtaacggtacggtccgacggtcgacggggacggcggggtcgtacgggaccgtaacgggccctaggtacgagctacgnnnnnnnnnnnnnnnnnnnnnnnnnnnnnnnn

SEQ ID NO: 185864 - DNA, 675 bp, Homo sapiens
  misc_feature: GYAE6OF01DUXPC.30.68.G02.1.454.CMB.1.raw
  modified_base (600)..(600): a, c, t, g, unknown or other
  misc_feature (600)..(600): n is a, c, g, or t
  modified_base (621)..(621): a, c, t, g, unknown or other
  misc_feature (621)..(621): n is a, c, g, or t
  modified_base (642)..(643): a, c, t, g, unknown or other
  misc_feature (642)..(643): n is a, c, g, or t
  modified_base (645)..(675): a, c, t, g, unknown or other
  misc_feature (645)..(675): n is a, c, g, or t
tcagcacgctacgtcacgaccggtgctcgatttagtcgatagtgaaggggaaaggggctgggaatgggtctcaagttattgctggtagtggtgatgcacatacacgcagccatcgtgagggccgttcaccatctccgagggacaggttacgaaagaacactacttgttttcagactaaatgaacacgctgagagtcgaaggaccgacggcttattattacgtgtcgcttaccttcgaaccggtgggacgtagggtaactaacgacgtctacttacctaccgaccgtacggggtccgggggcccgggcctaacccgggtgtaccgtacggtccgttaccgtccgccgtaaccgccccgtaacccggaacccgggaacccggccccgttaccgtttccccgggtttaccccccgtacccccggtaccggtacccctaaccccgtttacccgaaccgaaaaccgtccccgggtcccttaaccgggttcccggggtacgggaaccaaccgccgggaccctacccgggtccggtcggggtctcccggtaccggtacggtaacccaacggttaccttacccggttaccgtaggtcgtccggtacgnggacgggtcggcgggttacgnggaacgtcggctagtaggcanngnnnnnnnnnnnnnnnnnnnnnnnnnnnnnnn

SEQ ID NO: 185865 - DNA, 691 bp, Homo sapiens
  misc_feature: GYAE6OF01DSTW5.30.68.G02.1.454.CMB.1.raw
  modified_base (644)..(644): a, c, t, g, unknown or other
  misc_feature (644)..(644): n is a, c, g, or t
  modified_base (650)..(650): a, c, t, g, unknown or other
  misc_feature (650)..(650): n is a, c, g, or t
  modified_base (656)..(656): a, c, t, g, unknown or other
  misc_feature (656)..(656): n is a, c, g, or t
  modified_base (660)..(663): a, c, t, g, unknown or other
  misc_feature (660)..(663): n is a, c, g, or t
  modified_base (665)..(665): a, c, t, g, unknown or other
  misc_feature (665)..(665): n is a, c, g, or t
  modified_base (667)..(667): a, c, t, g, unknown or other
  misc_feature (667)..(667): n is a, c, g, or t
  modified_base (670)..(672): a, c, t, g, unknown or other
  misc_feature (670)..(672): n is a, c, g, or t
  modified_base (674)..(675): a, c, t, g, unknown or other
  misc_feature (674)..(675): n is a, c, g, or t
  modified_base (677)..(682): a, c, t, g, unknown or other
  misc_feature (677)..(682): n is a, c, g, or t
  modified_base (684)..(688): a, c, t, g, unknown or other
  misc_feature (684)..(688): n is a, c, g, or t
  modified_base (690)..(691): a, c, t, g, unknown or other
  misc_feature (690)..(691): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaaggccgttcaccatctccagggacagttcgaagaacacacttgtttctgacaaatgaacagcctgagagtcgaggacacggccgtaatattactgtgcgtctttcaccgtggagtgggattacgaacggctaactaccttccaaccgtacggtcgggggcccgggcctacccgttggaccggtagtccggttcctccgtaccgaccgcccctacccgaaacccggaacgggtcccctaagttcccgggtttacccccttaccccccgcggtaacccccttacccccgttacccctaacccgtaaaccggacgtaccccgtaccccggttcggggtaccgggggacccaaccggacggtacccgaaccgggttccccggtggggtaccctcgggtacccggttacgggtaaccgtaaacggttaccctttaaccgttacccgtaacggttacggccggttggtacctaacgggggcgggttacccggggacttacggggcgtaaaccgggctacgtaaagttggaccngtaacngatgcngcannnngngngcnnncnngnnnnnncnnnnngnn

SEQ ID NO: 185866 - DNA, 589 bp, Homo sapiens
  misc_feature: GYAE6OF01AXEWD.30.68.G02.1.454.CMB.1.raw
  modified_base (298)..(298): a, c, t, g, unknown or other
  misc_feature (298)..(298): n is a, c, g, or t
  modified_base (306)..(306): a, c, t, g, unknown or other
  misc_feature (306)..(306): n is a, c, g, or t
  modified_base (414)..(414): a, c, t, g, unknown or other
  misc_feature (414)..(414): n is a, c, g, or t
  modified_base (488)..(488): a, c, t, g, unknown or other
  misc_feature (488)..(488): n is a, c, g, or t
  modified_base (536)..(536): a, c, t, g, unknown or other
  misc_feature (536)..(536): n is a, c, g, or t
  modified_base (540)..(540): a, c, t, g, unknown or other
  misc_feature (540)..(540): n is a, c, g, or t
  modified_base (545)..(545): a, c, t, g, unknown or other
  misc_feature (545)..(545): n is a, c, g, or t
  modified_base (548)..(549): a, c, t, g, unknown or other
  misc_feature (548)..(549): n is a, c, g, or t
  modified_base (553)..(553): a, c, t, g, unknown or other
  misc_feature (553)..(553): n is a, c, g, or t
  modified_base (556)..(556): a, c, t, g, unknown or other
  misc_feature (556)..(556): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
  modified_base (564)..(564): a, c, t, g, unknown or other
  misc_feature (564)..(564): n is a, c, g, or t
  modified_base (566)..(567): a, c, t, g, unknown or other
  misc_feature (566)..(567): n is a, c, g, or t
  modified_base (569)..(570): a, c, t, g, unknown or other
  misc_feature (569)..(570): n is a, c, g, or t
  modified_base (572)..(576): a, c, t, g, unknown or other
  misc_feature (572)..(576): n is a, c, g, or t
  modified_base (578)..(580): a, c, t, g, unknown or other
  misc_feature (578)..(580): n is a, c, g, or t
  modified_base (584)..(584): a, c, t, g, unknown or other
  misc_feature (584)..(584): n is a, c, g, or t
  modified_base (586)..(588): a, c, t, g, unknown or other
  misc_feature (586)..(588): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctcagggacagttcgaagaacacacttgttctgacaaatgaacagcctgagagtcgaggacgacggtaccgtattattactgtgcgtctttccacccgtggacgtgggtaacgttacgaaggctagtaccttaccaccgacggtcgggggccggcacccgtggcncgcgtccncctcgacgccctaccaccgaacggcccctagttcccggtcccttccccgcggacccaccccttcctaccgaaacggctacccgacccgtttcggacgggcctaaccgngaccgacgccccggttaggccgttacgcccgttacggacaaaccgggtccttaccgtaccacgggtactacggngtacgttcgggacggccggggaactggacgttaaacggccgaataagnggcngactnatnntcancgngntngngncnncnnannnnncnnnacancnnnc

SEQ ID NO: 185867 - DNA, 527 bp, Homo sapiens
  misc_feature: GYAE6OF01DVN74.30.68.G02.1.454.CMB.1.raw
  modified_base (211)..(211): a, c, t, g, unknown or other
  misc_feature (211)..(211): n is a, c, g, or t
  modified_base (214)..(214): a, c, t, g, unknown or other
  misc_feature (214)..(214): n is a, c, g, or t
  modified_base (242)..(242): a, c, t, g, unknown or other
  misc_feature (242)..(242): n is a, c, g, or t
  modified_base (323)..(323): a, c, t, g, unknown or other
  misc_feature (323)..(323): n is a, c, g, or t
  modified_base (486)..(486): a, c, t, g, unknown or other
  misc_feature (486)..(486): n is a, c, g, or t
  modified_base (493)..(493): a, c, t, g, unknown or other
  misc_feature (493)..(493): n is a, c, g, or t
  modified_base (495)..(496): a, c, t, g, unknown or other
  misc_feature (495)..(496): n is a, c, g, or t
  modified_base (499)..(504): a, c, t, g, unknown or other
  misc_feature (499)..(504): n is a, c, g, or t
  modified_base (508)..(512): a, c, t, g, unknown or other
  misc_feature (508)..(512): n is a, c, g, or t
  modified_base (515)..(519): a, c, t, g, unknown or other
  misc_feature (515)..(519): n is a, c, g, or t
  modified_base (521)..(527): a, c, t, g, unknown or other
  misc_feature (521)..(527): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaggccgttcaccatctcgagggtacagttcgaagaactacactgtttctgacaaatgaacagcctgagaggtcgagacgacggccgtatattacngtncgtcttcacccgtggagtggatacgagnatctccacagtcgggccggcaccgtgtcagtctctcctacagccctccgaccgaacggccctagtccggttccctccccgnggccctcccgtcctaccgaagacgccaaccgtcggtcgggcacacgcacggcccgtcgggctcggtcgtacgggactaacgggtacctaccgtttcgacgttacggcgtacgctacgggcgccggggtctcgggagaaccgggtcgaagttagtacgcgattnatctacnannctnnnnnncgcnnnnngannnnntnnnnnnn

SEQ ID NO: 185868 - DNA, 756 bp, Homo sapiens
  misc_feature: GYAE6OF01BRXY3.30.68.G02.1.454.CMB.1.raw
  modified_base (642)..(642): a, c, t, g, unknown or other
  misc_feature (642)..(642): n is a, c, g, or t
  modified_base (655)..(655): a, c, t, g, unknown or other
  misc_feature (655)..(655): n is a, c, g, or t
  modified_base (659)..(659): a, c, t, g, unknown or other
  misc_feature (659)..(659): n is a, c, g, or t
  modified_base (673)..(673): a, c, t, g, unknown or other
  misc_feature (673)..(673): n is a, c, g, or t
tcagcacgctacgtcacgaccggtgctcgatttagtcgatagtgaagggaaaggggctggaatgggtctcaagtattgctggtagtggtgatagcacatactacgcagccatcgtagaaggccgtcaccatcctcgaggactagtcgaagaacacacttgtttcacgactaaatgacacgcgtagagtagtacggaaggacgaccggtctaatacttcgtgtcgtaccgttctttaccgccggtaggacgggttagggtaacgtttaacgaacggtcctaaaccttaaccgttcccgaaccggtacggggtccgggggcccggaccgttaccggtcggacgttaccgcccggtttcctaccctacggacccttaccccgtaccgaacccggtaacccgggtaccctcggtttccccggtcccccttaccccggtacgtaccccaaccccgttccaaccaacggtacctcccgtaccggtcgggaacggtccaacggctcggtaccgccggtcggtaccgtccggacgttaggtaaccctaacggttcccctttaacccggttaacgacgggtccgttagaccgttacgggtacggacgggtccggttacgtaacgggacgtaacgggtcctacgtaaggccngtaacgctaacgngacncgttacgcttaacncgttaacggaccttctacgacgtcgtcgacgtacgacggtacgtgtcgcgtctacgtacgtacgacgagtcgtcgtacgtacg

SEQ ID NO: 185869 - DNA, 585 bp, Homo sapiens
  misc_feature: GYAE6OF01DG546.30.68.G02.1.454.CMB.1.raw
  modified_base (130)..(130): a, c, t, g, unknown or other
  misc_feature (130)..(130): n is a, c, g, or t
  modified_base (433)..(433): a, c, t, g, unknown or other
  misc_feature (433)..(433): n is a, c, g, or t
  modified_base (557)..(560): a, c, t, g, unknown or other
  misc_feature (557)..(560): n is a, c, g, or t
  modified_base (562)..(585): a, c, t, g, unknown or other
  misc_feature (562)..(585): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccgttcacntctccagggacagttcgaagaacacactgtttctgacaatgaacagctgagagtcggaggacacggccgtatattactgtcgctctttcacccgtggaggttgggagttacgaacggtctactaccttccacgacggtcggggcccgggacgacccgtgtcgacgtccgtcctaccctcgacgtcccctcccaaccggaccgggacccctcgtacccgggtttcccttcccccgtaccggccctaccccgtccctaccgaacgtacgcctaacccgtcggtcgggggaccaccgaacggaccncggtaccccgtggggtccctcggtacccgtcggtaaccgaaacggtccttaacccgttaccgtaacggtgccgttagtccgtggggacggcggggtccgtaggaccgtaagcgaccgtagacgnnnncnnnnnnnnnnnnnnnnnnnnnnnn

SEQ ID NO: 185870 - DNA, 713 bp, Homo sapiens
  misc_feature: GYAE6OF01CYW00.30.68.G02.1.454.CMB.1.raw
  modified_base (131)..(131): a, c, t, g, unknown or other
  misc_feature (131)..(131): n is a, c, g, or t
  modified_base (682)..(689): a, c, t, g, unknown or other
  misc_feature (682)..(689): n is a, c, g, or t
  modified_base (691)..(700): a, c, t, g, unknown or other
  misc_feature (691)..(700): n is a, c, g, or t
  modified_base (702)..(713): a, c, t, g, unknown or other
  misc_feature (702)..(713): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccgttcaccntctccagggacagttcgaaagaacacacttgtttctgacaaatgaaacagcctgagagtcggagggaccacgggccgttaatattactgtcgcctccttttacccgacccgttgggaggtggggtaacgttaacgaaggcctaacttaccttcccgacccgacgggtcggggggccccggggtcacccggttcggtacacggtccgtacctcccgtacgaccgtcccctacccccgaaacccggtaaccggggtaccccctacgggttccccggtttcccccgtttcccccccggtacgggccccccttaacccccgttcccttaaaccccggaaaaccggtacccggccccgtaaccccggtttccgggaccggggggtaccaccgaacggtaccccgaccggtaccccggttcggggccgttccggacccggtttagggacccgtaaaaccggttacccgtttacccgttaccgaccgggttacggccggttacgccgtacgggtacggccggggcgtacgggacgtacggcgacgtagtacgcgcgannnnnnnntnnnnnnnnnngnnnnnnnnnnnn

SEQ ID NO: 185871 - DNA, 690 bp, Homo sapiens
  misc_feature: GYAE6OF01ECSHT.30.68.G02.1.454.CMB.1.raw
  modified_base (179)..(179): a, c, t, g, unknown or other
  misc_feature (179)..(179): n is a, c, g, or t
  modified_base (220)..(220): a, c, t, g, unknown or other
  misc_feature (220)..(220): n is a, c, g, or t
  modified_base (620)..(620): a, c, t, g, unknown or other
  misc_feature (620)..(620): n is a, c, g, or t
  modified_base (634)..(634): a, c, t, g, unknown or other
  misc_feature (634)..(634): n is a, c, g, or t
  modified_base (640)..(640): a, c, t, g, unknown or other
  misc_feature (640)..(640): n is a, c, g, or t
  modified_base (645)..(646): a, c, t, g, unknown or other
  misc_feature (645)..(646): n is a, c, g, or t
  modified_base (650)..(651): a, c, t, g, unknown or other
  misc_feature (650)..(651): n is a, c, g, or t
  modified_base (653)..(654): a, c, t, g, unknown or other
  misc_feature (653)..(654): n is a, c, g, or t
  modified_base (668)..(669): a, c, t, g, unknown or other
  misc_feature (668)..(669): n is a, c, g, or t
  modified_base (674)..(674): a, c, t, g, unknown or other
  misc_feature (674)..(674): n is a, c, g, or t
  modified_base (684)..(684): a, c, t, g, unknown or other
  misc_feature (684)..(684): n is a, c, g, or t
  modified_base (686)..(686): a, c, t, g, unknown or other
  misc_feature (686)..(686): n is a, c, g, or t
  modified_base (688)..(688): a, c, t, g, unknown or other
  misc_feature (688)..(688): n is a, c, g, or t
tcagcacgctacgtcacgaccggtgctcgatttagtcgatagtgaagggaaagggctggaatgggtctcaagtattgctggtagtggtgatagcacatactacgcagccatcgtgaacgggccgttcaccatctccagggacagttcgaagaacacacttgtttcagacaaatcgaacncgcctagagagtcgaagaccgacggaccgttaatattacgngtcgcgtctttccgaccgtggagtcggtaacttacgaagactacttactaccgaccgtaggtccggggtcccggacctacccgtggtacgacgtcgttaccctccgtacaaccgtccccgttaaccgaacccggaacggtaccccctaaggttccccggtttaccccgttttcccccggagaccccttaccccgttactaacccgtaaaggaccgtaccgtaccccggttcggacccggggaactaaccggcgtaccggaacccgtcccggtaggttcccacgggttccctaggggtaaccaaacggttcctaacgttaccggtaacggtacgtccggttacgacgtaccgggaggttccgggtacgtacgaacgaaagggccctaaggtactaggacgngatacgcgagtccngacgtnacgtnnagannannacgcgcgtagcganncacanagacacgacncngngc

SEQ ID NO: 185872 - DNA, 578 bp, Homo sapiens
  misc_feature: GYAE6OF01D5HPV.30.68.G02.1.454.CMB.1.raw
  modified_base (213)..(213): a, c, t, g, unknown or other
  misc_feature (213)..(213): n is a, c, g, or t
  modified_base (471)..(471): a, c, t, g, unknown or other
  misc_feature (471)..(471): n is a, c, g, or t
  modified_base (502)..(502): a, c, t, g, unknown or other
  misc_feature (502)..(502): n is a, c, g, or t
  modified_base (518)..(518): a, c, t, g, unknown or other
  misc_feature (518)..(518): n is a, c, g, or t
  modified_base (529)..(529): a, c, t, g, unknown or other
  misc_feature (529)..(529): n is a, c, g, or t
  modified_base (531)..(532): a, c, t, g, unknown or other
  misc_feature (531)..(532): n is a, c, g, or t
  modified_base (534)..(535): a, c, t, g, unknown or other
  misc_feature (534)..(535): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (544)..(544): a, c, t, g, unknown or other
  misc_feature (544)..(544): n is a, c, g, or t
  modified_base (547)..(547): a, c, t, g, unknown or other
  misc_feature (547)..(547): n is a, c, g, or t
  modified_base (551)..(551): a, c, t, g, unknown or other
  misc_feature (551)..(551): n is a, c, g, or t
  modified_base (556)..(556): a, c, t, g, unknown or other
  misc_feature (556)..(556): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
  modified_base (566)..(567): a, c, t, g, unknown or other
  misc_feature (566)..(567): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
  modified_base (573)..(574): a, c, t, g, unknown or other
  misc_feature (573)..(574): n is a, c, g, or t
  modified_base (576)..(576): a, c, t, g, unknown or other
  misc_feature (576)..(576): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccaggggacagttcgaagaacacactgtttctgcaaatgaacagcctgcgagtccgaggacacggaccgtatattacncggttgcgtctttcaccctggagtgggagttacaggcactacttccaccacgtcgggggtccggggccacccgtggtccgagtccggtctccgtccaacggtccctacccaccgaacggccccaacgttccggtccctttcccccgtcggcccaccccgtcctaccaaagtacgccaaccgttcgtacgggggccacgacgcgacgcccgtcgggactcggcgtcgtacgacggtactaacttccacgtacgcgtacncgttagcggcgggcctcgggcaaacggggcnccgaagttacggactnaggtcagctgncnncnncnancgtanctntcgncgcanancncncgannanancnncncg

SEQ ID NO: 185873 - DNA, 694 bp, Homo sapiens
  misc_feature: GYAE6OF01BU2XX.30.68.G02.1.454.CMB.1.raw
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
  modified_base (306)..(306): a, c, t, g, unknown or other
  misc_feature (306)..(306): n is a, c, g, or t
  modified_base (643)..(644): a, c, t, g, unknown or other
  misc_feature (643)..(644): n is a, c, g, or t
  modified_base (647)..(647): a, c, t, g, unknown or other
  misc_feature (647)..(647): n is a, c, g, or t
  modified_base (652)..(653): a, c, t, g, unknown or other
  misc_feature (652)..(653): n is a, c, g, or t
  modified_base (655)..(655): a, c, t, g, unknown or other
  misc_feature (655)..(655): n is a, c, g, or t
  modified_base (659)..(659): a, c, t, g, unknown or other
  misc_feature (659)..(659): n is a, c, g, or t
  modified_base (661)..(661): a, c, t, g, unknown or other
  misc_feature (661)..(661): n is a, c, g, or t
  modified_base (663)..(663): a, c, t, g, unknown or other
  misc_feature (663)..(663): n is a, c, g, or t
  modified_base (668)..(668): a, c, t, g, unknown or other
  misc_feature (668)..(668): n is a, c, g, or t
  modified_base (675)..(675): a, c, t, g, unknown or other
  misc_feature (675)..(675): n is a, c, g, or t
  modified_base (677)..(677): a, c, t, g, unknown or other
  misc_feature (677)..(677): n is a, c, g, or t
  modified_base (680)..(683): a, c, t, g, unknown or other
  misc_feature (680)..(683): n is a, c, g, or t
  modified_base (685)..(685): a, c, t, g, unknown or other
  misc_feature (685)..(685): n is a, c, g, or t
  modified_base (687)..(689): a, c, t, g, unknown or other
  misc_feature (687)..(689): n is a, c, g, or t
  modified_base (692)..(693): a, c, t, g, unknown or other
  misc_feature (692)..(693): n is a, c, g, or t
tcagcacgctacgtcacgaccggtgctcgattttagtcgatagtgaagggaaaggggctggaatgggtctcaagtattgctggtagtggtgatagcacatactacgcagccattcgtgaagggccggttcaccatctccagggacagttcgaagaacacacttgtttctgcaaatgaacagcctgagacgtcgaggacacggcgttatattactgtgctcttttccaccgtgagtgggagtacaggcactactcccacacggtcgggggaccgggcncccgttgggtccnggtccgtcctcctacncggtcccctaccccgacccgaacgggtccccgaacgttccggtttccccttccccccggtcgggtaccctaccccccgttacccctacccgaacggttaacggcccgtaaccccggtttcgggccgggggggttaccaaccggaggaccccggaaccgggcccccggttcgggtacccgttcccggtccggtttacccgggtaaaccggaccggttaaccccctttaacccgttaccgttacccgggttaccggggtccgttcgggtacgttaaaccgggcggggtccggggccgttgggaacccgacgggtacgccgtaaaccggtgatcgccgtnncgngcgcnncncgtncncncgctncgtgcgncngcnnnncncnnnctnnc

SEQ ID NO: 185874 - DNA, 702 bp, Homo sapiens
  misc_feature: GYAE6OF01E4UM1.30.68.G02.1.454.CMB.1.raw
  modified_base (168)..(168): a, c, t, g, unknown or other
  misc_feature (168)..(168): n is a, c, g, or t
  modified_base (631)..(631): a, c, t, g, unknown or other
  misc_feature (631)..(631): n is a, c, g, or t
  modified_base (635)..(635): a, c, t, g, unknown or other
  misc_feature (635)..(635): n is a, c, g, or t
  modified_base (642)..(642): a, c, t, g, unknown or other
  misc_feature (642)..(642): n is a, c, g, or t
  modified_base (649)..(649): a, c, t, g, unknown or other
  misc_feature (649)..(649): n is a, c, g, or t
  modified_base (654)..(654): a, c, t, g, unknown or other
  misc_feature (654)..(654): n is a, c, g, or t
  modified_base (658)..(658): a, c, t, g, unknown or other
  misc_feature (658)..(658): n is a, c, g, or t
  modified_base (661)..(661): a, c, t, g, unknown or other
  misc_feature (661)..(661): n is a, c, g, or t
  modified_base (663)..(663): a, c, t, g, unknown or other
  misc_feature (663)..(663): n is a, c, g, or t
  modified_base (671)..(671): a, c, t, g, unknown or other
  misc_feature (671)..(671): n is a, c, g, or t
  modified_base (675)..(675): a, c, t, g, unknown or other
  misc_feature (675)..(675): n is a, c, g, or t
  modified_base (680)..(680): a, c, t, g, unknown or other
  misc_feature (680)..(680): n is a, c, g, or t
  modified_base (684)..(684): a, c, t, g, unknown or other
  misc_feature (684)..(684): n is a, c, g, or t
  modified_base (694)..(694): a, c, t, g, unknown or other
  misc_feature (694)..(694): n is a, c, g, or t
  modified_base (699)..(699): a, c, t, g, unknown or other
  misc_feature (699)..(699): n is a, c, g, or t
tcagcacgctacgtcacgaccggtgctcgatttagtcgatagtgaagggaaaggggctggaatgggtctcaagtattgctggtagtggtgatagcacatactacgcagccatcgtggaagggccgttcaccatctccgagggacagttcgaagaacacacttgtttcncgacaatcgaacagtcctggagacgtacggaggtacgaccggtacggttatattacgtgtacgcgttacttacgacccgtggtaggtagggtacgtacgacggtactacttacctaccaccgacggtcggggggacccggtacctaccggtgggtactacggtccgtcctaccgtaccgaccgtccctaccgaaccggtaccgggtcctaccgttccggttaccctccccgggtaccgaccctaccccttaccgaaccgtaacggacccgtcccttaacccggtcgggggtaccgggaccaaccgtacgggaaccctccggggtcccgtacggggttccgtaccgttcccggttaagtaccccggtaaaccggttaccgtacccgttaccgtaacgggtccgtacgttccggacgtagggacccggtgggtaccgtcggacgacgggtaccaacgtcgagtcngacntcgctancgttacnactcngcancgntnacgcagtnacgntcgancgtncgatcgaccnacggnttc

SEQ ID NO: 185875 - DNA, 711 bp, Homo sapiens
  misc_feature: GYAE6OF01CJLRR.30.68.G02.1.454.CMB.1.raw
  modified_base (181)..(181): a, c, t, g, unknown or other
  misc_feature (181)..(181): n is a, c, g, or t
  modified_base (661)..(661): a, c, t, g, unknown or other
  misc_feature (661)..(661): n is a, c, g, or t
  modified_base (675)..(675): a, c, t, g, unknown or other
  misc_feature (675)..(675): n is a, c, g, or t
  modified_base (677)..(677): a, c, t, g, unknown or other
  misc_feature (677)..(677): n is a, c, g, or t
  modified_base (682)..(682): a, c, t, g, unknown or other
  misc_feature (682)..(682): n is a, c, g, or t
  modified_base (684)..(690): a, c, t, g, unknown or other
  misc_feature (684)..(690): n is a, c, g, or t
  modified_base (693)..(694): a, c, t, g, unknown or other
  misc_feature (693)..(694): n is a, c, g, or t
  modified_base (696)..(699): a, c, t, g, unknown or other
  misc_feature (696)..(699): n is a, c, g, or t
  modified_base (702)..(702): a, c, t, g, unknown or other
  misc_feature (702)..(702): n is a, c, g, or t
  modified_base (704)..(704): a, c, t, g, unknown or other
  misc_feature (704)..(704): n is a, c, g, or t
  modified_base (706)..(707): a, c, t, g, unknown or other
  misc_feature (706)..(707): n is a, c, g, or t
  modified_base (709)..(709): a, c, t, g, unknown or other
  misc_feature (709)..(709): n is a, c, g, or t
  modified_base (711)..(711): a, c, t, g, unknown or other
  misc_feature (711)..(711): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaaggccgtcaccatctccgagggacagttcgaaagaacacacttcgtttctgacaaatgaaaccncgtcctagacggtagacggaacggaccacgggtacccttaaattaacgttaccgtggttcgtccgttacccgttttaccgacccggttaggggtagggtttaggggtaaacgttaaccgaagggtaccttaacgtttaaacccctttccgaacccggttaacgggtcccgggggggacccgggtaacccctacccggtcggttaccgacggtcccttaccgtcccgttaacgtcccgacccctaccgaaaccccggtaacgggcccctaacggttccccggttacccttccccccgagaccctaccccttccgaccgaagcctcccgtaccttcggggaccggtaccacgaccgcgaaccggtcccggtggacctcggtcccgtaacggaccgaaaacggttccttacccgtacgaacgtccggtacgtcgtcggacggacggtcggacgtacggagtaacggcttaggactagcctagngctagcgtaagcancncagcnannnnnnngcnncnnnncanananngngn

SEQ ID NO: 185876 - DNA, 709 bp, Homo sapiens
  misc_feature: GYAE6OF01B7FIF.30.68.G02.1.454.CMB.1.raw
  modified_base (636)..(636): a, c, t, g, unknown or other
  misc_feature (636)..(636): n is a, c, g, or t
  modified_base (674)..(674): a, c, t, g, unknown or other
  misc_feature (674)..(674): n is a, c, g, or t
  modified_base (676)..(677): a, c, t, g, unknown or other
  misc_feature (676)..(677): n is a, c, g, or t
  modified_base (679)..(709): a, c, t, g, unknown or other
  misc_feature (679)..(709): n is a, c, g, or t
tcagcacgctacgtcacgaccggtgctcgatttagtcgatagtgaagggaaaggggctggaatgggtctcaagtattgctggtagtggtgatagcacatactacgcagccattcgtgaagggccggttcaccatctccagggacagttcgaagaacacacttgtttctgacaaatcgaacagtcctgagagtcgaggaccgaccggtcgtattaacttacgtgtcgacgttctttacccacccgttagggtaggttcggggtaagtttacgaaacgggtctaacttaccctttaccccgaacccgtacccgggttcgggggggaccccggggtacccgtacccccggttcgggttaccgacggtccggttcccttacccgtcccgtaaccgcccccttaccccgaaacccgttaaccggggacccctaacggttcccggttcccccgttttcccccccggtacgggtcccccttaaaccccccttcccttaaacccggaaaacggtaccgtaccccgtacccggttacccgggttccgggggaaccctacgacgccgtaaccggcccggttacgggccgtcgtccgtacggtaccgaaacgtcccttacgtccctaacggttacgcggtctacggngggcgggcgggtcgcggaaccgacggtccagactacgncnncnnnnnnnnnnnnnnnnnnnnnnnnnnnnnnn

SEQ ID NO: 185877 - DNA, 549 bp, Homo sapiens
  misc_feature: GYAE6OF01BABYU.30.68.G02.1.454.CMB.1.raw
  modified_base (162)..(162): a, c, t, g, unknown or other
  misc_feature (162)..(162): n is a, c, g, or t
  modified_base (174)..(174): a, c, t, g, unknown or other
  misc_feature (174)..(174): n is a, c, g, or t
  modified_base (204)..(204): a, c, t, g, unknown or other
  misc_feature (204)..(204): n is a, c, g, or t
  modified_base (207)..(207): a, c, t, g, unknown or other
  misc_feature (207)..(207): n is a, c, g, or t
  modified_base (239)..(239): a, c, t, g, unknown or other
  misc_feature (239)..(239): n is a, c, g, or t
  modified_base (264)..(264): a, c, t, g, unknown or other
  misc_feature (264)..(264): n is a, c, g, or t
  modified_base (275)..(275): a, c, t, g, unknown or other
  misc_feature (275)..(275): n is a, c, g, or t
  modified_base (510)..(510): a, c, t, g, unknown or other
  misc_feature (510)..(510): n is a, c, g, or t
  modified_base (514)..(514): a, c, t, g, unknown or other
  misc_feature (514)..(514): n is a, c, g, or t
  modified_base (517)..(517): a, c, t, g, unknown or other
  misc_feature (517)..(517): n is a, c, g, or t
  modified_base (521)..(549): a, c, t, g, unknown or other
  misc_feature (521)..(549): n is a, c, g, or t
tcagcacgctacgtcacgaccggtgctcgatttagtcgatagtgaagggaaaggggctggaatgggtctcaagtattgctggtagtggtgatagcacatactacgcagccatcgtgagggccgttcacatctccagggacagttcgaagacacactgtttcngacaaatgaacngcctgagagtcgaggcacgcgtatattacngtngtccttcaccgtggagtgggtattacaaggcntactccacgagtcggggccgggccncccgtaggtcncgtcgtctcctcacgcctaccaccgtacggccctagtccgttcccttccccgtcggccctaccccgtctaccacgtcgaccctacgttacggccggggtaccaacgacgcaccggtcccgtggtctacggcgtcgggtttacgaacggttaccttacgtacccgtaacggttcgaaccgttcgacggtaggtaccgggcggttccgtagggtacgaacgggtcccgataacggtncganctnacgnnnnnnnnnnnnnnnnnnnnnnnnnnnnn

SEQ ID NO: 185878 - DNA, 688 bp, Homo sapiens
  misc_feature: GYAE6OF01ASURS.30.68.G02.1.454.CMB.1.raw
  modified_base (180)..(180): a, c, t, g, unknown or other
  misc_feature (180)..(180): n is a, c, g, or t
  modified_base (616)..(616): a, c, t, g, unknown or other
  misc_feature (616)..(616): n is a, c, g, or t
  modified_base (623)..(623): a, c, t, g, unknown or other
  misc_feature (623)..(623): n is a, c, g, or t
  modified_base (634)..(634): a, c, t, g, unknown or other
  misc_feature (634)..(634): n is a, c, g, or t
  modified_base (636)..(636): a, c, t, g, unknown or other
  misc_feature (636)..(636): n is a, c, g, or t
  modified_base (641)..(641): a, c, t, g, unknown or other
  misc_feature (641)..(641): n is a, c, g, or t
  modified_base (643)..(643): a, c, t, g, unknown or other
  misc_feature (643)..(643): n is a, c, g, or t
  modified_base (648)..(648): a, c, t, g, unknown or other
  misc_feature (648)..(648): n is a, c, g, or t
  modified_base (667)..(667): a, c, t, g, unknown or other
  misc_feature (667)..(667): n is a, c, g, or t
  modified_base (669)..(669): a, c, t, g, unknown or other
  misc_feature (669)..(669): n is a, c, g, or t
  modified_base (673)..(674): a, c, t, g, unknown or other
  misc_feature (673)..(674): n is a, c, g, or t
  modified_base (680)..(681): a, c, t, g, unknown or other
  misc_feature (680)..(681): n is a, c, g, or t
  modified_base (686)..(686): a, c, t, g, unknown or other
  misc_feature (686)..(686): n is a, c, g, or t
tcagcacgctacgtcacgaccggtgctcgatttagtcgatagtgaagggaaaggggctggaatgggtctcaagtattgctggtagtggtgatagcacatactacgcagccaatcgtggaagggccggttcaccatctccagggacagttcgaagaacacacttgtttctgcaaatgaacngcctgagagtcgaggacgacggtccgtatattactgtgcgtctttcaccctggagtgggacgttacgaagcacttactaccacctacggtcggggcccgggacctacccgtggtacgacgtccgtcctcccgtacaccgtccctacccgaaccgaaccggcccgtacgtcccggttcccgttcccccgtacggccctaccccttcccgtccgaacgtccgcccgtaacccgttcggtaccggggcctaaccgacgtaacccgaccggtcccgtacggggtccgtaccggtacccgttcgggaaaccgtaaaccggttaccgtttaacccgttacccggtaaccggttaaccgggttccgtacccgggtccgttacgggtaccggggtcccggggtaccgtacgggacccggtaacgggtccgtacgaggttacggncgcagcncgcgtacacgngngcgcncncgacngtgtctcgtcgcgtcgtancncacnnctctcnncgtgngc

SEQ ID NO: 185879 - DNA, 427 bp, Homo sapiens
  misc_feature: GYAE6OF02I4HNL.30.68.G02.1.454.CMB.1.raw
  modified_base (422)..(427): a, c, t, g, unknown or other
  misc_feature (422)..(427): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctggggcacagcagccctgggctgcctggtcaaggactactccacgtagcgtgctgagcgggctggcaaggcgcatagnnnnnn

SEQ ID NO: 185880 - DNA, 384 bp, Homo sapiens
  misc_feature: GYAE6OF02IAMF9.30.68.G02.1.454.CMB.1.raw
  modified_base (379)..(384): a, c, t, g, unknown or other
  misc_feature (379)..(384): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgcagtttattattgtcagcactataacaattggcctcggaaacttttggccaggggaccaagcttgagatcaaacgaactgtggctgcaccatctgtcttcatcttccgccatctgaacgtagcgtgctgagcgggctggcaaggcgcatagnnnnnn

SEQ ID NO: 185881 - DNA, 431 bp, Homo sapiens
  misc_feature: GYAE6OF02ITY3K.30.68.G02.1.454.CMB.1.raw
  modified_base (425)..(431): a, c, t, g, unknown or other
  misc_feature (425)..(431): n is a, c, g, or t
tcagcacgctacgtcacgaccggtgctcgatttagtcgatagtgaagggaaagggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggccaccctcctccaagagcacctctggggcacagcagccctgggctgcctggtcaaggactacttccacgtagcgtgctgagcgggctggcaaggcgcatagnnnnnnn

SEQ ID NO: 185882 - DNA, 433 bp, Homo sapiens
  misc_feature: GYAE6OF02GMIOQ.30.68.G02.1.454.CMB.1.raw
  modified_base (424)..(433): a, c, t, g, unknown or other
  misc_feature (424)..(433): n is a, c, g, or t
tcagcacgctacgtcacgaccggtgctcgatttagtcgatagtgaagggaaaggggcgtggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggatgggagttacaaggcatacttccaccactgggccggggcaccctggtcagcgtctcctcagcctccaccaagggcccatcggtcttccccctggcaccctcctccaagagcacctctggggcacagcagccctgggctgcctggtcaaggactacttccacgtagcgtgctgagcgggctggcaaggcgcatagnnnnnnnnnn

SEQ ID NO: 185883 - DNA, 433 bp, Homo sapiens
  misc_feature: GYAE6OF02G69R9.30.68.G02.1.454.CMB.1.raw
  modified_base (424)..(433): a, c, t, g, unknown or other
  misc_feature (424)..(433): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctggggcacagcagccctgggctgcctggtcaaggactacttccacgtagcgtgctgagcgggctggcaaggcgcatagnnnnnnnnnn

SEQ ID NO: 185884 - DNA, 429 bp, Homo sapiens
  misc_feature: GYAE6OF02HQFFX.30.68.G02.1.454.CMB.1.raw
  modified_base (425)..(429): a, c, t, g, unknown or other
  misc_feature (425)..(429): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcacccctggtcagcgtctcctcagcctccaccaagggcccatcggtcttccccctggcaccctcctccaagagcacctctggggcacagcagccctgggctgcctggtcaaggactacttccacgtagcgtgctgagcgggctggcaaggcgcatagnnnnn

SEQ ID NO: 185885 - DNA, 429 bp, Homo sapiens
  misc_feature: GYAE6OF02GOUXK.30.68.G02.1.454.CMB.1.raw
  modified_base (424)..(429): a, c, t, g, unknown or other
  misc_feature (424)..(429): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctggggcacagcagccctgggctgcctggtcaaggactacttccacgtagcgtgctgagcgggctggcaaggcgcatagnnnnnn

SEQ ID NO: 185886 - DNA, 428 bp, Homo sapiens
  misc_feature: GYAE6OF02JDPBT.30.68.G02.1.454.CMB.1.raw
  modified_base (424)..(428): a, c, t, g, unknown or other
  misc_feature (424)..(428): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctggggcacagcagccctgggctgcctggtcaaggactacttccacgtagcgtgctgagcgggctggcaaggcgcatagnnnnn

SEQ ID NO: 185887 - DNA, 432 bp, Homo sapiens
  misc_feature: GYAE6OF02G99MN.30.68.G02.1.454.CMB.1.raw
  modified_base (426)..(432): a, c, t, g, unknown or other
  misc_feature (426)..(432): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnnn

SEQ ID NO: 185888 - DNA, 427 bp, Homo sapiens
  misc_feature: GYAE6OF02IB6Y0.30.68.G02.1.454.CMB.1.raw
  modified_base (269)..(269): a, c, t, g, unknown or other
  misc_feature (269)..(269): n is a, c, g, or t
  modified_base (407)..(407): a, c, t, g, unknown or other
  misc_feature (407)..(407): n is a, c, g, or t
  modified_base (423)..(427): a, c, t, g, unknown or other
  misc_feature (423)..(427): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgcttttcacccctggagtgggagttacaaggcatacttccacactgggccggggnaccctggtcagcgtctcctcagcctccaccaagggcccatcggtcttccccctggcaccctcctccaagagcacctctggggcacagcagcctggctgcctggtcaaggactacttccacgtagcgtgctgagcgggntggcaaggcgcatagnnnnn

SEQ ID NO: 185889 - DNA, 431 bp, Homo sapiens
  misc_feature: GYAE6OF02FSSSF.30.68.G02.1.454.CMB.1.raw
  modified_base (425)..(431): a, c, t, g, unknown or other
  misc_feature (425)..(431): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctgacaccctcctccaagagcacctctgggggcacagcagccctgggctgcctggtcaaggactacttccacgtagcgtgctgagcgggctggcaaggcgcatagnnnnnnn

SEQ ID NO: 185890 - DNA, 428 bp, Homo sapiens
  misc_feature: GYAE6OF02GNT1U.30.68.G02.1.454.CMB.1.raw
  modified_base (422)..(428): a, c, t, g, unknown or other
  misc_feature (422)..(428): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctggggcacagcagccctgggctgcctggtcaaggctacttccacgtagcgtctgagcgggctggcaaggcgcatagnnnnnnn

SEQ ID NO: 185891 - DNA, 427 bp, Homo sapiens
  misc_feature: GYAE6OF02HSI8I.30.68.G02.1.454.CMB.1.raw
  modified_base (424)..(427): a, c, t, g, unknown or other
  misc_feature (424)..(427): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagagcacctctggggcacagcagccctgggctgcctggtcaaggactactccacgtagcgtgctgagcgggctggcaaggcgcatagnnnn

SEQ ID NO: 185892 - DNA, 454 bp, Homo sapiens
  misc_feature: GYAE6OF02GT88X.30.68.G02.1.454.CMB.1.raw
  modified_base (426)..(454): a, c, t, g, unknown or other
  misc_feature (426)..(454): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnnnnnnnnnnnnnnnnnnnnnnnnn

SEQ ID NO: 185893 - DNA, 429 bp, Homo sapiens
  misc_feature: GYAE6OF02H8WV5.30.68.G02.1.454.CMB.1.raw
  modified_base (423)..(429): a, c, t, g, unknown or other
  misc_feature (423)..(429): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctggggcacagcagccctgggctgcctggtcaaggctacttccacgtagcgtgctgagcgggctggcaaggcgcatagnnnnnnn

SEQ ID NO: 185894 - DNA, 429 bp, Homo sapiens
  misc_feature: GYAE6OF02GRC6Y.30.68.G02.1.454.CMB.1.raw
  modified_base (426)..(429): a, c, t, g, unknown or other
  misc_feature (426)..(429): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccacccaagggcccatcggtcttccccctggcaccctcctccaagagcacctctgggggcacagcagccctgggctgcctggtcaaggactacttccacgtagcgtgctgagcgggctggcaaggcgcatagnnnn

SEQ ID NO: 185895 - DNA, 430 bp, Homo sapiens
  misc_feature: GYAE6OF02H2WAT.30.68.G02.1.454.CMB.1.raw
  modified_base (423)..(430): a, c, t, g, unknown or other
  misc_feature (423)..(430): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccacactgggccggggcaccctggtcagcgtctcctcagcctccaccaagggcccatcggtcttccccctggcaccctcctccaagcgcacctctgggggcacagcagccctgggctgcctggtcaaggactacttcacgtagcgtgctgagcgggctggcaaggcgcatagnnnnnnnn

SEQ ID NO: 185896 - DNA, 433 bp, Homo sapiens
  misc_feature: GYAE6OF02GBYGQ.30.68.G02.1.454.CMB.1.raw
  modified_base (425)..(433): a, c, t, g, unknown or other
  misc_feature (425)..(433): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccaggggacagttcgaagaacacactgttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnnnnn

SEQ ID NO: 185897 - DNA, 432 bp, Homo sapiens
  misc_feature: GYAE6OF02G34XC.30.68.G02.1.454.CMB.1.raw
  modified_base (425)..(432): a, c, t, g, unknown or other
  misc_feature (425)..(432): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnnnn

SEQ ID NO: 185898 - DNA, 431 bp, Homo sapiens
  misc_feature: GYAE6OF02I01N4.30.68.G02.1.454.CMB.1.raw
  modified_base (425)..(431): a, c, t, g, unknown or other
  misc_feature (425)..(431): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnnn

SEQ ID NO: 185899 - DNA, 433 bp, Homo sapiens
  misc_feature: GYAE6OF02GDL2Q.30.68.G02.1.454.CMB.1.raw
  modified_base (425)..(433): a, c, t, g, unknown or other
  misc_feature (425)..(433): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnnnnn

SEQ ID NO: 185900 - DNA, 456 bp, Homo sapiens
  misc_feature: GYAE6OF02H2WFB.30.68.G02.1.454.CMB.1.raw
  modified_base (344)..(344): a, c, t, g, unknown or other
  misc_feature (344)..(344): n is a, c, g, or t
  modified_base (424)..(424): a, c, t, g, unknown or other
  misc_feature (424)..(424): n is a, c, g, or t
  modified_base (431)..(456): a, c, t, g, unknown or other
  misc_feature (431)..(456): n is a, c, g, or t
tcagcacgctacgtcacgaccggtgctcgatttagtcgatagtgaagggaaaggggctggggaatgggtctcaagtattgctggtaggtggtgatagcacatactacgcagccatcgtgaaggccggttcaccatctccagggacagttcgaagaacacactgtttctgcaaatgaacagcctgagagtcgagggacacggccgtatattactgtgcgctttcaccctggagtgggagttacaaggcatacttccactactggggccgggggcaccctggtcagcgtctcctcagcctccaccaagggcccatcggtcttccccctggccaccctcctccaagngcacctctggggcacagcagccctgggctgcctggtcaaggactacttccacgtagcgtgctgagcgggctggcaaggcncatacgnnnnnnnnnnnnnnnnnnnnnnnnnn

SEQ ID NO: 185901 - DNA, 428 bp, Homo sapiens
  misc_feature: GYAE6OF02H7WA5.30.68.G02.1.454.CMB.1.raw
  modified_base (422)..(428): a, c, t, g, unknown or other
  misc_feature (422)..(428): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccacactggggccggggcaccctggtcagcgtctcctcagcctccaccaaggcccatcggtctccccctggcaccctcctccaagagcacctctgggggcacagcagccctgggctgcctggtcaaggctacttccacgtagcgtgctgagcgggctggcaaggcgcatagnnnnnnn

SEQ ID NO: 185902 - DNA, 432 bp, Homo sapiens
  misc_feature: GYAE6OF02IHOXL.30.68.G02.1.454.CMB.1.raw
  modified_base (426)..(432): a, c, t, g, unknown or other
  misc_feature (426)..(432): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcacccctggtcagcgtctccctcagcctccaccaagggcccatcggtcttccccctggcaccctcctccaagagcacctctggggcacagcagccctgggctgcctggtcaaggactactccacgtagcgtgctgagcgggctggcaaggcgcatagnnnnnnn

SEQ ID NO: 185903 - DNA, 432 bp, Homo sapiens
  misc_feature: GYAE6OF02IQ0Y3.30.68.G02.1.454.CMB.1.raw
  modified_base (418)..(418): a, c, t, g, unknown or other
  misc_feature (418)..(418): n is a, c, g, or t
  modified_base (424)..(432): a, c, t, g, unknown or other
  misc_feature (424)..(432): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctggggcacagcagccctgggctgcctggtcaaggactacttccacgtagcgtgctgagcgggctggcaaggcncatagnnnnnnnnn

SEQ ID NO: 185904 - DNA, 381 bp, Homo sapiens
  misc_feature: GYAE6OF02GML7K.30.68.G02.1.454.CMB.1.raw
  modified_base (376)..(381): a, c, t, g, unknown or other
  misc_feature (376)..(381): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgcagtttattattgtcagcactataacaattggcctccggaaactttggccaggggaccaagcttgagatcaaacgactgtgctgcaccatctgtcttcatcttcccgcatctgaacgtgcgtgctgagcgggctggcaaggcgcatagnnnnnn

SEQ ID NO: 185905 - DNA, 434 bp, Homo sapiens
  misc_feature: GYAE6OF02GF02V.30.68.G02.1.454.CMB.1.raw
  modified_base (428)..(434): a, c, t, g, unknown or other
  misc_feature (428)..(434): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaacgacgcacctctgggggcacagcagccctgggctgcctggtcaaggactacttccacgtagcgtgctgagcgggctggcaaggcgcatagnnnnnnn

SEQ ID NO: 185906 - DNA, 581 bp, Homo sapiens
  misc_feature: GYAE6OF02H5B4O.30.68.G02.1.454.CMB.1.raw
  modified_base (231)..(231): a, c, t, g, unknown or other
  misc_feature (231)..(231): n is a, c, g, or t
  modified_base (246)..(246): a, c, t, g, unknown or other
  misc_feature (246)..(246): n is a, c, g, or t
  modified_base (395)..(395): a, c, t, g, unknown or other
  misc_feature (395)..(395): n is a, c, g, or t
  modified_base (404)..(404): a, c, t, g, unknown or other
  misc_feature (404)..(404): n is a, c, g, or t
  modified_base (413)..(413): a, c, t, g, unknown or other
  misc_feature (413)..(413): n is a, c, g, or t
  modified_base (494)..(494): a, c, t, g, unknown or other
  misc_feature (494)..(494): n is a, c, g, or t
  modified_base (508)..(509): a, c, t, g, unknown or other
  misc_feature (508)..(509): n is a, c, g, or t
  modified_base (512)..(512): a, c, t, g, unknown or other
  misc_feature (512)..(512): n is a, c, g, or t
  modified_base (516)..(516): a, c, t, g, unknown or other
  misc_feature (516)..(516): n is a, c, g, or t
  modified_base (521)..(521): a, c, t, g, unknown or other
  misc_feature (521)..(521): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
  modified_base (532)..(532): a, c, t, g, unknown or other
  misc_feature (532)..(532): n is a, c, g, or t
  modified_base (534)..(534): a, c, t, g, unknown or other
  misc_feature (534)..(534): n is a, c, g, or t
  modified_base (537)..(537): a, c, t, g, unknown or other
  misc_feature (537)..(537): n is a, c, g, or t
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (562)..(562): a, c, t, g, unknown or other
  misc_feature (562)..(562): n is a, c, g, or t
tcagcacgctacgtcacgaccggtgctcgatttagtcgatagtgaagggaaagggggtcggtggaatgggtactcaagtatttgctggtaagtggtcgagtagcacatactacgcagccatcggtgaagggccggttcaccatcttccagggacagttcgaagaacacactgtttctgcaaaactggaaccaggcctgagaagtcgaggggacacggtccggtatattacngtggccgcgttttanacccgtggagtgggtaagtttaacaaaggtcagtaacgtttcccaacctacgtggggcccggggcaccctggtcagcggtctccgtcgacgcctaccaaccaacgggcccctatccgggtcttaccccgtggaccacctcctccaaagngcacctcgnggggacacngctagcctgggctcgctcggcaaaggacctacgtcgaccgtaagtcgtgcctagtacggccgggtcgtggaccgaacgggngaccagttacggcnncgngacngcgcncncncgngngngnganatananacncnctctctctctctcncgtcgtcgcgcgtcgcgtc

SEQ ID NO: 185907 - DNA, 402 bp, Homo sapiens
  misc_feature: GYAE6OF02GG2DI.30.68.G02.1.454.CMB.1.raw
  modified_base (380)..(402): a, c, t, g, unknown or other
  misc_feature (380)..(402): n is a, c, g, or t
tcagcacgctacgtcacgaccggtgctcgatttagtcgatagtgaagggaaagggcgagagtgttagcagcaacttagcctggtaccagcagaaacctggccaggctcccaggctcctcatctatgatgcgtccaccagggtcactggtatcccagccaggttcagcggcagtgggtctgggacagagttcgagtctcaccatcagcagcctgcagtctgaagattttgcagtttatatgtcagcactataacaattggcctccggaaacttttggccaggggaccaagcttgagatacgaaacgaactgtggctgcaccatctgtctcatcttcccgcatctgaacgtagctgctgagcgggctggcaaggcgcatagnnnnnnnnnnnnnnnnnnnnnnn

SEQ ID NO: 185908 - DNA, 432 bp, Homo sapiens
  misc_feature: GYAE6OF02IW4N9.30.68.G02.1.454.CMB.1.raw
  modified_base (426)..(432): a, c, t, g, unknown or other
  misc_feature (426)..(432): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaacgagcacctctgggggcacagcagccctgggctgcctggtcaaggactacttccacgtagcgtgctgagcgggctggcaaggcgcatagnnnnnnn

SEQ ID NO: 185909 - DNA, 433 bp, Homo sapiens
  misc_feature: GYAE6OF02INI1I.30.68.G02.1.454.CMB.1.raw
  modified_base (409)..(409): a, c, t, g, unknown or other
  misc_feature (409)..(409): n is a, c, g, or t
  modified_base (424)..(433): a, c, t, g, unknown or other
  misc_feature (424)..(433): n is a, c, g, or t
tcagcacgctacgtcacgaccggtgctcgatttagtcgatagtgaagggaaagggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaaggcccatcggtcttcccctggcaccctcctccaagagcacctctcggggcacagcagccctgggctgcctggtcaaggactacttccacgtagcgtgctgagcgggntggcaggcgcatagnnnnnnnnnn

SEQ ID NO: 185910 - DNA, 529 bp, Homo sapiens
  misc_feature: GYAE6OF02JQRAY.30.68.G02.1.454.CMB.1.raw
  modified_base (499)..(529): a, c, t, g, unknown or other
  misc_feature (499)..(529): n is a, c, g, or t
tcagcacgctacgtcacgaccggtgctcgatttagtcgatagtgaagggaaagggggcgtggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaggcatacttccaccatgggccggggcaccctggtcagcgtctcctcagcctccaccaagggcccatcggtcttccccctggccaccctcctccacgagccacctctcgggggcaccagccgacgcccgttggggcctcggcccgttgggtaccgaaagggtacccgttaccttacccgtaacggttacggtccgtacgccgttggacggtccgggggactcggggacgaacgggtcccggcacgttacgggcagtcnnnnnnnnnnnnnnnnnnnnnnnnnnnnnnn

SEQ ID NO: 185911 - DNA, 432 bp, Homo sapiens
  misc_feature: GYAE6OF02H1KXS.30.68.G02.1.454.CMB.1.raw
  modified_base (342)..(342): a, c, t, g, unknown or other
  misc_feature (342)..(342): n is a, c, g, or t
  modified_base (409)..(409): a, c, t, g, unknown or other
  misc_feature (409)..(409): n is a, c, g, or t
  modified_base (425)..(432): a, c, t, g, unknown or other
  misc_feature (425)..(432): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccacactgggccggggcaccctggtcagcgtctccgtcagcctccaccaagggcccatccggtcttcccccctggccaccctcctccaacgngcacctctggggcacagcagcctgggctgcctgtcaaggactacttccacgtagcgtgctgagcggntggcaaggcgcatagnnnnnnnn

SEQ ID NO: 185912 - DNA, 433 bp, Homo sapiens
  misc_feature: GYAE6OF02G1OT0.30.68.G02.1.454.CMB.1.raw
  modified_base (419)..(419): a, c, t, g, unknown or other
  misc_feature (419)..(419): n is a, c, g, or t
  modified_base (425)..(433): a, c, t, g, unknown or other
  misc_feature (425)..(433): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctggggcacagcagccctgggctgcctggtcaaggactacttccacgtagcgtgctgagcgggctgggcaaggcncatagnnnnnnnnn

SEQ ID NO: 185913 - DNA, 430 bp, Homo sapiens
  misc_feature: GYAE6OF02GXZKW.30.68.G02.1.454.CMB.1.raw
  modified_base (426)..(430): a, c, t, g, unknown or other
  misc_feature (426)..(430): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggccaccctcctccaagagcacctctgggggcacagcagccctgggctgcctggtcaaggactacttccacgtagcgtgctgagcgggctggcaggcgcatagnnnnn

SEQ ID NO: 185914 - DNA, 535 bp, Homo sapiens
  misc_feature: GYAE6OF02GXD7S.30.68.G02.1.454.CMB.1.raw
  modified_base (511)..(511): a, c, t, g, unknown or other
  misc_feature (511)..(511): n is a, c, g, or t
  modified_base (514)..(535): a, c, t, g, unknown or other
  misc_feature (514)..(535): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgtctttcaccctgggagtgggagttacaaggcatacttccaccacgtcggggccgggcacctggtcagcgtctcctcacgcctcccaccgaacgggcccacgtccggttcccttcccccgtcggccacccctcctaccaacgcgccacctcggtcgggggccacgacgccgacgcccgtcgggtcgtcggtccgttacgggtaccgaacggtaccttaccgttacccgtacggtacggccggtcgcggtcgggacgggtcggggccggtacgggaccggaacgggtcgacgagtagnagnnnnnnnnnnnnnnnnnnnnnn

SEQ ID NO: 185915 - DNA, 427 bp, Homo sapiens
  misc_feature: GYAE6OF02G79V9.30.68.G02.1.454.CMB.1.raw
  modified_base (423)..(427): a, c, t, g, unknown or other
  misc_feature (423)..(427): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctggggcacagcagccctgggctgcctggtcaaggctacttccacgtagcgtgctgagcgggctggcaaggcgcatagnnnnn

SEQ ID NO: 185916 - DNA, 385 bp, Homo sapiens
  misc_feature: GYAE6OF02FKUCV.30.68.G02.1.454.CMB.1.raw
  modified_base (381)..(385): a, c, t, g, unknown or other
  misc_feature (381)..(385): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgcagtttattattgtcagcactataacaattggcctccggaaacttttggccaggggaccaagcttgagatcaaacgaactgtggctgcaccatctgtcttcatcttcccgccatctgaacgtagcgtgctgagcgggctggcaaggcgcatagnnnnn

SEQ ID NO: 185917 - DNA, 391 bp, Homo sapiens
  misc_feature: GYAE6OF02I45GY.30.68.G02.1.454.CMB.1.raw
  modified_base (376)..(391): a, c, t, g, unknown or other
  misc_feature (376)..(391): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgcagtttatattgtcagcactataacaattggcctcggaaacttttgccagggaccaagcttgagatcaaacgactagtggctgcaccatctgtcttcatcttcccgcatctgaacgtgcgtgctgagcgggctggctaaggcgcatagnnnnnnnnnnnnnnnn

SEQ ID NO: 185918 - DNA, 430 bp, Homo sapiens
  misc_feature: GYAE6OF02HQ6K8.30.68.G02.1.454.CMB.1.raw
  modified_base (408)..(408): a, c, t, g, unknown or other
  misc_feature (408)..(408): n is a, c, g, or t
  modified_base (424)..(430): a, c, t, g, unknown or other
  misc_feature (424)..(430): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctgggggcacagcagccctgggctgcctggtcaaggctacttccacgtagcgtgctgagcgggntggcaaggcgcatagnnnnnnn

SEQ ID NO: 185919 - DNA, 433 bp, Homo sapiens
  misc_feature: GYAE6OF02HAY3R.30.68.G02.1.454.CMB.1.raw
  modified_base (426)..(433): a, c, t, g, unknown or other
  misc_feature (426)..(433): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggccacccctcctccaagacgcacctctggggcacagcagccctgggctgcctggtcaaggactactccacgtagcgtgctgagcgggctggcaaggcgcatagnnnnnnnn

SEQ ID NO: 185920 - DNA, 432 bp, Homo sapiens
  misc_feature: GYAE6OF02IWSFE.30.68.G02.1.454.CMB.1.raw
  modified_base (420)..(420): a, c, t, g, unknown or other
  misc_feature (420)..(420): n is a, c, g, or t
  modified_base (425)..(432): a, c, t, g, unknown or other
  misc_feature (425)..(432): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcactctggtcagcgtctcctcagcctccaccaagggcccatcggtcttcccctggccaccctcctcccaagacgcacctctcgggggcacagcagccctgggctgcctggtcaaggctactcacgtagcgtgctgagcgggctggcaaggcgnatagnnnnnnnn

SEQ ID NO: 185921 - DNA, 433 bp, Homo sapiens; identical to SEQ ID NO: 185883
  misc_feature: GYAE6OF02I1KO5.30.68.G02.1.454.CMB.1.raw
  modified_base (424)..(433): a, c, t, g, unknown or other
  misc_feature (424)..(433): n is a, c, g, or t

SEQ ID NO: 185922 - DNA, 433 bp, Homo sapiens
  misc_feature: GYAE6OF02FMQM6.30.68.G02.1.454.CMB.1.raw
  modified_base (425)..(433): a, c, t, g, unknown or other
  misc_feature (425)..(433): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagagcacctctgggggcacagcagccctgggctgcctggtcaggactacttccacgtagcgtgctgagcgggctggcaaggcgcatagnnnnnnnnn

SEQ ID NO: 185923 - DNA, 437 bp, Homo sapiens
  misc_feature: GYAE6OF02GPIPF.30.68.G02.1.454.CMB.1.raw
  modified_base (428)..(429): a, c, t, g, unknown or other
  misc_feature (428)..(429): n is a, c, g, or t
  modified_base (431)..(437): a, c, t, g, unknown or other
  misc_feature (431)..(437): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagacgcacctctgggggcacgagcagccctgggctgcctggtcaaggactacttccacgtagcgtgctgagcgggctggcaaggcgcatagnngnnnnnnn

SEQ ID NO: 185924 - DNA, 429 bp, Homo sapiens; identical to SEQ ID NO: 185885
  misc_feature: GYAE6OF02GNT6C.30.68.G02.1.454.CMB.1.raw
  modified_base (424)..(429): a, c, t, g, unknown or other
  misc_feature (424)..(429): n is a, c, g, or t

SEQ ID NO: 185925 - DNA, 435 bp, Homo sapiens
  misc_feature: GYAE6OF02IUHUR.30.68.G02.1.454.CMB.1.raw
  modified_base (425)..(435): a, c, t, g, unknown or other
  misc_feature (425)..(435): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagagcacctctgggggcacagcagccctgggctgcctggtcaaggactacttccacgtagcgtgctgagcgggctggcaggcgcatagnnnnnnnnnnn

SEQ ID NO: 185926 - DNA, 460 bp, Homo sapiens
  misc_feature: GYAE6OF02IJG69.30.68.G02.1.454.CMB.1.raw
  modified_base (406)..(406): a, c, t, g, unknown or other
  misc_feature (406)..(406): n is a, c, g, or t
  modified_base (429)..(430): a, c, t, g, unknown or other
  misc_feature (429)..(430): n is a, c, g, or t
  modified_base (432)..(460): a, c, t, g, unknown or other
  misc_feature (432)..(460): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggattacaaggcatacttccacactggggccggggcacccctggtcagcgtctcctcagcctccaccaagggcccatcggtctcccctggcaccctcctccaagacgcacctctggggcacgagcagccctgggctgcctggtcaagggactacttccacgtagcgtgctggaancgggctggcaaggcgcagtaggnngnnnnnnnnnnnnnnnnnnnnnnnnnnnnn

SEQ ID NO: 185927 - DNA, 435 bp, Homo sapiens
  misc_feature: GYAE6OF02GQU7B.30.68.G02.1.454.CMB.1.raw
  modified_base (426)..(435): a, c, t, g, unknown or other
  misc_feature (426)..(435): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatacgnnnnnnnnnn

SEQ ID NO: 185928 - DNA, 437 bp, Homo sapiens
  misc_feature: GYAE6OF02I6U14.30.68.G02.1.454.CMB.1.raw
  modified_base (427)..(437): a, c, t, g, unknown or other
  misc_feature (427)..(437): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctccctcagcctccaccaagggcccatcggtcttccccctggcaccctcctccaagacgcacctctggggcacagcagccctgggctgcctggtcaaggactacttccacgtagcgtgctgagcgggctgggcaaggcgcatagnnnnnnnnnnn

SEQ ID NO: 185929 - DNA, 438 bp, Homo sapiens
  misc_feature: GYAE6OF02IHNHC.30.68.G02.1.454.CMB.1.raw
  modified_base (307)..(307): a, c, t, g, unknown or other
  misc_feature (307)..(307): n is a, c, g, or t
  modified_base (323)..(323): a, c, t, g, unknown or other
  misc_feature (323)..(323): n is a, c, g, or t
  modified_base (423)..(438): a, c, t, g, unknown or other
  misc_feature (423)..(438): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaaatgaacagcctgagagtcgaggacacggccgtatattactgtgcgctttcaccctggagtgggagttacaaggcatacttccacatgggccggggcaccctggtcagcgtctcctcagcctccaccaagggcccancggtctccccctggcnccctcctccaagagcacctctgggggcacagcagccctgggctgcctggtcaaggactacttccacgtagcgtgctgagcgggctggcaaggcgcatagnnnnnnnnnnnnnnnn

SEQ ID NO: 185930 - DNA, 478 bp, Homo sapiens
  misc_feature: GYAE6OF02IMY7K.30.68.G02.1.454.CMB.1.raw
  modified_base (457)..(457): a, c, t, g, unknown or other
  misc_feature (457)..(457): n is a, c, g, or t
  modified_base (464)..(478): a, c, t, g, unknown or other
  misc_feature (464)..(478): n is a, c, g, or t
tcagcacgctacgtcacgaccggtgctcgatttagtcgatagtgaagggaaaggggcgtggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactcggggccggggcaccctggtcagcgtctcctcagcctccacccaagggccccagtccggtccttccccctggtccacccctcctccaaagacgccacctcgtcgggggcaccgagcacgccccgtggggcctggcctcggtcaaacggtacctacgttcccacgttacgcgtgcgtgaggcgggctcggacaagggcnacgtagnnnnnnnnnnnnnnn

SEQ ID NO: 185931 - DNA, 432 bp, Homo sapiens
  misc_feature: GYAE6OF02JHQP1.30.68.G02.1.454.CMB.1.raw
  modified_base (210)..(210): a, c, t, g, unknown or other
  misc_feature (210)..(210): n is a, c, g, or t
  modified_base (424)..(432): a, c, t, g, unknown or other
  misc_feature (424)..(432): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattacngtgcgctttcaccctggagtgggagttacaaggcatacttccaccactgggccggggcaccctggtcagcgtctcctcagcctccaccaagggcccatcggtcttccccctggcaccctcctccaagagcacctctggggcacagcagccctgggctgcctggtcaaggactacttccacgtagcgtgctgagcgggctggcaaggcgcatagnnnnnnnnn

SEQ ID NO: 185932 - DNA, 436 bp, Homo sapiens
  misc_feature: GYAE6OF02IIDTG.30.68.G02.1.454.CMB.1.raw
  modified_base (422)..(422): a, c, t, g, unknown or other
  misc_feature (422)..(422): n is a, c, g, or t
  modified_base (428)..(436): a, c, t, g, unknown or other
  misc_feature (428)..(436): n is a, c, g, or t
tcagcacgctacgtcacgaccggtgctcgatttagtcgatagtgaagggaaagggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccacactgggccggggcaccctggtcagcgtctcctcagcctccaccaagggcccatcggtcttccccctgacacccctcctccaacgacgcacctctgggggcacagcagccctgggctgcctggtcaaggctacttccacgtagcgtgctgagcgggctggcaagggcncatagnnnnnnnnn

SEQ ID NO: 185933 - DNA, 426 bp, Homo sapiens
  misc_feature: GYAE6OF02IBX2K.30.68.G02.1.454.CMB.1.raw
  modified_base (421)..(426): a, c, t, g, unknown or other
  misc_feature (421)..(426): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcacccctggtcagcgtctcctcagcctccacaaggcccatcggtctcccctggcaccctcctccaagagcacctctgggggcacagcagcctgggctgcctggtcaaggactacttcacgtagcgtgctgagcgggctggcaaggcgcatagnnnnnn

SEQ ID NO: 185934 - DNA, 439 bp, Homo sapiens
  misc_feature: GYAE6OF02IC0VU.30.68.G02.1.454.CMB.1.raw
  modified_base (430)..(439): a, c, t, g, unknown or other
  misc_feature (430)..(439): n is a, c, g, or t
tcagcacgctacgtcacgaccggtgctcgatttagtcgatagtgaagggaaagggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtccagcgtctcctcagcctccaccaagggccccatcggtccttccccctggccaccctcctccaagacgcacctcgtgggggcacagcagccctgggctgcctggcaaggactacttccacgtgcatgctgagcgggctggcaggcacatagnnnnnnnnnn

SEQ ID NO: 185935 - DNA, 385 bp, Homo sapiens
  misc_feature: GYAE6OF02GIKVY.30.68.G02.1.454.CMB.1.raw
  modified_base (379)..(385): a, c, t, g, unknown or other
  misc_feature (379)..(385): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgcagtttattattgtcagcactataacaattggcctccggaaacttttggcctaggggaccaagcttgagatcaaacgaactgtggctgcacatctgtcttcatcttccgcatctgaacgtagcgtgctgagcgggctggcaaggcgcatagnnnnnnn

SEQ ID NO: 185936 - DNA, 385 bp, Homo sapiens
  misc_feature: GYAE6OF02GUIRM.30.68.G02.1.454.CMB.1.raw
  modified_base (351)..(351): a, c, t, g, unknown or other
  misc_feature (351)..(351): n is a, c, g, or t
  modified_base (372)..(372): a, c, t, g, unknown or other
  misc_feature (372)..(372): n is a, c, g, or t
  modified_base (377)..(385): a, c, t, g, unknown or other
  misc_feature (377)..(385): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgcagtttatattgtcagcactataacaattggcctccggaaacttttggccaggggaccaagcttgagatcaaacgactgtggctgcaccatctgtcttcatcttcccgcatctgaacgtgcgtnctgagcgggctggcaaggcgnatagnnnnnnnnn

SEQ ID NO: 185937 - DNA, 431 bp, Homo sapiens
  misc_feature: GYAE6OF02ILYZW.30.68.G02.1.454.CMB.1.raw
  modified_base (422)..(431): a, c, t, g, unknown or other
  misc_feature (422)..(431): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctcaccaagggcccatcggtctcccctggccaccctcctccaagagcacctctggggcacagcagccctgggctgcctggtcaaggctacttccacgtagcgtgctgagcgggctggcaaggcgcatagnnnnnnnnnn

SEQ ID NO: 185938 - DNA, 386 bp, Homo sapiens
  misc_feature: GYAE6OF02FV9MQ.30.68.G02.1.454.CMB.1.raw
  modified_base (379)..(386): a, c, t, g, unknown or other
  misc_feature (379)..(386): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgtgtccaccagggtcactggtatcccagccaggttcagcggcagtgggtctgggacagagttcagtctcaccatcagcagcctgcagtctgaagattttgcagtttattattgtcagcactataacaattggcctccggaaacttttggccaggggaccaagcttgagatcaaacgactgtggctgcaccatctgtcttcatcttcccgcatctgaacgtagcgtgctgagcgggctggcaaggcgcatagnnnnnnnn

SEQ ID NO: 185939 - DNA, 432 bp, Homo sapiens
  misc_feature: GYAE6OF02GKVFM.30.68.G02.1.454.CMB.1.raw
  modified_base (426)..(432): a, c, t, g, unknown or other
  misc_feature (426)..(432): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggctgtatattactgtgcgctttcaccctggagtgggagttacaaggcatacttccaccactgggccggggcacccctggtcagcgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatagnnnnnnn

SEQ ID NO: 185940 - DNA, 534 bp, Homo sapiens
  misc_feature: GYAE6OF02GJVNQ.30.68.G02.1.454.CMB.1.raw
  modified_base (491)..(492): a, c, t, g, unknown or other
  misc_feature (491)..(492): n is a, c, g, or t
  modified_base (497)..(497): a, c, t, g, unknown or other
  misc_feature (497)..(497): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
  modified_base (507)..(509): a, c, t, g, unknown or other
  misc_feature (507)..(509): n is a, c, g, or t
  modified_base (511)..(534): a, c, t, g, unknown or other
  misc_feature (511)..(534): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggctcaccatctccgagggacagttcgaagaacacacttgtttctgacaaatgaacagcctgagagtcgaggacacggccgtatattactgtgcgtctttcaccctggagtgggagttacgaggcatactccaccacgtggggccgggcacccgtggtcagcgtctcctcacgccctcccaccgaacgggcccacgtccggtcccttcccccgtggccacccctcctaccaagacgcctacctcggtcgggggccacgacgcacgcccgtgggctcgccgtggtacgaacggtaccttaccttccgacggtacgcgtcgcgtggacggccgggtcgtcgggaccgaacgggccgaccgtaagtacggnngacgngngngngngnnngnnnnnnnnnnnnnnnnnnnnnnnn

SEQ ID NO: 185941 - DNA, 384 bp, Homo sapiens
  misc_feature: GYAE6OF02IM3KR.30.68.G02.1.454.CMB.1.raw
  modified_base (377)..(384): a, c, t, g, unknown or other
  misc_feature (377)..(384): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgcagtttattattgtcagcactataacaattggcctccggaaacttttggccaggggaccaagcttgagatcaaacgactgtggctgcacatctgtctcatcttccgccatctgaacgtagcgtgctgagcgggctggcaaggcgcatagnnnnnnnn

SEQ ID NO: 185942 - DNA, 435 bp, Homo sapiens
  misc_feature: GYAE6OF02H6BA7.30.68.G02.1.454.CMB.1.raw
  modified_base (267)..(267): a, c, t, g, unknown or other
  misc_feature (267)..(267): n is a, c, g, or t
  modified_base (423)..(435): a, c, t, g, unknown or other
  misc_feature (423)..(435): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccacactgggccggggnaccctggtcagcgtctcctcagcctccaccaagggccccatccggtcttccccctggccaccctcctccaacgagcacctctgggggcacagcagccctgggctgcctggtcaggctactcacgtgcgtgctgagcgggctggcaaggcgcatagnnnnnnnnnnnnn

SEQ ID NO: 185943 - DNA, 431 bp, Homo sapiens
  misc_feature: GYAE6OF02IT8FE.30.68.G02.1.454.CMB.1.raw
  modified_base (424)..(431): a, c, t, g, unknown or other
  misc_feature (424)..(431): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctgggggcacagcagccctgggctgcctggtcaaggctacttccacgtagcgtgctgagcgggctggcaaggcgcatagnnnnnnnn

SEQ ID NO: 185944 - DNA, 438 bp, Homo sapiens
  misc_feature: GYAE6OF02I8DAO.30.68.G02.1.454.CMB.1.raw
  modified_base (428)..(438): a, c, t, g, unknown or other
  misc_feature (428)..(438): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttcccccctggcacccgtcctccaacgagcacctctgggggcacagcagccctgggctgcctggtcaaggactacttccacgtagcgtgctgagcgggctggcaaggcgcatagnnnnnnnnnnn

SEQ ID NO: 185945 - DNA, 433 bp, Homo sapiens; identical to SEQ ID NO: 185899
  misc_feature: GYAE6OF02IBWFR.30.68.G02.1.454.CMB.1.raw
  modified_base (425)..(433): a, c, t, g, unknown or other
  misc_feature (425)..(433): n is a, c, g, or t

SEQ ID NO: 185946 - DNA, 559 bp, Homo sapiens
  misc_feature: GYAE6OF02JQHPX.30.68.G02.1.454.CMB.1.raw
  modified_base (504)..(504): a, c, t, g, unknown or other
  misc_feature (504)..(504): n is a, c, g, or t
  modified_base (520)..(520): a, c, t, g, unknown or other
  misc_feature (520)..(520): n is a, c, g, or t
  modified_base (525)..(527): a, c, t, g, unknown or other
  misc_feature (525)..(527): n is a, c, g, or t
  modified_base (529)..(530): a, c, t, g, unknown or other
  misc_feature (529)..(530): n is a, c, g, or t
  modified_base (534)..(536): a, c, t, g, unknown or other
  misc_feature (534)..(536): n is a, c, g, or t
  modified_base (538)..(540): a, c, t, g, unknown or other
  misc_feature (538)..(540): n is a, c, g, or t
  modified_base (542)..(544): a, c, t, g, unknown or other
  misc_feature (542)..(544): n is a, c, g, or t
  modified_base (546)..(559): a, c, t, g, unknown or other
  misc_feature (546)..(559): n is a, c, g, or t
tcagcacgctacgtcacgaccggtgctcgatttagtcgatagtgaagggaaaggggacgtggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccacactgggccgggcaccgtggtcagcgtctcctcacgcctccaccaacgggcccacgtccggtccttcccccgtcggccaccccgtccctccaagacgccacctcgtcgggggcacgacgaccgtacgccccgtcgggcttcgccgttcgggttaccaaacgggaccttaccttcccgaacggttacggccgtttggccgttcggaacggtccgggggtaccttcggggacgaaacgggccggtaaccgnggttaacgcgtgcacncgcgnnngnngcgnnncnnncnnngnnnnnnnnnnnnnn

SEQ ID NO: 185947 - DNA, 428 bp, Homo sapiens
  misc_feature: GYAE6OF02HC0AM.30.68.G02.1.454.CMB.1.raw
  modified_base (424)..(428): a, c, t, g, unknown or other
  misc_feature (424)..(428): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttcccctggccaccctcctccaagagcacctcgtggggcacagcagccctgggctgcctggtcaaggactactccacgtagcgtgctgagcgggctggcaggcgcatagnnnnn

SEQ ID NO: 185948 - DNA, 439 bp, Homo sapiens
  misc_feature: GYAE6OF02IJXEL.30.68.G02.1.454.CMB.1.raw
  modified_base (414)..(414): a, c, t, g, unknown or other
  misc_feature (414)..(414): n is a, c, g, or t
  modified_base (429)..(439): a, c, t, g, unknown or other
  misc_feature (429)..(439): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtccagcgtctcctcagcctccaccaagggcccatcggtcttccccctggccaccctcctccaagacgcacctcgtgggggccacgagcacgccctgggctgcctggtcaaggctactcacgtagcgtgctgagcgggntggcaggcgcatagnnnnnnnnnnn

SEQ ID NO: 185949 - DNA, 434 bp, Homo sapiens
  misc_feature: GYAE6OF02G62X3.30.68.G02.1.454.CMB.1.raw
  modified_base (425)..(434): a, c, t, g, unknown or other
  misc_feature (425)..(434): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagagcacctctgggggcacagcagccctgggctgcctggtcaaggctacttccacgtagcgtgctgagcgggctggcaaggcgcatagnnnnnnnnnn

SEQ ID NO: 185950 - DNA, 455 bp, Homo sapiens
  misc_feature: GYAE6OF02JJ2TV.30.68.G02.1.454.CMB.1.raw
  modified_base (321)..(321): a, c, t, g, unknown or other
  misc_feature (321)..(321): n is a, c, g, or t
  modified_base (428)..(455): a, c, t, g, unknown or other
  misc_feature (428)..(455): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttcccccnggccaccctcctccaacgagccacctctggggcacagcagccctgggctcgctggtcaaggctacttccacgtagcgtgctgacgcgggctggcaaggcgcatacgnnnnnnnnnnnnnnnnnnnnnnnnnnnn

SEQ ID NO: 185951 - DNA, 429 bp, Homo sapiens
  misc_feature: GYAE6OF02GFBNH.30.68.G02.1.454.CMB.1.raw
  modified_base (423)..(429): a, c, t, g, unknown or other
  misc_feature (423)..(429): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcatgnnnnnnn

SEQ ID NO: 185952 - DNA, 526 bp, Homo sapiens
  misc_feature: GYAE6OF02I65Z7.30.68.G02.1.454.CMB.1.raw
  modified_base (492)..(492): a, c, t, g, unknown or other
  misc_feature (492)..(492): n is a, c, g, or t
  modified_base (496)..(526): a, c, t, g, unknown or other
  misc_feature (496)..(526): n is a, c, g, or t
tcagcacgctacgtcacgaccggtgctcgatttagtcgatagtgaagggaaagggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggattacaaggcatactccaccacgtggggccgggcacccgtggtcgacgcgtctcctcacgcctccgaccaacgggcccacgtccggtccttcccccgtggcctaccctcctaccaagacgcaccctcgtcggggcacacgcacgccctgggactcggcctggtaccaaacgggtacctaccgttaccgacggttacggcgtcggcgtaggacgggtcccggggtgtacgggacgaacgggccggtacgaaagtcggangcgnnnnnnnnnnnnnnnnnnnnnnnnnnnnnnn

SEQ ID NO: 185953 - DNA, 488 bp, Homo sapiens
  misc_feature: GYAE6OF02FRZKS.30.68.G02.1.454.CMB.1.raw
  modified_base (460)..(488): a, c, t, g, unknown or other
  misc_feature (460)..(488): n is a, c, g, or t
tcagcacgctacgtcacgaccggtgctcgattagtcgatagtgaagggaaagggctggaatggtctcaagtattgctggtagtggtgatagcacatactacgcagccatcgtgaagggccggttcacccatctccaggacagttcgaagaacacactgttctgcaaatgaacagcctgagagtcgaggacacggccgtatattacctgtgccgccttcacccctggagtgggattacaaggcataccttccacccacgtgtccggtcacccctggtcagccgtctccctcagccctcccaccgaacgtccgatcgtgtccgtcggcacccctcctccaacgagccaccctctggggggtccaccagccagcccctgggcctgccctgggtccaagggacctaccttccaccgtagccgttgccgtgagccgggtctcgggccaaacgggcgcgattagcnnnnnnnnnnnnnnnnnnnnnnnnnnnnn

SEQ ID NO: 185954 - DNA, 437 bp, Homo sapiens
  misc_feature: GYAE6OF02I6OW8.30.68.G02.1.454.CMB.1.raw
  modified_base (422)..(437): a, c, t, g, unknown or other
  misc_feature (422)..(437): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatactccaccactgggccggggcaccctggtcagcgtctcctcagcctccaccaagggcccatcggtcttccccctggcaccctcctccaagagcacctctggggcacagcagccctgggctgcctggtcaaggctacttccacgtagcgtgctgagcgggctggcaaggcgcatagnnnnnnnnnnnnnnnn

SEQ ID NO: 185955 - DNA, 441 bp, Homo sapiens
  misc_feature: GYAE6OF02HZ99F.30.68.G02.1.454.CMB.1.raw
  modified_base (355)..(355): a, c, t, g, unknown or other
  misc_feature (355)..(355): n is a, c, g, or t
  modified_base (428)..(441): a, c, t, g, unknown or other
  misc_feature (428)..(441): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagagcacctctgggggcacngcagccctgggctgcctggtcaaggactacttccacgtagcgtgctgagcgggctgggcaaggcgcatacggnnnnnnnnnnnnnn

SEQ ID NO: 185956 - DNA, 389 bp, Homo sapiens
  misc_feature: GYAE6OF02FT1F8.30.68.G02.1.454.CMB.1.raw
  modified_base (380)..(389): a, c, t, g, unknown or other
  misc_feature (380)..(389): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgcagtttattattgtcagcactataacaattggcctcggaaacttttggccaggggaccaagcttgagatacaaacgaactgtggctgcaccatctgtcttcatccttcccgcatctgaacgtgcgtgctgagcgggctggcaaggcgcatagnnnnnnnnnn

SEQ ID NO: 185957 - DNA, 453 bp, Homo sapiens
  misc_feature: GYAE6OF02I6CQE.30.68.G02.1.454.CMB.1.raw
  modified_base (332)..(332): a, c, t, g, unknown or other
  misc_feature (332)..(332): n is a, c, g, or t
  modified_base (351)..(351): a, c, t, g, unknown or other
  misc_feature (351)..(351): n is a, c, g, or t
  modified_base (368)..(368): a, c, t, g, unknown or other
  misc_feature (368)..(368): n is a, c, g, or t
  modified_base (437)..(437): a, c, t, g, unknown or other
  misc_feature (437)..(437): n is a, c, g, or t
  modified_base (443)..(453): a, c, t, g, unknown or other
  misc_feature (443)..(453): n is a, c, g, or t
tcagcacgctacgtcacgaccggtgctcgatttagtcgatagtgaagggaaagggggtcgtggaatgggtctcgaagtaattgctggtagtggtgatagcacatacctacgcagccatcgtgaagggccgttcaccatctccagggacagttcgaagaacacactgtttctgcaaatgaacagcctgagagtcgaggacacggccgtatattactgtgcgtctttcaccctggagtgggattacaaggcatacttccacacgtggggccggggcaccgtggtcagcgtctcctcacgcctccaccaacgggccccagtcggtcttcccccgnggccacccctctccaagcncacctcgtggggcacgngcacgcccgtggctcgctggtcaaggacttaccttccacgtagtcgtgactggagcggctggacaggcncgatgnnnnnnnnnnn

SEQ ID NO: 185958 - DNA, 432 bp, Homo sapiens
  misc_feature: GYAE6OF02I6689.30.68.G02.1.454.CMB.1.raw
  modified_base (420)..(420): a, c, t, g, unknown or other
  misc_feature (420)..(420): n is a, c, g, or t
  modified_base (426)..(432): a, c, t, g, unknown or other
  misc_feature (426)..(432): n is a, c, g, or t
tcagcacgctacgtcacgaccggtgctcgatttagtcgatagtgaagggaaaggggatggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtctcccctggcaccctctccagagcacctctggggcacagcagccctgggctgcctggtcaaggacctacttcccgacgtacgcgtgcctgagcgggctggcaaggcncatagnnnnnnn

SEQ ID NO: 185959 - DNA, 579 bp, Homo sapiens
  misc_feature: GYAE6OF02F83AY.30.68.G02.1.454.CMB.1.raw
  modified_base (569)..(579): a, c, t, g, unknown or other
  misc_feature (569)..(579): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaaacagcccgtagagtacgtacggacgacggaccggtacgtaattaacttacgttgtcggcctttccttacccctaccggtaggtagggtagggttaacgtaaacggacgactaactttaccctacccaacctacgggggtccggggggccggacccctaccggttcggtacgacggtccgttcccttccctacgacccgtcccctaccccaaaccgggaccccggacctacggtccgttcccccttcccggtcgacccctacccctccctaacgaacgcgaccctacctcggggtcgggaccacgcacgacccgtccgggcgtcgccgtcggtcgaacgaacgtaccttccaccgtagcgtcgctgaggcgggcgtgcgaacggacggccatagnnnnnnnnnnn

SEQ ID NO: 185960 - DNA, 648 bp, Homo sapiens
  misc_feature: GYAE6OF02IP09U.30.68.G02.1.454.CMB.1.raw
  modified_base (139)..(139): a, c, t, g, unknown or other
  misc_feature (139)..(139): n is a, c, g, or t
  modified_base (174)..(174): a, c, t, g, unknown or other
  misc_feature (174)..(174): n is a, c, g, or t
  modified_base (485)..(485): a, c, t, g, unknown or other
  misc_feature (485)..(485): n is a, c, g, or t
  modified_base (584)..(584): a, c, t, g, unknown or other
  misc_feature (584)..(584): n is a, c, g, or t
  modified_base (623)..(648): a, c, t, g, unknown or other
  misc_feature (623)..(648): n is a, c, g, or t
tcagcacgctacgtcacgaccggtgctcgatttagtcgatagtgaagggaaagggggctggaatgggtctcaagtattgctggtagtgggtgatagcacatactacgcagccatcgtgaagggccggttcaccatcccncggaggatgtagaacgaacactacgttcgtttcgngaaactaaagtacgaacgacgtccgtaggaaggtacgtacgggaacggaaccggacccgggtacgttaatttaactttacgtggtcgccgtttcctttacccaccgggtagggtagggtagggttaacgttaacggacggactaacttaccctacccgaaccgtacgggggtccggggggcccgggaccctaccggttcggtacgacggtcgttccctccctacgaccgtcccctacccgaaccgggaacccgggccctacggttccggtttccccctccccggtggaccccctcccctcctaacgaagcncctaccgtcggggtcgggaccacgacgacgacccgtccgggtggtctccgtccggtcgtaacggaacgttaccttccctaccgagtacggtcgcgtcgngggacgggtccgggtcgtcggaggacggccgacagtcgnnnnnnnnnnnnnnnnnnnnnnnnnn

SEQ ID NO: 185961 - DNA, 384 bp, Homo sapiens
  misc_feature: GYAE6OF02ICR2P.30.68.G02.1.454.CMB.1.raw
  modified_base (372)..(372): a, c, t, g, unknown or other
  misc_feature (372)..(372): n is a, c, g, or t
  modified_base (377)..(384): a, c, t, g, unknown or other
  misc_feature (377)..(384): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgctagtttattattgtcagcactataacaattggcctccggaaacttttggccaggggaccaagcttgagatcaaacgaactgtggctgcaccatctgtcttcatctccgcatctgaacgtgcgtgctgagcgggctggcaggcgnatagnnnnnnnn

SEQ ID NO: 185962 - DNA, 398 bp, Homo sapiens
  misc_feature: GYAE6OF02I3AJ1.30.68.G02.1.454.CMB.1.raw
  modified_base (295)..(295): a, c, t, g, unknown or other
  misc_feature (295)..(295): n is a, c, g, or t
  modified_base (374)..(374): a, c, t, g, unknown or other
  misc_feature (374)..(374): n is a, c, g, or t
  modified_base (379)..(398): a, c, t, g, unknown or other
  misc_feature (379)..(398): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgcagtttattattgtcagcactataacaattggcctccggaaacttttggccaggggaccaagcttganatcaaacgaactgtggctgcaccatctgtcttcatctcccgcatctgaacgtagcgtgctgagcgggctggcaaggcgnatagnnnnnnnnnnnnnnnnnnnn

SEQ ID NO: 185963 - DNA, 434 bp, Homo sapiens
  misc_feature: GYAE6OF02I164N.30.68.G02.1.454.CMB.1.raw
  modified_base (427)..(434): a, c, t, g, unknown or other
  misc_feature (427)..(434): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggccaccctcctccaagacgcacctctgggggcacagcagccctgggctgcctggtcaaggactacttccacgtagcgtgctgagcgggctggcaaggcgcatagnnnnnnnn

SEQ ID NO: 185964 - DNA, 432 bp, Homo sapiens
  misc_feature: GYAE6OF02H8VME.30.68.G02.1.454.CMB.1.raw
  modified_base (422)..(432): a, c, t, g, unknown or other
  misc_feature (422)..(432): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcacccctggtcagcgtctcctcagcctccaccagggcccatcggtcttccccctggcaccctcctccaagagcacctctgggggcacagcagccctgggctgcctggtcaaggctactcacgtagcgtgctgagcgggctggcaaggcgcatagnnnnnnnnnnn

SEQ ID NO: 185965 - DNA, 433 bp, Homo sapiens
  misc_feature: GYAE6OF02G60FH.30.68.G02.1.454.CMB.1.raw
  modified_base (424)..(433): a, c, t, g, unknown or other
  misc_feature (424)..(433): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccatggggccggggcaccctggtcagcgtctcctcagcctccaccaagggcccatcggtcttccccctggcaccctcctccaagagcacctctggggcacagcagccctgggctgcctgtcaaggactacttccacgtagcgtgctggagcgggctggcaaggcgcatagnnnnnnnnnn

SEQ ID NO: 185966 - DNA, 448 bp, Homo sapiens
  misc_feature: GYAE6OF02G4EDZ.30.68.G02.1.454.CMB.1.raw
  modified_base (435)..(448): a, c, t, g, unknown or other
  misc_feature (435)..(448): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaacgggccccatccggtccttccccctggccacccctcctccaacgacgccacctctgggggcacagcagccctgggctgcctggtcaaggctactccacgtgcgtgctgacgcgggctggcaaggcgcagtacgnnnnnnnnnnnnnn

SEQ ID NO: 185967 - DNA, 451 bp, Homo sapiens
  misc_feature: GYAE6OF02JJN5J.30.68.G02.1.454.CMB.1.raw
  modified_base (439)..(451): a, c, t, g, unknown or other
  misc_feature (439)..(451): n is a, c, g, or t
tcagcacgctacgtcacgaccggtgctcgatttagtcgatagtgaagggaaaggggacgtggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggccaccctcctccaagacgcacctcgtcgggggcacgagcagcccctgggctcgcctggtcaaggactacttccacgtagccgtgcctgaggcgggctgggcaaggcgcatagnnnnnnnnnnnnn

SEQ ID NO: 185968 - DNA, 434 bp, Homo sapiens
  misc_feature: GYAE6OF02FKKOD.30.68.G02.1.454.CMB.1.raw
  modified_base (425)..(434): a, c, t, g, unknown or other
  misc_feature (425)..(434): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggccccatcggtcttccccctggcaccctcctccaagagcacctctgggggcacagcagccctgggctgcctggtcaaggctacttccacgtagcgtgctgagcgggctggcaaggcgcatagnnnnnnnnnn

SEQ ID NO: 185969 - DNA, 444 bp, Homo sapiens
  misc_feature: GYAE6OF02GNNIK.30.68.G02.1.454.CMB.1.raw
  modified_base (425)..(425): a, c, t, g, unknown or other
  misc_feature (425)..(425): n is a, c, g, or t
  modified_base (427)..(444): a, c, t, g, unknown or other
  misc_feature (427)..(444): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggcaccctcctccaagcgcacctctggggcacagcagccctgggctgcctgtcaaggactacttccacgtagcgtgctgagcgggctgggcaaggcgcagtagngnnnnnnnnnnnnnnnnnn

SEQ ID NO: 185970 - DNA, 444 bp, Homo sapiens
  misc_feature: GYAE6OF02GWVWM.30.68.G02.1.454.CMB.1.raw
  modified_base (437)..(444): a, c, t, g, unknown or other
  misc_feature (437)..(444): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccgggggcaccctggtcagcgtctcctcagcctccaccaagggcccatccggtccttccccctcggccacccctcctccaacgacgccacctcctgggggccacacgcagccctgggctgcctggtcaaggactacttccacgtgcgtgctgagcgggctggcaaggcgcatagnnnnnnnn

SEQ ID NO: 185971 - DNA, 434 bp, Homo sapiens
  misc_feature: GYAE6OF02HZSG6.30.68.G02.1.454.CMB.1.raw
  modified_base (421)..(434): a, c, t, g, unknown or other
  misc_feature (421)..(434): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttcccctggcaccctcctccaagagcacctctggggcacagcagccctgggctgcctggtcaggctactccacgtagcgtgctgagcgggctggcaaggcgcatagnnnnnnnnnnnnnn

SEQ ID NO: 185972 - DNA, 434 bp, Homo sapiens
  misc_feature: GYAE6OF02HLDR8.30.68.G02.1.454.CMB.1.raw
  modified_base (424)..(434): a, c, t, g, unknown or other
  misc_feature (424)..(434): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtggggagttacaaggcatacttccaccactggggccggggcaccctggtcagcgtctcctcagcctccaccaagggcccatcggtcttccccctggcaccctcctccaagagcacctctgggggcacagcagccctgggctgcctggtcaaggctacttcacgtagcgtgctgagcgggctggcaggcgcatagnnnnnnnnnnn

SEQ ID NO: 185973 - DNA, 444 bp, Homo sapiens
  misc_feature: GYAE6OF02H84JM.30.68.G02.1.454.CMB.1.raw
  modified_base (420)..(420): a, c, t, g, unknown or other
  misc_feature (420)..(420): n is a, c, g, or t
  modified_base (429)..(444): a, c, t, g, unknown or other
  misc_feature (429)..(444): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggattacaaggcatacttccaccactggggccgggcaccctggtcagcgtctcctcagcctccacaacgggcccatccggtcttccccctggccaccctcctccaagcgccacctcgtcggggcacagcacgccctgggctgcctggcagctactccacgtagcgtgctgagcgggctggccaagggcncgaatacgnnnnnnnnnnnnnnnn

SEQ ID NO: 185974 - DNA, 453 bp, Homo sapiens
  misc_feature: GYAE6OF02ISOUI.30.68.G02.1.454.CMB.1.raw
  modified_base (276)..(276): a, c, t, g, unknown or other
  misc_feature (276)..(276): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
  modified_base (406)..(406): a, c, t, g, unknown or other
  misc_feature (406)..(406): n is a, c, g, or t
  modified_base (413)..(413): a, c, t, g, unknown or other
  misc_feature (413)..(413): n is a, c, g, or t
  modified_base (421)..(421): a, c, t, g, unknown or other
  misc_feature (421)..(421): n is a, c, g, or t
  modified_base (428)..(434): a, c, t, g, unknown or other
  misc_feature (428)..(434): n is a, c, g, or t
  modified_base (436)..(453): a, c, t, g, unknown or other
  misc_feature (436)..(453): n is a, c, g, or t
tcagcacgctacgtcacgaccggtgctcgatttagtcgatagtgaagggaaagggggacgtgggaagtagggtcgtcaagtattgtctggtagtggtgatagcacatactacgcagccatcgtgaagggccggttcaccatctccagggacagttcgaagaacacactgttctgcaaatgaacagcctgagagtcgagggactacggcctatattactgtgcgctttcaccctggagtgggagttacaaggcatacttccgacactgggccggggnacccgtggtcagcgcgtcctcagcctccaccaaggcccatcggtctcccctggccaccctcctccaagacgccacctcgcggggcacngcacgccnggcngcctggtcagctactccacgtgcngtcngngcggtcngtcagcgnctagtcnnnnnnncnnnnnnnnnnnnnnnnnn

SEQ ID NO: 185975 - DNA, 445 bp, Homo sapiens
  misc_feature: GYAE6OF02HOXSP.30.68.G02.1.454.CMB.1.raw
  modified_base (436)..(445): a, c, t, g, unknown or other
  misc_feature (436)..(445): n is a, c, g, or t
tcagcacgctacgtcacgaccggtgctcgatttagtcgatagtgaagggaaaggggctggaatgggtctcaagtattgctggtagtggtaatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttcaccacgtggggccggggcaccctggtcagcgtctcctcagcctccaccaagggcccatcggtccttccccctggccacccctcctccaagacgcaccctcgtgggggcacgagcagccctgggctgcctggtcaaggactactccacgtacgcgtgctggaggcgggctggacgaggcgcatagnnnnnnnnnn

SEQ ID NO: 185976 - DNA, 448 bp, Homo sapiens
  misc_feature: GYAE6OF02JLT8C.30.68.G02.1.454.CMB.1.raw
  modified_base (429)..(431): a, c, t, g, unknown or other
  misc_feature (429)..(431): n is a, c, g, or t
  modified_base (433)..(448): a, c, t, g, unknown or other
  misc_feature (433)..(448): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtcttccccctggccaccctcctccacgacgcacctctggggccacagcagccctgggctgcctggtcaaggactacttccacgtacgcgtgctgacgcgggctggcaggcgcagtagnnnannnnnnnnnnnnnnnn

SEQ ID NO: 185977 - DNA, 430 bp, Homo sapiens
  misc_feature: GYAE6OF02GQJ4M.30.68.G02.1.454.CMB.1.raw
  modified_base (422)..(430): a, c, t, g, unknown or other
  misc_feature (422)..(430): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggcccatcggtctcccctggcaccctcctccaagagcacctctggggcacagcagccctgggctgcctggtcaagggactacttccacgtagcgtgctgagcgggctggcaaggcgcatgnnnnnnnnn

SEQ ID NO: 185978 - DNA, 429 bp, Homo sapiens
  misc_feature: GYAE6OF02GITFT.30.68.G02.1.454.CMB.1.raw
  modified_base (337)..(337): a, c, t, g, unknown or other
  misc_feature (337)..(337): n is a, c, g, or t
  modified_base (424)..(429): a, c, t, g, unknown or other
  misc_feature (424)..(429): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccgggcacctggtcagcgtctcctcagcctccaccaagggcccatcggtcttcccctggccaccctcctccaagngccacctcgtggggcacagcagccctgggctgcctggtcaaggactactccacgtagcgtgctgagcgggctggcaggcgcatacgnnnnnn

SEQ ID NO: 185979 - DNA, 439 bp, Homo sapiens
  misc_feature: GYAE6OF02HE6JS.30.68.G02.1.454.CMB.1.raw
  modified_base (424)..(439): a, c, t, g, unknown or other
  misc_feature (424)..(439): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttcccctgcaccctcctccaagagcacctctgggggcacagcagccctgggctgcctggtcaaggctacttccacgtagcgtgctgagcgggctggcaaggcgcatacgnnnnnnnnnnnnnnnn

SEQ ID NO: 185980 - DNA, 452 bp, Homo sapiens
  misc_feature: GYAE6OF02G4P36.30.68.G02.1.454.CMB.1.raw
  modified_base (441)..(452): a, c, t, g, unknown or other
  misc_feature (441)..(452): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccacactggggccggggcaccctggtcagcgtctcctcagcctccaccaagggcccatcggtccttccccctggccacccctcctccaagacgccacctctgggggcacagcacgccctagggctcgccgtgtcaaggctactccacgtagcgtgctgacggcgggctcgggacgaaggcgcacgttagcnnnnnnnnnnnn

SEQ ID NO: 185981 - DNA, 475 bp, Homo sapiens
  misc_feature: GYAE6OF02GY35I.30.68.G02.1.454.CMB.1.raw
  modified_base (458)..(475): a, c, t, g, unknown or other
  misc_feature (458)..(475): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaacgggcccatccggtcctccccctcggccacccctcctccaacgacgccacctccgtcgggggccacgacgcgacgcccgtagggcctcggccgtggtccaacggtactaccttccacgtacgcgtgctggagcgggctgggcgaaggcgcagtacgnnnnnnnnnnnnnnnnnn

SEQ ID NO: 185982 - DNA, 427 bp, Homo sapiens
  misc_feature: GYAE6OF02GX0O2.30.68.G02.1.454.CMB.1.raw
  modified_base (423)..(427): a, c, t, g, unknown or other
  misc_feature (423)..(427): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgcttttcaccctggagtgggagttacaaggcatacttccaccactggggccggggcaccctggtcagcgtctcctcagcctccaccaagggcccatcggtcttccccctggcaccctcctccagagcacctctgggggcacagcagccctgggctgcctggtcaggactactccacgtagcgtgctgagcgggctggcaggcgcatagnnnnn

SEQ ID NO: 185983 - DNA, 453 bp, Homo sapiens
  misc_feature: GYAE6OF02ICAQV.30.68.G02.1.454.CMB.1.raw
  modified_base (334)..(334): a, c, t, g, unknown or other
  misc_feature (334)..(334): n is a, c, g, or t
  modified_base (343)..(343): a, c, t, g, unknown or other
  misc_feature (343)..(343): n is a, c, g, or t
  modified_base (435)..(453): a, c, t, g, unknown or other
  misc_feature (435)..(453): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccgggcaccctggtcagcgtctcctcagcctccacaacggcccatcggtctcccctgccacctcctccagngcacctcgnggggcacagcacgcctcggctcgccgtggtacaaggactaccgttaccacgtacgcgtacgctggtacgcgggctggcgaaggcgacatagnnnnnnnnnnnnnnnnnnn

SEQ ID NO: 185984 - DNA, 384 bp, Homo sapiens
  misc_feature: GYAE6OF02ILZVA.30.68.G02.1.454.CMB.1.raw
  modified_base (379)..(384): a, c, t, g, unknown or other
  misc_feature (379)..(384): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgcagtttattattgtcagcactataacaattggcctccggaaacttttggccaggggaccaagcttgagatcaaacgaactgtggctgcaccatctgtcttcatctcccgcatctgaacgtagcgtgctgagcgggctggcaaggcgcatagnnnnnn

SEQ ID NO: 185985 - DNA, 437 bp, Homo sapiens
  misc_feature: GYAE6OF02IJNFZ.30.68.G02.1.454.CMB.1.raw
  modified_base (337)..(337): a, c, t, g, unknown or other
  misc_feature (337)..(337): n is a, c, g, or t
  modified_base (427)..(437): a, c, t, g, unknown or other
  misc_feature (427)..(437): n is a, c, g, or t
tcagcacgctacgtcacgaccggtgctcgatttagtcgatagtgaagggaaagggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtctcccctgcaccctcctccaagngcacctctgggggcacagcacgccctgggctgcctggtcaaggactaccttccacgtagcgtgctgagcgggctggcaaggcgcatacgnnnnnnnnnnn

SEQ ID NO: 185986 - DNA, 433 bp, Homo sapiens
  misc_feature: GYAE6OF02IKXS2.30.68.G02.1.454.CMB.1.raw
  modified_base (412)..(412): a, c, t, g, unknown or other
  misc_feature (412)..(412): n is a, c, g, or t
  modified_base (420)..(420): a, c, t, g, unknown or other
  misc_feature (420)..(420): n is a, c, g, or t
  modified_base (425)..(433): a, c, t, g, unknown or other
  misc_feature (425)..(433): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtccttccccctggccacccctcctccaagacgcacctctggggcacagcagccctggctgcctggtcaaggactactccacgtagcgtgctgagcgggcnggcaggcncatgnnnnnnnnn

SEQ ID NO: 185987 - DNA, 432 bp, Homo sapiens
  misc_feature: GYAE6OF02FH9OE.30.68.G02.1.454.CMB.1.raw
  modified_base (425)..(432): a, c, t, g, unknown or other
  misc_feature (425)..(432): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaagggccatcggtcttccccctggcaccctcctccaagacgcacctctggggggcacagcagccctgggctcgcctggtcaggactacttccacgtagcgtgctgagcgggctggcaaggcgcatgnnnnnnnn

SEQ ID NO: 185988 - DNA, 428 bp, Homo sapiens
  misc_feature: GYAE6OF02F7WJX.30.68.G02.1.454.CMB.1.raw
  modified_base (373)..(373): a, c, t, g, unknown or other
  misc_feature (373)..(373): n is a, c, g, or t
  modified_base (375)..(375): a, c, t, g, unknown or other
  misc_feature (375)..(375): n is a, c, g, or t
  modified_base (377)..(377): a, c, t, g, unknown or other
  misc_feature (377)..(377): n is a, c, g, or t
  modified_base (410)..(410): a, c, t, g, unknown or other
  misc_feature (410)..(410): n is a, c, g, or t
  modified_base (424)..(428): a, c, t, g, unknown or other
  misc_feature (424)..(428): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccacgggacgagttcgaagaacacactgtttctgcaaatagacagcctgagagtcgaggacacggccgtatattactgtgcgctttcaccctggagtgggagttacaagcgatacttccaccactggggccggggccacctcggtcagcgtctcctcagccctccaccaagggcccatcggtccttccccctggacaccctccctcaagagcacctcgtggggcacagcagtcctggncncngtacagctactccagcgcgtgctgagcgggtcngacaaggcgcatgnnnnn

SEQ ID NO: 185989 - DNA, 436 bp, Homo sapiens
  misc_feature: GYAE6OF02IOOC3.30.68.G02.1.454.CMB.1.raw
  modified_base (427)..(436): a, c, t, g, unknown or other
  misc_feature (427)..(436): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggccacccctcctccaagagccacctctgggggcacagcagccctgggctgcctggtcaaggactactcacgtagcgtgctgagcgggctggcaaggcgcatagnnnnnnnnnn

SEQ ID NO: 185990 - DNA, 438 bp, Homo sapiens
  misc_feature: GYAE6OF02FO6WE.30.68.G02.1.454.CMB.1.raw
  modified_base (309)..(309): a, c, t, g, unknown or other
  misc_feature (309)..(309): n is a, c, g, or t
  modified_base (427)..(438): a, c, t, g, unknown or other
  misc_feature (427)..(438): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgcttttcaccctggagtgggagttacaaggcatacttccaccactggggccggggcaccctggtcagcgtctcctcagcctcaccaagggcccancggtcttccccctggcacctcctccaagagcacctctgggggcacagcagccctgggctgcctggtcaaggactacttccacgtacgcgtgctgagcgggctggcaagggcgcatagnnnnnnnnnnnn

SEQ ID NO: 185991 - DNA, 430 bp, Homo sapiens
  misc_feature: GYAE6OF02J0BCT.30.68.G02.1.454.CMB.1.raw
  modified_base (304)..(304): a, c, t, g, unknown or other
  misc_feature (304)..(304): n is a, c, g, or t
  modified_base (385)..(385): a, c, t, g, unknown or other
  misc_feature (385)..(385): n is a, c, g, or t
  modified_base (390)..(430): a, c, t, g, unknown or other
  misc_feature (390)..(430): n is a, c, g, or t
tcagcacgctacgtcacgaccggtgctcgatttagtcgatagtgaagggaaaggggcgagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagtattttgctagtttatatgtacagcactataacattggcctccgaattttggcagggaccagctgagatacaaacgactgnggctgcaccattctgtcttcattcctacccgctatctagaactgctcgctgacgcggctcggcaagggcctcaagtagctnacgtnnnnnnnnnnnnnnnnnnnnnnnnnnnnnnnnnnnnnnnnn

SEQ ID NO: 185992 - DNA, 421 bp, Homo sapiens
  misc_feature: GYAE6OF02FKU26.30.68.G02.1.454.CMB.1.raw
  modified_base (401)..(421): a, c, t, g, unknown or other
  misc_feature (401)..(421): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgcagtttattattgtcagcactataacaattggcctccggaaacttttggccggacgggacagtctgagatacgaaacgactggtgctgcacatctgttctcacttcctcccgctatcgtacgtaacgtagcgtgctggacggtcgggtcgtcggacgacggcgacgtagtacgnnnnnnnnnnnnnnnnnnnnn

SEQ ID NO: 185993 - DNA, 471 bp, Homo sapiens
  misc_feature: GYAE6OF02I0PI5.30.68.G02.1.454.CMB.1.raw
  modified_base (444)..(444): a, c, t, g, unknown or other
  misc_feature (444)..(444): n is a, c, g, or t
  modified_base (446)..(471): a, c, t, g, unknown or other
  misc_feature (446)..(471): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccgggcaccctggtcagcgtctcctcagcctccaccaagggcccatcggtccttcccccgtcggccacccctcctccaacgacgccacctcgtggggcacagcacgccctgggctcgcctggtcaacggtactacttccgacgtacgcgtgctggacgcgggcgtggcgacggcgcagtgcngnnnnnnnnnnnnnnnnnnnnnnnnnn

SEQ ID NO: 185994 - DNA, 438 bp, Homo sapiens
  misc_feature: GYAE6OF02F0VW1.30.68.G02.1.454.CMB.1.raw
  modified_base (428)..(438): a, c, t, g, unknown or other
  misc_feature (428)..(438): n is a, c, g, or t
tcagcacgctacgtcacgaccggtgctcgatttagtcgatagtgaagggaaaggggctggaatgggtcccaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccgggcaccctggtcagcgtctcctcagcctccaccaaggcccatccggtcttcccccctggccacccctcctccaagacgcacctctgggggcacagcagccctgggctgcctggtcaaggctacttccacgtagcgtgctgagcgggctggcaaggcgcatagnnnnnnnnnnn

SEQ ID NO: 185995 - DNA, 432 bp, Homo sapiens
  misc_feature: GYAE6OF02FW788.30.68.G02.1.454.CMB.1.raw
  modified_base (425)..(432): a, c, t, g, unknown or other
  misc_feature (425)..(432): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccatgggccggggcaccctggtcagcgtctcctcagcctccaccaagggcccatcggtcttccccctggccacctccctccaagagcacctctgggggcacagcagccctgggctgcctggtcaaggactacttccacgtagcgtgctgagcgggctggcaaggcgcatagnnnnnnnn

SEQ ID NO: 185996 - DNA, 433 bp, Homo sapiens
  misc_feature: GYAE6OF02II85S.30.68.G02.1.454.CMB.1.raw
  modified_base (425)..(427): a, c, t, g, unknown or other
  misc_feature (425)..(427): n is a, c, g, or t
  modified_base (429)..(433): a, c, t, g, unknown or other
  misc_feature (429)..(433): n is a, c, g, or t
tcagcacgctacgtcacgaccggtgctcgatttagtcgatagtgaagggaaagggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagagcacctctggggcacagcagccctgggctgcctggtcaaggactacttccacgtagcgtgctgagcgggctggcaggcgcatagnnngnnnnn

SEQ ID NO: 185997 - DNA, 434 bp, Homo sapiens
  misc_feature: GYAE6OF02FI91W.30.68.G02.1.454.CMB.1.raw
  modified_base (416)..(416): a, c, t, g, unknown or other
  misc_feature (416)..(416): n is a, c, g, or t
  modified_base (422)..(434): a, c, t, g, unknown or other
  misc_feature (422)..(434): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgcttttcaccctggagtgggagttacaaggcatacttccaccactgggccggggcaccctggtcagcgtctcctcagcctccaccaaggcccatcgtcttccccctggcacctcctccaagagcacctctgggggcacagcagccctgggctgcctggtcaaggactacttccacgtagcgtgctgagcgggctggcaggcncatagnnnnnnnnnnnnn

SEQ ID NO: 185998 - DNA, 474 bp, Homo sapiens
  misc_feature: GYAE6OF02GJA67.30.68.G02.1.454.CMB.1.raw
  modified_base (452)..(474): a, c, t, g, unknown or other
  misc_feature (452)..(474): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccgggcaccctggtcagcgtctcctcagccctcaccaagggccccatccggtccttccccctggccacccctcctaccaacgacgccaccctctgggggccacagcagccctgggcctgcctggtcaaggccttacttccgacgtacgcgtacgcctgacggcgggctcgggcaagggccgacataggcnnnnnnnnnnnnnnnnnnnnnnn

SEQ ID NO: 185999 - DNA, 453 bp, Homo sapiens
  misc_feature: GYAE6OF02IF7BO.30.68.G02.1.454.CMB.1.raw
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
  modified_base (432)..(453): a, c, t, g, unknown or other
  misc_feature (432)..(453): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaaggcccatcggtcctccccgtgcaccctctccaagcncacncgtggggcacagcacgccctgggctcgcctggtcaaggacctacttccacgtagcgtgctggacgcgggctggacgaaggcgacagtacgnnnnnnnnnnnnnnnnnnnnnn

SEQ ID NO: 186000 - DNA, 488 bp, Homo sapiens
  misc_feature: GYAE6OF02GW6KB.30.68.G02.1.454.CMB.1.raw
  modified_base (462)..(488): a, c, t, g, unknown or other
  misc_feature (462)..(488): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccggggcaccctggtcagcgtctcctcagcctccaccaacgggcccagtccggtccttcccccgtggcccacccctccctaccaacgagccacctcgtggggccacagcacgcccgtgggcctgccgtggtccaaggactaccttccgaacgtagcgtcgctggacgcgggctcggacgaacggccgacgtagtaacgnnnnnnnnnnnnnnnnnnnnnnnnnnn

SEQ ID NO: 186001 - DNA, 437 bp, Homo sapiens
  misc_feature: GYAE6OF02FYV65.30.68.G02.1.454.CMB.1.raw
  modified_base (427)..(437): a, c, t, g, unknown or other
  misc_feature (427)..(437): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagagcacctcgtgggggcacagcacgccctgggctgcctggtcaaggctactccacgtacgcgtgctgacgcgggctggcaggcgcatagnnnnnnnnnnn

SEQ ID NO: 186002 - DNA, 519 bp, Homo sapiens
  misc_feature: GYAE6OF02IF1K9.30.68.G02.1.454.CMB.1.raw
  modified_base (168)..(168): a, c, t, g, unknown or other
  misc_feature (168)..(168): n is a, c, g, or t
  modified_base (180)..(180): a, c, t, g, unknown or other
  misc_feature (180)..(180): n is a, c, g, or t
  modified_base (210)..(210): a, c, t, g, unknown or other
  misc_feature (210)..(210): n is a, c, g, or t
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
  modified_base (371)..(371): a, c, t, g, unknown or other
  misc_feature (371)..(371): n is a, c, g, or t
  modified_base (385)..(385): a, c, t, g, unknown or other
  misc_feature (385)..(385): n is a, c, g, or t
  modified_base (488)..(488): a, c, t, g, unknown or other
  misc_feature (488)..(488): n is a, c, g, or t
  modified_base (491)..(493): a, c, t, g, unknown or other
  misc_feature (491)..(493): n is a, c, g, or t
  modified_base (495)..(519): a, c, t, g, unknown or other
  misc_feature (495)..(519): n is a, c, g, or t
tcagcacgctacgtcacgaccggtgctcgatttagtcgatagtgaagggaaaggggacgtggaatgggtcgtcaagtattgctggtagtggtgatagcacatactacgcagccatcgtgaagggccggtcaccatctccagggacagttcgaagaacacactgtttcngcaaatgaaacngcctgagagtcgaggtacacggtccgtaanatttacgngtgcgctttnaccctggagttgggagttacaaggcatacttccaccatgggccgggcgaccctggtcagcgtctcctacgacgccttcccaccgaagggcccatccggtcgttccccctaggccaccccgtcctccaacgaacgccacccgtntcgggggcaaccgngccagcccgtcgggtctcgaccgtgtacaacgggacttacctcgacgtagcgtcgtagcgtaaggcgggtcctggaccgaaggcggcaaacggtgtgacacgncgnnncnnnnnnnnnnnnnnnnnnnnnnnnn

SEQ ID NO: 186003 - DNA, 461 bp, Homo sapiens
  misc_feature: GYAE6OF02I2URP.30.68.G02.1.454.CMB.1.raw
  modified_base (258)..(258): a, c, t, g, unknown or other
  misc_feature (258)..(258): n is a, c, g, or t
  modified_base (441)..(461): a, c, t, g, unknown or other
  misc_feature (441)..(461): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacnggggccggggcaccctggtcagcgtctcctctagcctccaccaagggcccatcggtcttccccctggccaccctcctccaagacgcacctctgggggcacagcacgcccgtggctcgcctggtcaagggactacctccacgtacgcgtcgcgtgaggcgggcgtggacaaggccgcgattagnnnnnnnnnnnnnnnnnnnnn

SEQ ID NO: 186004 - DNA, 487 bp, Homo sapiens
  misc_feature: GYAE6OF02FQO1N.30.68.G02.1.454.CMB.1.raw
  modified_base (397)..(397): a, c, t, g, unknown or other
  misc_feature (397)..(397): n is a, c, g, or t
  modified_base (467)..(467): a, c, t, g, unknown or other
  misc_feature (467)..(467): n is a, c, g, or t
  modified_base (469)..(481): a, c, t, g, unknown or other
  misc_feature (469)..(481): n is a, c, g, or t
  modified_base (483)..(487): a, c, t, g, unknown or other
  misc_feature (483)..(487): n is a, c, g, or t
tcagcacgctacgtcacgaccggtgctcgatttagtcgatagtgaagggaaagggggctgggaattgggtctcaagtattgctggtagtggtgactagcacatactacgcagccatcgtgaagggccggttcacccatctccagggacagttcgaagaacgacactgtttctgcaaatgaacaggcctgagagtcgaggacacggtccgtatattactgtgcgctttcacctggaagtcgggagttacaaggctataccttccaccactggggccggggcaccgtggtcacgcgtcctctcacgcctccaccagggcccagtccggtccttcccccttggccacccctccctccaagacgccacctcgtcgggggccacgagcaggcccgtgggtcncggtcctggtcaacggtacctacttccacgttacgtcgtgctggcggcgggtcgcggcaggcgacatagnannnnnnnnnnnnncnnnnn

SEQ ID NO: 186005 - DNA, 501 bp, Homo sapiens
  misc_feature: GYAE6OF02HKLE7.30.68.G02.1.454.CMB.1.raw
  modified_base (468)..(501): a, c, t, g, unknown or other
  misc_feature (468)..(501): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatactccacacgtggggccgggcaccctggtcagcgtctcctcacgcctccaccgaacgggcccacgtccggtccttcccccgtggcccacccctcctccaacgtacgccaccgtcgtcggggcacgcgcacgcccgtggctgcctggtacaacggacctacgtccacggtacgcgtgcgtaggacggtcgggtcgtcgggacgaacggtccgacagtagcgannnnnnnnnnnnnnnnnnnnnnnnnnnnnnnnnn

SEQ ID NO: 186006 - DNA, 446 bp, Homo sapiens
  misc_feature: GYAE6OF02IYSJX.30.68.G02.1.454.CMB.1.raw
  modified_base (335)..(335): a, c, t, g, unknown or other
  misc_feature (335)..(335): n is a, c, g, or t
  modified_base (425)..(446): a, c, t, g, unknown or other
  misc_feature (425)..(446): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcacctggagtgggagttacaaggcatacttccaccactgggccggggcaccctggtcagcgtctcctcagcctccaccaagggcccatcggtcttcccctggcaccctcctccagngcacctctggggcacagcagccctgggctgcctggtcaggactacttccacgtagcgtgctgacggcgggctgggcaagggccgcatagnnnnnnnnnnnnnnnnnnnnnn

SEQ ID NO: 186007 - DNA, 553 bp, Homo sapiens
  misc_feature: GYAE6OF02I7EEW.30.68.G02.1.454.CMB.1.raw
  modified_base (522)..(553): a, c, t, g, unknown or other
  misc_feature (522)..(553): n is a, c, g, or t
tcagcacgctacgtcacgaccggtgctcgatttagtcgatagtgaagggaaaggggctggaatgggtctcaagtattgctggtagtggtgatagcacatactacgcagccatcgtgagggccgttcacatctccagggacagttcgaagaacacactgtttctgacaaatgaacagcctgagagtcgaggacacggccgtatattactgtgcgtctttccacccgtggagtgggagttacaaggcatacctccaccacgtgggggccggggaccacccgtggtcacggcgtcctccctcacgcccctccaaccgaacggggccccagttccggtccttcccccgtggcccacccctcctaccaagcgccaccgtcggtcggggaccacgacgccacggcccctgggcctcgtccgtgggtaccaaacggtaccttaccgtaccgtaaccgtaggtcccgtggtccgttaggacgggtccgggcgttcgggaccggtaaacgggccgacctacgttaaggctnnnnnnnnnnnnnnnnnnnnnnnnnnnnnnnn

SEQ ID NO: 186008 - DNA, 456 bp, Homo sapiens
  misc_feature: GYAE6OF02H569S.30.68.G02.1.454.CMB.1.raw
  modified_base (441)..(456): a, c, t, g, unknown or other
  misc_feature (441)..(456): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgtaaatgaacaccctgagagtcgaggacacggccgtatattactgtgcgctttcaccctggagtgggagttacaaggcatacttccaccacgtggggcccggggcaccctggtcagcgtctcctcagcctccaccaagggcccatcggtcttccccctggccaccctcctccaagacgccacctcgtcgggggcacagcacgcctgggcctcgcctggtccaaggacctacgttaccacgtacgcgtcgcgtgagcgggctggcgaggcgcatgnnnnnnnnnnnnnnnn

SEQ ID NO: 186009 - DNA, 394 bp, Homo sapiens
  misc_feature: GYAE6OF02HV3LG.30.68.G02.1.454.CMB.1.raw
  modified_base (383)..(394): a, c, t, g, unknown or other
  misc_feature (383)..(394): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcacatcagcagcctgcagtctgaagtattttgctagttttattattgtcagcactataacaattggcctcggaaacttttggccagggaccaagcttgagatcaaacgaactgtggctgcaccatctgtcttcatcttcccgctatctagaacgtagcgtgctgagcgggtctggcaaggcgcatagnnnnnnnnnnnn

SEQ ID NO: 186010 - DNA, 449 bp, Homo sapiens
  misc_feature: GYAE6OF02IFJ3Q.30.68.G02.1.454.CMB.1.raw
  modified_base (434)..(434): a, c, t, g, unknown or other
  misc_feature (434)..(434): n is a, c, g, or t
  modified_base (439)..(449): a, c, t, g, unknown or other
  misc_feature (439)..(449): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccggggcacccctggtcagcgtctcctcagcctccaccaagggcccatcggtccttccccctggccacccctcctccaacgacgcaccctcgtggggcacacgcacgcccgtgggctcgcctggtcaaggtctacttccacgtacgcgtgctgagcgggctgggcaggcgnatagnnnnnnnnnnn

SEQ ID NO: 186011 - DNA, 491 bp, Homo sapiens
  misc_feature: GYAE6OF02IZJDC.30.68.G02.1.454.CMB.1.raw
  modified_base (235)..(235): a, c, t, g, unknown or other
  misc_feature (235)..(235): n is a, c, g, or t
  modified_base (251)..(251): a, c, t, g, unknown or other
  misc_feature (251)..(251): n is a, c, g, or t
  modified_base (460)..(462): a, c, t, g, unknown or other
  misc_feature (460)..(462): n is a, c, g, or t
  modified_base (464)..(491): a, c, t, g, unknown or other
  misc_feature (464)..(491): n is a, c, g, or t
tcagcacgctacgtcacgaccggtgctcgatttagtcgatagtgaagggaaaggggcgtggaatgggtctcaagtattgctggtagtggtgatagcacatactacgcagccatcgtgaagggccggttcaccatctccagggacagttcgaagaacacactgttctgcaaatgacagcctgagagtcgaggcacggccgtatatactgtgacgctttcaccctggatgggattanaaggcatacttcaccntgggcggggcacctggtcagcgtctcctcacgctccacctaagggccccatccgggtcttcccccgtcggccgaccctccgtccaacgcgcacctcctgggggccacgacgcgacgcccgtacgggctcgcccgtgctaacggggacctacttcccgacgtacgccggtcgtcgtgacgcgggcgtggacgtaacggcgcagtggcagnnnannnnnnnnnnnnnnnnnnnnnnnnnnnn

SEQ ID NO: 186012 - DNA, 543 bp, Homo sapiens
  misc_feature: GYAE6OF02IS4HU.30.68.G02.1.454.CMB.1.raw
  modified_base (216)..(216): a, c, t, g, unknown or other
  misc_feature (216)..(216): n is a, c, g, or t
  modified_base (254)..(254): a, c, t, g, unknown or other
  misc_feature (254)..(254): n is a, c, g, or t
  modified_base (341)..(341): a, c, t, g, unknown or other
  misc_feature (341)..(341): n is a, c, g, or t
  modified_base (365)..(365): a, c, t, g, unknown or other
  misc_feature (365)..(365): n is a, c, g, or t
  modified_base (392)..(392): a, c, t, g, unknown or other
  misc_feature (392)..(392): n is a, c, g, or t
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
  modified_base (509)..(511): a, c, t, g, unknown or other
  misc_feature (509)..(511): n is a, c, g, or t
  modified_base (513)..(528): a, c, t, g, unknown or other
  misc_feature (513)..(528): n is a, c, g, or t
  modified_base (530)..(543): a, c, t, g, unknown or other
  misc_feature (530)..(543): n is a, c, g, or t
tcagcacgctacgtcacgaccggtgctcgatttagtcgatagtgaagggaaagggggacgtgggaatgggtcgtcaagtattgctggtagtggtgatagcacatactacgcagccatcgtgaagggccggttcaccatctccagggacagttcgaagaacacactgtttctgcaaatgaacagcctgagagtcgaggacacggccgtatattaacngtgcgctttcaccctggaagtggggagttaacaaggcnttaatcccaccactggggcccggggacaccctggtacaggcgtcctcctcacgcctcccaaccgaagggcccagtcgtccttccccnggccaccctccctacaagacgccncctacggtcggggcacagccacgcccnggggcctgccgttgcaaaacgggaccttacgttccctaaacgggagtccggttcgcgtagggaccgggtccgggccggttagggcgtaaaaccgggcgtacccgaagaagcgngngnnngnnnnnnnnnnnnnnnngnnnnnnnnnnnnnn

SEQ ID NO: 186013 - DNA, 435 bp, Homo sapiens
  misc_feature: GYAE6OF02IEXMI.30.68.G02.1.454.CMB.1.raw
  modified_base (429)..(435): a, c, t, g, unknown or other
  misc_feature (429)..(435): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtccttccccctggccacccctcctccaagagcacctcgtgggggcacagcacgccctggctgcctggtcaaggactacttccacgtagcgtgctgagcgggctggcaggcgcatagnnnnnnn

SEQ ID NO: 186014 - DNA, 582 bp, Homo sapiens
  misc_feature: GYAE6OF02IBG15.30.68.G02.1.454.CMB.1.raw
  modified_base (322)..(322): a, c, t, g, unknown or other
  misc_feature (322)..(322): n is a, c, g, or t
  modified_base (505)..(505): a, c, t, g, unknown or other
  misc_feature (505)..(505): n is a, c, g, or t
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
  modified_base (550)..(550): a, c, t, g, unknown or other
  misc_feature (550)..(550): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (568)..(569): a, c, t, g, unknown or other
  misc_feature (568)..(569): n is a, c, g, or t
  modified_base (571)..(572): a, c, t, g, unknown or other
  misc_feature (571)..(572): n is a, c, g, or t
  modified_base (574)..(574): a, c, t, g, unknown or other
  misc_feature (574)..(574): n is a, c, g, or t
  modified_base (576)..(578): a, c, t, g, unknown or other
  misc_feature (576)..(578): n is a, c, g, or t
  modified_base (580)..(582): a, c, t, g, unknown or other
  misc_feature (580)..(582): n is a, c, g, or t
tcagcacgctacgtcacgaccggtgctcgatttagtcgatagtgaagggaaaggggcgtggaatgggtctcaagtattgctggtagtggtgatagcacatactacgcagccatcgtgaagggccggttcaccatctccagggacagttcgaagaacacactgttctgcaaatgaacagcctgagagtcgaggacacggccgtatattactgtgcgctttcaccctggagtgggagttacaaggcatacttccaccactggggccggggcacccgtggtcagcgtctcctcagcctccaccaacggccatcggtccttccccnggtccaccctccctccaacgacgccaccgtcgtcggggcacgagacctacgcccgtggggccttcggcccgtacgggttaccaaaacggggtaccttacccgtttaccgaaccggtacggttccggtacggtcgtttacggggaacggcccgggggtcgttcggggaaccgaaacgggggccnccgtttaaaacggtacgcgtgcgcgcgcgcgcgcgncncgcgcgncgcgcgcancngngtcgnncnncncnnncnnn

SEQ ID NO: 186015 - DNA, 477 bp, Homo sapiens
  misc_feature: GYAE6OF02H34LN.30.68.G02.1.454.CMB.1.raw
  modified_base (461)..(477): a, c, t, g, unknown or other
  misc_feature (461)..(477): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcacccgtggtcagcgtctcctcagcctccaccaacgggcccatccggtccttcccccgtggccacccctcctccaacgacgccaccctcgtcgggggccacgagccacgccctggggctcggcctgggtcaacggacttaccttccgacgtacgcgtgctggacggcgggactgggacaagggccgcagtagnnnnnnnnnnnnnnnnn

SEQ ID NO: 186016 - DNA, 518 bp, Homo sapiens
  misc_feature: GYAE6OF02GXT53.30.68.G02.1.454.CMB.1.raw
  modified_base (370)..(370): a, c, t, g, unknown or other
  misc_feature (370)..(370): n is a, c, g, or t
  modified_base (485)..(485): a, c, t, g, unknown or other
  misc_feature (485)..(485): n is a, c, g, or t
  modified_base (488)..(518): a, c, t, g, unknown or other
  misc_feature (488)..(518): n is a, c, g, or t
tcagcacgctacgtcacgaccggtgctcgatttagtcgatagtgaagggaaagggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccggggcaccctggtcagcgtctccctcagccctccaccgaagggccccatccggtccttccccctggccacccctcctcccaagagcaccctcgtgggggcacgngcacgcccgtgggcctcgcctggtaccaaggaccttaccgttcccgaacgttacgaccggtcgcgttggaacggtccggggtaccgtgggccgaaacgggtccggaccaagtagngcnnnnnnnnnnnnnnnnnnnnnnnnnnnnnnn

SEQ ID NO: 186017 - DNA, 444 bp, Homo sapiens
  misc_feature: GYAE6OF02FS5W5.30.68.G02.1.454.CMB.1.raw
  modified_base (431)..(432): a, c, t, g, unknown or other
  misc_feature (431)..(432): n is a, c, g, or t
  modified_base (434)..(444): a, c, t, g, unknown or other
  misc_feature (434)..(444): n is a, c, g, or t
tcagcacgctacgtcacgaccggtgctcgatttagtcgatagtgaagggaaagggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccgggggcaccctggtcagcgtctcctcagcctccaccaagggcccatcggtcttccccctggcaccctccctccaagacgcacctctgggggcacagcacgccctgggctgcctggtcaaggctacttccacgtagcgtgctgagcgggctggcgaggcgcgatagnngnnnnnnnnnnn

SEQ ID NO: 186018 - DNA, 561 bp, Homo sapiens
  misc_feature: GYAE6OF02JJYDS.30.68.G02.1.454.CMB.1.raw
  modified_base (212)..(212): a, c, t, g, unknown or other
  misc_feature (212)..(212): n is a, c, g, or t
  modified_base (518)..(518): a, c, t, g, unknown or other
  misc_feature (518)..(518): n is a, c, g, or t
  modified_base (522)..(523): a, c, t, g, unknown or other
  misc_feature (522)..(523): n is a, c, g, or t
  modified_base (525)..(525): a, c, t, g, unknown or other
  misc_feature (525)..(525): n is a, c, g, or t
  modified_base (527)..(528): a, c, t, g, unknown or other
  misc_feature (527)..(528): n is a, c, g, or t
  modified_base (530)..(531): a, c, t, g, unknown or other
  misc_feature (530)..(531): n is a, c, g, or t
  modified_base (533)..(535): a, c, t, g, unknown or other
  misc_feature (533)..(535): n is a, c, g, or t
  modified_base (537)..(546): a, c, t, g, unknown or other
  misc_feature (537)..(546): n is a, c, g, or t
  modified_base (548)..(561): a, c, t, g, unknown or other
  misc_feature (548)..(561): n is a, c, g, or t
tcagcacgctacgtcacgaccggtgctcgatttagtcgatagtgaagggaaagggggcgtggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattacngtgcgctttcacctggagtgggattacaaggcataccttccaccagtggggccggggcacccgtggtcagcgtctccgtcagcctccaccaagggtcccatccgggtccttcccccgtcgggcctaccccgtccctcctaaacgacgccgacccttcgtcggggggcaaccgagcacggcccgttggggctacggcccgttggtaccgaaagggaaccttaccttcccgaaccggttacgccggttgaccgttggacggcccgggggtcttcgggacccggaaaggccgggtactaacgttaacgngcgnngngnngnngnnngnnnnnnnnnngnnnnnnnnnnnnnn

SEQ ID NO: 186019 - DNA, 506 bp, Homo sapiens
  misc_feature: GYAE6OF02JZF2V.30.68.G02.1.454.CMB.1.raw
  modified_base (324)..(324): a, c, t, g, unknown or other
  misc_feature (324)..(324): n is a, c, g, or t
  modified_base (474)..(506): a, c, t, g, unknown or other
  misc_feature (474)..(506): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgttctgcaaatgaacagcctgagagtcgaggacacggccgtatattactgtgcgcttttcaccctggagtgggagttacaaggcatacttccaccactggggccggggcacccgtggtcagcgtctcctcagcctccaccaagggcccatcggtccttcccccnggccacccctcctccgaacgacgccacctcgtcgggggcacagccacgcccctgggcctcggcctggtccaaacgggtacctaaccgtttcccgaacgttacggccgtcgccgtgacgggtcgggctcgggaccaagggccgcagtacgnnnnnnnnnnnnnnnnnnnnnnnnnnnnnnnnn

SEQ ID NO: 186020 - DNA, 455 bp, Homo sapiens
  misc_feature: GYAE6OF02I9NUB.30.68.G02.1.454.CMB.1.raw
  modified_base (438)..(455): a, c, t, g, unknown or other
  misc_feature (438)..(455): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccaggggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaacgggcccatcggtccttcccccgtggccaccctcctccaacgacgcacctcgtcggggcacagcacgcccgtgggctcgcctggtcaaggacctactccacgtgcgtgctgagcgggctggcgaaggcgcatacgnnnnnnnnnnnnnnnnnn

SEQ ID NO: 186021 - DNA, 493 bp, Homo sapiens
  misc_feature: GYAE6OF02GBHWF.30.68.G02.1.454.CMB.1.raw
  modified_base (324)..(324): a, c, t, g, unknown or other
  misc_feature (324)..(324): n is a, c, g, or t
  modified_base (343)..(343): a, c, t, g, unknown or other
  misc_feature (343)..(343): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
  modified_base (456)..(456): a, c, t, g, unknown or other
  misc_feature (456)..(456): n is a, c, g, or t
  modified_base (459)..(459): a, c, t, g, unknown or other
  misc_feature (459)..(459): n is a, c, g, or t
  modified_base (462)..(462): a, c, t, g, unknown or other
  misc_feature (462)..(462): n is a, c, g, or t
  modified_base (466)..(469): a, c, t, g, unknown or other
  misc_feature (466)..(469): n is a, c, g, or t
  modified_base (471)..(493): a, c, t, g, unknown or other
  misc_feature (471)..(493): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccgggcacccgtggtcagcgtctcctcagcctccaccagggcccagtcggtccttcccccnggccacccctcctccaagngccacctcgtggggcacagcacgcccgtgggctcgccgtggtacaaacggtctaccttccgacgtagcgtcgcgtgacggcgggctgggacaagggccgtcagtagnactnantanctnacgnnnngnnnnnnnnnnnnnnnnnnnnnnn

SEQ ID NO: 186022 - DNA, 527 bp, Homo sapiens
  misc_feature: GYAE6OF02JJBJ9.30.68.G02.1.454.CMB.1.raw
  modified_base (490)..(490): a, c, t, g, unknown or other
  misc_feature (490)..(490): n is a, c, g, or t
  modified_base (493)..(495): a, c, t, g, unknown or other
  misc_feature (493)..(495): n is a, c, g, or t
  modified_base (499)..(499): a, c, t, g, unknown or other
  misc_feature (499)..(499): n is a, c, g, or t
  modified_base (501)..(527): a, c, t, g, unknown or other
  misc_feature (501)..(527): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtggggagttacaaggcatactccaccatgggccgggcaccctggtcagcgtctcctcagcctccaccaacgggcccactcggtccttcccccgtggccacccctccctccaagacgccacctccgtgggggccacgacgccacgccccgtggggacctcggcccttcgggtaccgaacgggaccttaccgttccgaaccggtacgaccgtcgcttcgggacggccggggtcgtgggaccgaaacgggtcgacagtagcgtngcnnncgcngnnnnnnnnnnnnnnnnnnnnnnnnnnn

SEQ ID NO: 186023 - DNA, 455 bp, Homo sapiens
  misc_feature: GYAE6OF02IVFVR.30.68.G02.1.454.CMB.1.raw
  modified_base (437)..(455): a, c, t, g, unknown or other
  misc_feature (437)..(455): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtaggggattacaaggcatacttccaccacgtggggccggggcacccctggtcagcgtctcctcacgcctccaccaagggcccacttcggtccttccccctggccacccctcctccaaagacgcacctcgtgggggcacagcagcccgtgggctgcctggcaagactacttccacgtagcgtgctgagcgggctggcaggcgacatagnnnnnnnnnnnnnnnnnnn

SEQ ID NO: 186024 - DNA, 531 bp, Homo sapiens
  misc_feature: GYAE6OF02FUW64.30.68.G02.1.454.CMB.1.raw
  modified_base (501)..(531): a, c, t, g, unknown or other
  misc_feature (501)..(531): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggattacaaggcatacttccaccactggggccggggcaccctggtcagcgtctcctcagcccctccaccgaacgggccccagtccggttcccttcccccgtggccctacccctcctacccaagacgcctacctcggtcgggggccacacgcacgccccgtgggcctcggccgtggtaccgaaacggtccttaccttcccgaacggtagcggtgcctggacgggccggggtctgggccgaaacgggtcccgacgtaacgttaggactgcgnnnnnnnnnnnnnnnnnnnnnnnnnnnnnnn

SEQ ID NO: 186025 - DNA, 433 bp, Homo sapiens
  misc_feature: GYAE6OF02HSI5P.30.68.G02.1.454.CMB.1.raw
  modified_base (424)..(433): a, c, t, g, unknown or other
  misc_feature (424)..(433): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagacgcacctctggggcacagcagccctgggctgcctggtcaaggactactcacgtagcgtgctgagcgggctggcaaggcgcatagnnnnnnnnnn

SEQ ID NO: 186026 - DNA, 455 bp, Homo sapiens
  misc_feature: GYAE6OF02GDRXW.30.68.G02.1.454.CMB.1.raw
  modified_base (439)..(455): a, c, t, g, unknown or other
  misc_feature (439)..(455): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtccttcccctggccaccctcctccaagcgcacctctcgggggcacagcacgccctgggctcgcctggtcaaggacctacttccacgtacgcgtgctgacgcgggcgtggcgaaggcgacgagtacgnnnnnnnnnnnnnnnnn

SEQ ID NO: 186027 - DNA, 486 bp, Homo sapiens
  misc_feature: GYAE6OF02F2NXG.30.68.G02.1.454.CMB.1.raw
  modified_base (210)..(210): a, c, t, g, unknown or other
  misc_feature (210)..(210): n is a, c, g, or t
  modified_base (331)..(331): a, c, t, g, unknown or other
  misc_feature (331)..(331): n is a, c, g, or t
  modified_base (348)..(348): a, c, t, g, unknown or other
  misc_feature (348)..(348): n is a, c, g, or t
  modified_base (470)..(486): a, c, t, g, unknown or other
  misc_feature (470)..(486): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgggagtcgaggacacggccgtatattacngtgcgctttcaccctggagtgggagttacaaggcatacttccaccacgtggggccggggcaccctggtcagcgtctcctcagcctccaccaagggcccatccggtccttccccctcggccncccctcctcccaagacnccacctcgtgggggccaccgagcacgcccgtgggcctcggccttgggtcaaggtaccttaccttcccgaacggtacgcggtgcgtggacggccggggctagggcgaagggcgccgagtagcnnnnnnnnnnnnnnnnn

SEQ ID NO: 186028 - DNA, 441 bp, Homo sapiens
  misc_feature: GYAE6OF02FTQF7.30.68.G02.1.454.CMB.1.raw
  modified_base (409)..(409): a, c, t, g, unknown or other
  misc_feature (409)..(409): n is a, c, g, or t
  modified_base (431)..(441): a, c, t, g, unknown or other
  misc_feature (431)..(441): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgcttttcaccctggagtgggagttacaaggcatacttccaccactggggccggggcaccctggtcagcgtctcctcagcctccaccaagggcccatccggtcttccccctggccaccctcctccaagacgcacctcgtgggggcacagcagccctgggctgcctggtcaaggactacgtccacgtagcgtgctgngcgggctggcaaggcgcatagnnnnnnnnnnn

SEQ ID NO: 186029 - DNA, 451 bp, Homo sapiens
  misc_feature: GYAE6OF02HNPO4.30.68.G02.1.454.CMB.1.raw
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
  modified_base (422)..(422): a, c, t, g, unknown or other
  misc_feature (422)..(422): n is a, c, g, or t
  modified_base (425)..(451): a, c, t, g, unknown or other
  misc_feature (425)..(451): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgctagttttattattgtctagcacttataaactaattaggcctaccgggtaaactttttcggaccgaagggggaccaaacggctttaggaggtataccaaaacggtaactgtaggctgcaccatctgtcttnacttctcccncactctagaacgtgcgtgctggacgcgggtcgtcggacgaacgggcgcagtagnagnnnnnnnnnnnnnnnnnnnnnnnnnnn

SEQ ID NO: 186030 - DNA, 461 bp, Homo sapiens
  misc_feature: GYAE6OF02HDJVS.30.68.G02.1.454.CMB.1.raw
  modified_base (403)..(403): a, c, t, g, unknown or other
  misc_feature (403)..(403): n is a, c, g, or t
  modified_base (437)..(461): a, c, t, g, unknown or other
  misc_feature (437)..(461): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccgggcaccctggtcagcgtctccctcagcctccaccgaagggccccatccggtccttccccctggccacccctcctccaagacgccaccctcgtggggcacagcagccctgggctgcctggtcaaggactactccagtancgtgctgacgcgggctggctaagggcgcatacgnnnnnnnnnnnnnnnnnnnnnnnnn

SEQ ID NO: 186031 - DNA, 462 bp, Homo sapiens
  misc_feature: GYAE6OF02JLPF7.30.68.G02.1.454.CMB.1.raw
  modified_base (213)..(213): a, c, t, g, unknown or other
  misc_feature (213)..(213): n is a, c, g, or t
  modified_base (225)..(225): a, c, t, g, unknown or other
  misc_feature (225)..(225): n is a, c, g, or t
  modified_base (323)..(323): a, c, t, g, unknown or other
  misc_feature (323)..(323): n is a, c, g, or t
  modified_base (352)..(352): a, c, t, g, unknown or other
  misc_feature (352)..(352): n is a, c, g, or t
  modified_base (434)..(436): a, c, t, g, unknown or other
  misc_feature (434)..(436): n is a, c, g, or t
  modified_base (438)..(462): a, c, t, g, unknown or other
  misc_feature (438)..(462): n is a, c, g, or t
tcagcacgctacgtcacgaccggtgctcgatttagtcgatagtgaagggaaaggggcgtggaatgggtcgtcaagtattgctggtagtggtgatagcacatactacgcagccatcgtgaagggccggttcaccatctccagggacagttcgaagaacacactgtttctgcaaatgaacagcctgagagtcgaggacacggtccgtatattacngtgcgctttacnccctggatgggattacaggcatactcacactggggccgggcaccgtggtcagcgtctcctcagcctccacaagggcccagtcggtcctcccctgaccnccctctcaagcgcacctcgtggggacacncgcagtccccgtgggctcgctaggtcaaggcctacttccacgtgcgtgcctagcggtcggctaggcgtaaggcgctaagtgnnngnnnnnnnnnnnnnnnnnnnnnnnnn

SEQ ID NO: 186032 - DNA, 698 bp, Homo sapiens
  misc_feature: GYAE6OF02HFSES.30.68.G02.1.454.CMB.1.raw
tcagcacgctacgtcacgaccggtgctcgatttagtcgatagtgaaggaaaggggtcggtggaatgggtcgtcaagtattgctgtagtggtgatagcacagtactacggcagccatcgtgaaggccggttcaccatctccagggacagttcgaagaacgacactgtttctcgcaaatgaacagcctgagagtcgaggtacacggccgtatattactgtgcgctttcaccctggagtggagttacaaggcagtactccacgactgggccggcaccgtggtcgagccgtcgtcctcacgcctaccaccgaacggcccaacgtaccgtcctaccccgtcggacctacccgtcctaccgaacgagtaccacccgttaccgtcgggggtactaccgtaacgccgtaaccggtcccgttcggggtcccgtcggtcccggttacgggtaccgtaaacggggaaccttaacccgttacccgtacccgttacgaaccggtcgtaccgttacggtacgggacggggtccgttacgggaccggtaaacgggccggtaacgaacgtttaggaccgttagtacttacgacgtcgacgtacggtctaacgtacgtcgttacgaaccgtaaggttcgaagcgtactacgtcgtcgtaacggtcgacgtacgagtacgtacgttcgaccgttacggtcgtacgtacgtaaccgg

SEQ ID NO: 186033 - DNA, 520 bp, Homo sapiens
  misc_feature: GYAE6OF02GBZOS.30.68.G02.1.454.CMB.1.raw
  modified_base (483)..(483): a, c, t, g, unknown or other
  misc_feature (483)..(483): n is a, c, g, or t
  modified_base (493)..(493): a, c, t, g, unknown or other
  misc_feature (493)..(493): n is a, c, g, or t
  modified_base (495)..(520): a, c, t, g, unknown or other
  misc_feature (495)..(520): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatactccaccactggggccgggcaccctggtcagcgtctcctcagcctccaccagggcccagtccggtccttcccccgtggcccaccccgttccctaccaacgacgtcacccgttcggtcgggggccacgagccacggcccctggggctggcccttggggtaccaaacgggtacctacctttacccgaacggttacgccgttcgcgtggaaccgggtcgggcctgggacaaggggcccnaacgttagcngnnnnnnnnnnnnnnnnnnnnnnnnnn

SEQ ID NO: 186034 - DNA, 454 bp, Homo sapiens
  misc_feature: GYAE6OF02IOEKB.30.68.G02.1.454.CMB.1.raw
  modified_base (440)..(454): a, c, t, g, unknown or other
  misc_feature (440)..(454): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccggggcacctggtcagcgtctcctcagcctccaccaacgggccccagtccggtccttcccccgtcggccacccctcctccaagcgccacctcgtcggggcacgagcacgcccgtgggctcgcctggcaaggactacctcacgtagcgtgctgagcggctggcgaaggcgacatagnnnnnnnnnnnnnnn

SEQ ID NO: 186035 - DNA, 432 bp, Homo sapiens
  misc_feature: GYAE6OF02GIAO5.30.68.G02.1.454.CMB.1.raw
  modified_base (354)..(354): a, c, t, g, unknown or other
  misc_feature (354)..(354): n is a, c, g, or t
  modified_base (424)..(432): a, c, t, g, unknown or other
  misc_feature (424)..(432): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccagggcccatcggcttccccctggcaccctcctccaagagcacctctgggggcacngcagccctgggctgcctggtcaaggcctacttccacgtacgcgtgctgagcgggctggcaggcgcatagnnnnnnnnn

SEQ ID NO: 186036 - DNA, 522 bp, Homo sapiens
  misc_feature: GYAE6OF02IXRXD.30.68.G02.1.454.CMB.1.raw
  modified_base (477)..(477): a, c, t, g, unknown or other
  misc_feature (477)..(477): n is a, c, g, or t
  modified_base (490)..(490): a, c, t, g, unknown or other
  misc_feature (490)..(490): n is a, c, g, or t
  modified_base (493)..(522): a, c, t, g, unknown or other
  misc_feature (493)..(522): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttcaccactggggccggggcaccctggtcagcgtctcctcagcctccaccaagggcccatcggtccttcccctggccaccctccctacaagacgccaccgtcgtcggggcactacgacgacgccccgtgggcctacggcccgttggaccgaaagggacccttaacgtttcccgaacggttacgccgtcggtacctgggacggccgggggcttcgggacaagggtaccgntaacgttacggancgnnnnnnnnnnnnnnnnnnnnnnnnnnnnnn

SEQ ID NO: 186037 - DNA, 550 bp, Homo sapiens
  misc_feature: GYAE6OF02FY36O.30.68.G02.1.454.CMB.1.raw
  modified_base (479)..(479): a, c, t, g, unknown or other
  misc_feature (479)..(479): n is a, c, g, or t
  modified_base (481)..(481): a, c, t, g, unknown or other
  misc_feature (481)..(481): n is a, c, g, or t
  modified_base (489)..(489): a, c, t, g, unknown or other
  misc_feature (489)..(489): n is a, c, g, or t
  modified_base (491)..(491): a, c, t, g, unknown or other
  misc_feature (491)..(491): n is a, c, g, or t
  modified_base (503)..(503): a, c, t, g, unknown or other
  misc_feature (503)..(503): n is a, c, g, or t
  modified_base (517)..(517): a, c, t, g, unknown or other
  misc_feature (517)..(517): n is a, c, g, or t
  modified_base (519)..(519): a, c, t, g, unknown or other
  misc_feature (519)..(519): n is a, c, g, or t
  modified_base (522)..(523): a, c, t, g, unknown or other
  misc_feature (522)..(523): n is a, c, g, or t
  modified_base (525)..(525): a, c, t, g, unknown or other
  misc_feature (525)..(525): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
  modified_base (542)..(543): a, c, t, g, unknown or other
  misc_feature (542)..(543): n is a, c, g, or t
  modified_base (546)..(547): a, c, t, g, unknown or other
  misc_feature (546)..(547): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcacctggagtgggattacaaggcatacttccaccacgtggggccgggcaccgtggtcagcgtctcctcacgtcctccaccgaacgggcccagtccggtaccttcccccgtggcctaccctcctccgaagcgccacctcgcggggccacgacgcgacgccgtcgggctcgccgttcggtaccaacggtaccctactttacccgacgttaccgtcgtacggaacggccggggtctcgggacgaaacggtcgacacgttacgngngctacgancngacgtcgcgcgnacgtgactgctcgngngcnngngcgctngngngcncncnncgnngtc

SEQ ID NO: 186038 - DNA, 493 bp, Homo sapiens
  misc_feature: GYAE6OF02GHOCS.30.68.G02.1.454.CMB.1.raw
  modified_base (458)..(461): a, c, t, g, unknown or other
  misc_feature (458)..(461): n is a, c, g, or t
  modified_base (463)..(493): a, c, t, g, unknown or other
  misc_feature (463)..(493): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgcttttcaccctggagtgggagttacaaggcatacttccaccactggggccggggcaccctggtcagcgtctcctcagcctccaccaagggcccatccggtcttccccctggccaccctcctccaacgagcaccgtctcgggggcacgagcacgccctgggctgcctcggtcgaaggtacctaccttccacgtacgcgtcgccgtgacggcggggtctcgggcgaagggccgacgagttacggnnnngnnnnnnnnnnnnnnnnnnnnnnnnnnnnnnn

SEQ ID NO: 186039 - DNA, 466 bp, Homo sapiens
  misc_feature: GYAE6OF02IA08Y.30.68.G02.1.454.CMB.1.raw
  modified_base (158)..(158): a, c, t, g, unknown or other
  misc_feature (158)..(158): n is a, c, g, or t
  modified_base (184)..(184): a, c, t, g, unknown or other
  misc_feature (184)..(184): n is a, c, g, or t
  modified_base (208)..(208): a, c, t, g, unknown or other
  misc_feature (208)..(208): n is a, c, g, or t
  modified_base (350)..(350): a, c, t, g, unknown or other
  misc_feature (350)..(350): n is a, c, g, or t
  modified_base (444)..(445): a, c, t, g, unknown or other
  misc_feature (444)..(445): n is a, c, g, or t
  modified_base (447)..(466): a, c, t, g, unknown or other
  misc_feature (447)..(466): n is a, c, g, or t
tcagcacgctacgtcacgaccggtgctcgatttagtcgatagtgaagggaaaggggcgtggaatgggtctcaagtattgctggtagtggtgatagcacatactacgcagccatcgtgaagggccggttcaccatctccagggacagttcgaagaacanactgttctgcaaatgaacagcctganagcgaggacacggcctatattacngtgcgctttcaacccgtggagtgggacttacaaggcatactccacacgtggggccgggcacccgtggtcagcgtctcctcagcctccacgaacggcccagcgtcctcccgtgccacctcctcaagagtccactcgcgggcanagtcagcccgttggctcgaccgtgtacaacggtactacctcgaactcgcgtagctacgggcgcgggtcagggaccgaagggcacgttagacggnngnnnnnnnnnnnnnnnnnnnn

SEQ ID NO: 186040 - DNA, 385 bp, Homo sapiens
  misc_feature: GYAE6OF02FY1TF.30.68.G02.1.454.CMB.1.raw
  modified_base (376)..(376): a, c, t, g, unknown or other
  misc_feature (376)..(376): n is a, c, g, or t
  modified_base (382)..(385): a, c, t, g, unknown or other
  misc_feature (382)..(385): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagtattttgctagttttattattgtcagcactataacaattggcctccggaaacttttggccaggggaccaagcttgagatcaaacgaactgtggctgcaccatctgtcttcatcttcccgcatctgaacgtagcgtgctgagcgggctggcaggcncatagnnnn

SEQ ID NO: 186041 - DNA, 473 bp, Homo sapiens
  misc_feature: GYAE6OF02IRPTA.30.68.G02.1.454.CMB.1.raw
  modified_base (281)..(281): a, c, t, g, unknown or other
  misc_feature (281)..(281): n is a, c, g, or t
  modified_base (329)..(329): a, c, t, g, unknown or other
  misc_feature (329)..(329): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (439)..(473): a, c, t, g, unknown or other
  misc_feature (439)..(473): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatatactgtgcgctttcacctggagtgggagttacaaggcatacttcaccacgtgggccggggcaccctggtcagcgtntcctcagcctccacaagggccccatcggtctcccctggccaccctccnccaagacgctacctcgtcggggcacagcaacgccgtagggctgcctgtacaaaggcaacttccgaccgtancgtncctggnggcggcgtcggacgacggcgacacgagannnnnnnnnnnnnnnnnnnnnnnnnnnnnnnnnnn

SEQ ID NO: 186042 - DNA, 481 bp, Homo sapiens
  misc_feature: GYAE6OF02HKBHW.30.68.G02.1.454.CMB.1.raw
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
  modified_base (461)..(462): a, c, t, g, unknown or other
  misc_feature (461)..(462): n is a, c, g, or t
  modified_base (465)..(481): a, c, t, g, unknown or other
  misc_feature (465)..(481): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccgggccaccctggtcngcgtctcctcncgcctccaccaagggcccacgtcggtccttcccccgtcggccacccctcctaccaacgacgccaccgtcgtcgggggcacgagcacgcccgtgggctcgccgtggtacaacgggactaccgttccgacgtagcgtcgctggacggcgggctggacgaacggcgcagtagnngannnnnnnnnnnnnnnnn

SEQ ID NO: 186043 - DNA, 439 bp, Homo sapiens
  misc_feature: GYAE6OF02FVWHS.30.68.G02.1.454.CMB.1.raw
  modified_base (427)..(439): a, c, t, g, unknown or other
  misc_feature (427)..(439): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctccctccaagagccacctctgggggcacagcagccctgggctgcctggtcaaggctactccacgtagcgtgctgagcgggctggcaaggcgcagtagnnnnnnnnnnnnn

SEQ ID NO: 186044 - DNA, 509 bp, Homo sapiens
  misc_feature: GYAE6OF02IXCER.30.68.G02.1.454.CMB.1.raw
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (479)..(483): a, c, t, g, unknown or other
  misc_feature (479)..(483): n is a, c, g, or t
  modified_base (485)..(509): a, c, t, g, unknown or other
  misc_feature (485)..(509): n is a, c, g, or t
tcagcacgctacgtcacgaccggtgctcgatttagtcgatagtgaagggaaagggggcgtggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggattacaaggcatacttccaccatgggccggggcacccgtggtcacgcgtctcctcagcctccaccaggcccatcgtcttccccnggccnccctccnccaagcncacctcgtggggccacgcgcacgcccgtcgggctcgccgtcggtcgaacggaccttaccgttcccgtacgtacggccgtcggtcttacggacggccgggcgttcggacggaacgggccgaccgtattacggcagtncncgnnnnngnnnnnnnnnnnnnnnnnnnnnnnnn

SEQ ID NO: 186045 - DNA, 484 bp, Homo sapiens
  misc_feature: GYAE6OF02IN3M1.30.68.G02.1.454.CMB.1.raw
  modified_base (291)..(291): a, c, t, g, unknown or other
  misc_feature (291)..(291): n is a, c, g, or t
  modified_base (435)..(442): a, c, t, g, unknown or other
  misc_feature (435)..(442): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (457)..(457): a, c, t, g, unknown or other
  misc_feature (457)..(457): n is a, c, g, or t
  modified_base (461)..(461): a, c, t, g, unknown or other
  misc_feature (461)..(461): n is a, c, g, or t
  modified_base (463)..(463): a, c, t, g, unknown or other
  misc_feature (463)..(463): n is a, c, g, or t
  modified_base (469)..(474): a, c, t, g, unknown or other
  misc_feature (469)..(474): n is a, c, g, or t
  modified_base (476)..(476): a, c, t, g, unknown or other
  misc_feature (476)..(476): n is a, c, g, or t
  modified_base (478)..(481): a, c, t, g, unknown or other
  misc_feature (478)..(481): n is a, c, g, or t
  modified_base (483)..(483): a, c, t, g, unknown or other
  misc_feature (483)..(483): n is a, c, g, or t
tcagcacgctacgtcacgaccggtgctcgatttagtcgatagtgaagggaaaggggctggaatgggtctcaagtattgctggtagtggtgatagcacatactacgcagccaatcgtgaagggccgttcaccatctccagggacagttcgaagaacactactgtttctgacaaatgaacagcctgagagtcgaggacacggccgtatattactgtgcgcttttcaccctggagtgggagttacaaggcatacttccaccactggggcggggcaccctggtcagcgtctcctnagcctccaccaagggcccatcggtccttcccctggccaccctcctccaagacgcacctcgtggggcacgagcagccctgggctgccgtggtcaggctacttccacgtagacgtcgactgagcgggtctggcaagcgacagacgnnnnnnnngacntcagnactgcnatcncngtactnnnnnncncnnnngnc

SEQ ID NO: 186046 - DNA, 483 bp, Homo sapiens
  misc_feature: GYAE6OF02HUWF4.30.68.G02.1.454.CMB.1.raw
  modified_base (211)..(211): a, c, t, g, unknown or other
  misc_feature (211)..(211): n is a, c, g, or t
  modified_base (326)..(326): a, c, t, g, unknown or other
  misc_feature (326)..(326): n is a, c, g, or t
  modified_base (359)..(359): a, c, t, g, unknown or other
  misc_feature (359)..(359): n is a, c, g, or t
  modified_base (451)..(452): a, c, t, g, unknown or other
  misc_feature (451)..(452): n is a, c, g, or t
  modified_base (454)..(457): a, c, t, g, unknown or other
  misc_feature (454)..(457): n is a, c, g, or t
  modified_base (459)..(483): a, c, t, g, unknown or other
  misc_feature (459)..(483): n is a, c, g, or t
tcagcacgctacgtcacgaccggtgctcgatttagtcgatagtgaagggaaaggggctggaatgggtctcaagtattgctggtagtgggtgatagcacatactacgcagccatcgtgaagggccggttcaccatctccagggacagttcgaagaacacactgtttctgcaaatgaacagcctgagagtcgaggacacggccgtatattacngtgcgctttcaccctggagtgggagttacaaggcatacttccacacgtggggccgggcaccctggtcagcgtctcctcagcctccacaagggcccagtcggtccttcccctgccnccctcctccaagcgcaccctcgtcggggccacngcacggccctgggctcggccgtggtacaaggtacctaccttccgacgtacgcgtagctggacgcgggctcgggcgaagggccgacagtacgnncnnnngnnnnnnnnnnnnnnnnnnnnnnnnn

SEQ ID NO: 186047 - DNA, 468 bp, Homo sapiens
  misc_feature: GYAE6OF02G9RVP.30.68.G02.1.454.CMB.1.raw
  modified_base (447)..(448): a, c, t, g, unknown or other
  misc_feature (447)..(448): n is a, c, g, or t
  modified_base (450)..(468): a, c, t, g, unknown or other
  misc_feature (450)..(468): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatactccaccactggggccgggcaccctggtcagcgtctcctcagcctccaccgaagggcccagtccggtccttcccccgtggcctacccctcctacctaagacgccacctcgtggggcacagccagcccgtgggcctcgccgtggcaaacgggtacctacttccacgtacgcgtgctgaggcgggctggcgaggcgcatagnngnnnnnnnnnnnnnnnnnnn

SEQ ID NO: 186048 - DNA, 541 bp, Homo sapiens
  misc_feature: GYAE6OF02I408M.30.68.G02.1.454.CMB.1.raw
  modified_base (509)..(518): a, c, t, g, unknown or other
  misc_feature (509)..(518): n is a, c, g, or t
  modified_base (520)..(541): a, c, t, g, unknown or other
  misc_feature (520)..(541): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccgttcaccatctccagggacagttcgaagaacacactgtttctgcaaatgaacagcctgagagtcgaggacacggccgtatattactgtgcgctttcaccctggagtgggagttacaaggcatacttccaccacgtggggccgggcacccgtggtcagcgtctccctcagccctccaccgaacgggcccacgtcggtccttcccccgtggcccacccctcctaccaacgcgccacctcggtcggggccacgacgcacggtcccgtgggtcctcggtccgtacggtccgaaacggtacccttacccgttcccgtaacggtcgtaccgtcgtccgtgggacgggtcccggggtcgtcgggacgaacgggtccgacgtacgttagcagcnnnnnnnnnncnnnnnnnnnnnnnnnnnnnnnn

SEQ ID NO: 186049 - DNA, 476 bp, Homo sapiens
  misc_feature: GYAE6OF02G6N69.30.68.G02.1.454.CMB.1.raw
  modified_base (452)..(452): a, c, t, g, unknown or other
  misc_feature (452)..(452): n is a, c, g, or t
  modified_base (454)..(476): a, c, t, g, unknown or other
  misc_feature (454)..(476): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggattacaaggcatacttccaccactggggccgggcaccctggtcagcgtctcctcacgcctccaccgaacggcccacgtccggtccttccccctcggccacccctccctccaacgacgccacctcgtcggggcacgagcacgcccgtgggctcgccgtggtcaacggtactaccttccacgtagcgtcgctgacgcgggctggcgaacggcgcacgtagngnnnnnnnnnnnnnnnnnnnnnnn

SEQ ID NO: 186050 - DNA, 393 bp, Homo sapiens
  misc_feature: GYAE6OF02GBFDE.30.68.G02.1.454.CMB.1.raw
  modified_base (356)..(356): a, c, t, g, unknown or other
  misc_feature (356)..(356): n is a, c, g, or t
  modified_base (368)..(368): a, c, t, g, unknown or other
  misc_feature (368)..(368): n is a, c, g, or t
  modified_base (371)..(371): a, c, t, g, unknown or other
  misc_feature (371)..(371): n is a, c, g, or t
  modified_base (379)..(379): a, c, t, g, unknown or other
  misc_feature (379)..(379): n is a, c, g, or t
  modified_base (386)..(393): a, c, t, g, unknown or other
  misc_feature (386)..(393): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagtattttgctagtttattattgtcagcactataacaattggacctccggaaactttgccagggaccaagcttgagatacaaacgaactgtggctgcactatctgtcttcactcttcccgcatctagaacgtgcgtnctgagccggtgnggngaacggcncgatagnnnnnnnn

SEQ ID NO: 186051 - DNA, 456 bp, Homo sapiens
  misc_feature: GYAE6OF02FN2MI.30.68.G02.1.454.CMB.1.raw
  modified_base (372)..(372): a, c, t, g, unknown or other
  misc_feature (372)..(372): n is a, c, g, or t
  modified_base (434)..(434): a, c, t, g, unknown or other
  misc_feature (434)..(434): n is a, c, g, or t
  modified_base (436)..(456): a, c, t, g, unknown or other
  misc_feature (436)..(456): n is a, c, g, or t
tcagcacgctacgtcacgaccggtgctcgatttagtcgatagtgaagggaaagggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgcttttcaccctggagtgggagttacaaggcatacttccaccactggggccggggcaccctggtcagcgtctcctcagcctccaccaagggcccatcggtcttccccctggccaccctcctccaagacgcacctcgtggggcacagcagccctggcncgcctggtcaaggctactccgacgtagcgtgctggagcggggctggcgaagggcgcagtagncnnnnnnnnnnnnnnnnnnnnn

SEQ ID NO: 186052 - DNA, 496 bp, Homo sapiens
  misc_feature: GYAE6OF02I2BB0.30.68.G02.1.454.CMB.1.raw
  modified_base (286)..(286): a, c, t, g, unknown or other
  misc_feature (286)..(286): n is a, c, g, or t
  modified_base (465)..(465): a, c, t, g, unknown or other
  misc_feature (465)..(465): n is a, c, g, or t
  modified_base (468)..(496): a, c, t, g, unknown or other
  misc_feature (468)..(496): n is a, c, g, or t
tcagcacgctacgtcacgaccggtgctcgatttagtcgatagtgaagggaaagggggctgggaatgggtctcaagtattgctggtagtgggtgatagcacatactacgcagccatcgtgaagggcggttcaccatctccagggacagttcgaagaacacactgtttctgcaaatgaacagcctgagagtcgaggcacggccgtatattactgtgcgctttcaccctggagtgggagttacaggcatacttccaccacgtggggccggggcaccctggtcagcgtcncctcagcctccaccacgggcccatcggtccttccccctcggcacccctccctccgaacgacgcaccctccgtgggggcaccaggcacgccctcgggcgtcgcctgggacaacggacttaccgttccacgtagcgttcgactgggacggtcgggcgtcgggcgaagggccgctagtagcncgnnnnnnnnnnnnnnnnnnnnnnnnnnnnn

SEQ ID NO: 186053 - DNA, 478 bp, Homo sapiens
  misc_feature: GYAE6OF02HWT41.30.68.G02.1.454.CMB.1.raw
  modified_base (446)..(478): a, c, t, g, unknown or other
  misc_feature (446)..(478): n is a, c, g, or t
tcagcacgctacgtcacgaccggtgctcgatttagtcgatagtgaagggaaagggggctggaatgggtctcaagtattgctggtagtggtgatagcacatactacgcagccatcgtgaagggccggttcaccatctccagggcagttcgaagaacacactgtttctgcaaatgaacagcctgagagtcgaggacacggccgtatattactgtgcgctttcaccctggagtgggagttacaaggcatacttccaccactggggccgggcaccctggtcagcgtctcctcagcctccaccaagggcccatcggtcttccccctggccaccctcctccaagacgccaccctcgtcgggggcacgacgcagcccctggggcctgccgtggtcaaggactaccttccacgtacgcgtcgctggagcgggctgggcgaagggcgcagtacgnnnnnnnnnnnnnnnnnnnnnnnnnnnnnnnnn

SEQ ID NO: 186054 - DNA, 538 bp, Homo sapiens
  misc_feature: GYAE6OF02IPWSV.30.68.G02.1.454.CMB.1.raw
  modified_base (70)..(70): a, c, t, g, unknown or other
  misc_feature (70)..(70): n is a, c, g, or t
  modified_base (498)..(498): a, c, t, g, unknown or other
  misc_feature (498)..(498): n is a, c, g, or t
  modified_base (503)..(503): a, c, t, g, unknown or other
  misc_feature (503)..(503): n is a, c, g, or t
  modified_base (505)..(538): a, c, t, g, unknown or other
  misc_feature (505)..(538): n is a, c, g, or t
tcagcacgctacgtcacgaccggtgctcgatttagtcgatagtgaagggaaagggcagagtgttagcagnaacttagcctggtaccagcagaaacctggccaggctcccaggctcctcatctatgatgcgtccaccagggtcactggtatcccagccaggttcagcggcagtgggtctgggacagagttcagtctcaccatccagcagcctgcagtctgaagtattttgctagttttattattgtcagcaacttaataaaactaagtttcggccttaccgggtaaaacgtttttcgggaccgtaacgggggaaccctaaaggcctttaggagtaaacgtacaaaaacggtaactggttagggccttacgaccaaccgtataccgttgttccttcctacttccccgttcccgtaccctattcctaacggtaacgttacgtcgtacggctacggaggtccggggtctagggggtacgaacgggtaccgactaaggtacgntacgncnnnnnnnnnnnnnnnnnnnnnnnnnnnnnnnnnn

SEQ ID NO: 186055 - DNA, 478 bp, Homo sapiens
  misc_feature: GYAE6OF02GE8IK.30.68.G02.1.454.CMB.1.raw
  modified_base (447)..(478): a, c, t, g, unknown or other
  misc_feature (447)..(478): n is a, c, g, or t
tcagcacgctacgtcacgaccggtgctcgatttagtcgatagtgaagggaaagggggctggaatgggtctcaagtattgctggtagtggtgatagcacatactacgcagccatcgtgaagggccgggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcgtcttcccctggcaccctcctccaagagcacctctgggggcacagcacgccctgggctggcctggtcaagggacctacgttcccaacgtacgcgtgctgacgcggggctgggcaaacgggcgacaacgttaggannnnnnnnnnnnnnnnnnnnnnnnnnnnnnnn

SEQ ID NO: 186056 - DNA, 450 bp, Homo sapiens
  misc_feature: GYAE6OF02IRRYQ.30.68.G02.1.454.CMB.1.raw
  modified_base (417)..(417): a, c, t, g, unknown or other
  misc_feature (417)..(417): n is a, c, g, or t
  modified_base (442)..(450): a, c, t, g, unknown or other
  misc_feature (442)..(450): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccgttcaccatctccagggacagttcgaagaacacactgttttctgacaaaatgaaacagcctgagagtcgaggacacggccgtatattactgtgcgtctttcaccctggagtgggagttacaaggcatactccaccacgtggggccggggcaccctggtcagcgtctccctcagcctccaccaagggcccatcggtccttccccctggccacccctcctcccaagacgcacctctggggcacagcagcccgtgggctgccgtggtcaaggacctacttccgacgtagcgtgctgngcggctggcgaaggccgcagtacgnnnnnnnnn

SEQ ID NO: 186057 - DNA, 548 bp, Homo sapiens
  misc_feature: GYAE6OF02INGO4.30.68.G02.1.454.CMB.1.raw
  modified_base (514)..(514): a, c, t, g, unknown or other
  misc_feature (514)..(514): n is a, c, g, or t
  modified_base (516)..(517): a, c, t, g, unknown or other
  misc_feature (516)..(517): n is a, c, g, or t
  modified_base (520)..(548): a, c, t, g, unknown or other
  misc_feature (520)..(548): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgtctttcaccctggagtgggagttacaaggcatacttccaccactggggccggggcacccgtggtccagcgtctcctcagcctcccaccaacgggcccatccggtccttccccctggccacccctcctcccaagacgccaacctccgtcgggggcacgagcacgcccgtggggctcggcccgttcgggtacgaaacgggtaccttaaccgtttccccgaacggttacggtccggttcggccgttagggaacgggtccgggggccgttcggggaccgaacggggccgaacgtagttacggncnngcnnnnnnnnnnnnnnnnnnnnnnnnnnnnn

SEQ ID NO: 186058 - DNA, 534 bp, Homo sapiens
  misc_feature: GYAE6OF02GZP7M.30.68.G02.1.454.CMB.1.raw
  modified_base (504)..(504): a, c, t, g, unknown or other
  misc_feature (504)..(504): n is a, c, g, or t
  modified_base (506)..(534): a, c, t, g, unknown or other
  misc_feature (506)..(534): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccgggcacccgtggtcagccgtctcctcagcctccaccaagggcccatccggtccttcccccgtggccacccctcctaccaagacgccaccctcggtcggggccacgacgccacggccccgtgggccctcggcccgttgggtacctaaacgggacctttaccgttcccgtaacggttacggtccgtcgtcgttaggacgggccgggtccgtacgggaccgaagggccgactaacggtacgngnnnnnnnnnnnnnnnnnnnnnnnnnnnnn

SEQ ID NO: 186059 - DNA, 440 bp, Homo sapiens
  misc_feature: GYAE6OF02G2EFT.30.68.G02.1.454.CMB.1.raw
  modified_base (359)..(359): a, c, t, g, unknown or other
  misc_feature (359)..(359): n is a, c, g, or t
  modified_base (427)..(440): a, c, t, g, unknown or other
  misc_feature (427)..(440): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggccacccctcctccaacgacgcacctctggggcacngcagccctgggctgcctggtcaaggctactccacgtagcgtgctgagcgggctggcaggcgcagtagnnnnnnnnnnnnnn

SEQ ID NO: 186060 - DNA, 492 bp, Homo sapiens
  misc_feature: GYAE6OF02JX1KG.30.68.G02.1.454.CMB.1.raw
  modified_base (466)..(467): a, c, t, g, unknown or other
  misc_feature (466)..(467): n is a, c, g, or t
  modified_base (469)..(492): a, c, t, g, unknown or other
  misc_feature (469)..(492): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccgggcacccgtggtcagcgtctcctcacgcctccaccagggccccatccggtccttccccgtggccaccctcctccaacgacgccaccgtcgtcggggccacgacgcacgcccgtgggctcggcctggtacgaacggactaccgtccacggtcgacgtgtctggacggcgggtcgtcggcgtaacggccgtacgagttacgnngnnnnnnnnnnnnnnnnnnnnnnnn

SEQ ID NO: 186061 - DNA, 523 bp, Homo sapiens
  misc_feature: GYAE6OF02HQKM5.30.68.G02.1.454.CMB.1.raw
  modified_base (354)..(354): a, c, t, g, unknown or other
  misc_feature (354)..(354): n is a, c, g, or t
  modified_base (452)..(452): a, c, t, g, unknown or other
  misc_feature (452)..(452): n is a, c, g, or t
  modified_base (465)..(465): a, c, t, g, unknown or other
  misc_feature (465)..(465): n is a, c, g, or t
  modified_base (471)..(471): a, c, t, g, unknown or other
  misc_feature (471)..(471): n is a, c, g, or t
  modified_base (474)..(474): a, c, t, g, unknown or other
  misc_feature (474)..(474): n is a, c, g, or t
  modified_base (476)..(477): a, c, t, g, unknown or other
  misc_feature (476)..(477): n is a, c, g, or t
  modified_base (480)..(480): a, c, t, g, unknown or other
  misc_feature (480)..(480): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
  modified_base (493)..(493): a, c, t, g, unknown or other
  misc_feature (493)..(493): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
  modified_base (506)..(506): a, c, t, g, unknown or other
  misc_feature (506)..(506): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (515)..(516): a, c, t, g, unknown or other
  misc_feature (515)..(516): n is a, c, g, or t
  modified_base (519)..(519): a, c, t, g, unknown or other
  misc_feature (519)..(519): n is a, c, g, or t
  modified_base (522)..(522): a, c, t, g, unknown or other
  misc_feature (522)..(522): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcacccgtggagtggagttacaaggcatacttccaccgacgtggggccgggcaccctggtccagcgtctcctcagcctccaccaagggcccatccggtcttccccgtggccaccctcctaccaagacgcacctcgnggggccacgacgcacgccgtggctgccgtggtctaaggaccttaccttacgacgtacgtcgtcgtcgtggacggcgggtcgtcggtacgagggtccgntaacgtacgctancgagcngtngnncgngngctcngcgcgncgcgacgncncancgncncgcnncgngtng

SEQ ID NO: 186062 - DNA, 385 bp, Homo sapiens
  misc_feature: GYAE6OF02ILI2J.30.68.G02.1.454.CMB.1.raw
  modified_base (379)..(385): a, c, t, g, unknown or other
  misc_feature (379)..(385): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgctagttttattattgtcagcactataacaattggcctccggaacttttggccagggaccaagcttgagatcaaacgaactgtggctgcaccatctgtcttcatctcccgcatctgaactgcgtgctgagcgggcgtggcgaaggcgcatagnnnnnnn

SEQ ID NO: 186063 - DNA, 577 bp, Homo sapiens
  misc_feature: GYAE6OF02HUHMD.30.68.G02.1.454.CMB.1.raw
  modified_base (525)..(525): a, c, t, g, unknown or other
  misc_feature (525)..(525): n is a, c, g, or t
  modified_base (528)..(528): a, c, t, g, unknown or other
  misc_feature (528)..(528): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
  modified_base (547)..(547): a, c, t, g, unknown or other
  misc_feature (547)..(547): n is a, c, g, or t
  modified_base (549)..(550): a, c, t, g, unknown or other
  misc_feature (549)..(550): n is a, c, g, or t
  modified_base (554)..(555): a, c, t, g, unknown or other
  misc_feature (554)..(555): n is a, c, g, or t
  modified_base (558)..(562): a, c, t, g, unknown or other
  misc_feature (558)..(562): n is a, c, g, or t
  modified_base (564)..(564): a, c, t, g, unknown or other
  misc_feature (564)..(564): n is a, c, g, or t
  modified_base (566)..(569): a, c, t, g, unknown or other
  misc_feature (566)..(569): n is a, c, g, or t
  modified_base (571)..(573): a, c, t, g, unknown or other
  misc_feature (571)..(573): n is a, c, g, or t
  modified_base (575)..(577): a, c, t, g, unknown or other
  misc_feature (575)..(577): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggattacaagcatacttccaccagtgggccgggcaccctggtcagcgtctcctcacgcctccaccgaacgggccccactccggtcctttcccccgtggccacccctcctaccaacgacgcacctcgtcgggggcaacgacgccaacgccccgtcgggtcctcgccgttcgggtacaaacgggtaaccttaaccgtttacccgtaaccggttaacggtccggttggcccgtttacgggacggccgggggtccgttacggggacgaaacggggccggtaaccgtaagtaacgggtnacncgcgngncgcgngnagcgngnngacnntgnnnnngngnnnngnnnannn

SEQ ID NO: 186064 - DNA, 804 bp, Homo sapiens
  misc_feature: GYAE6OF02JG5GT.30.68.G02.1.454.CMB.1.raw
tcagcacgctacgtcacgaccggtgctcgatttagtcgatagtgaaggaaaggggctggaatgggtctcaaggtattcgctcggtaggtggttgatagtcactagtactacgcagccatcgtgaaggccggttcaccaatctccgagggtacgagttcgaagaaccacgacttgtttctgctaaattagaacagctgagagtcgagacgacggccgtatattactggtcgcgtactttcacccgtgggtaggtcgggagttacgaaacggctattaaccttccaccgacgtggggtcccggggtctacccgtggttacaacgtcgttaccgtcctccaagtcccgtaccaccgtaacgggtcccccagttccggtacccctttccccggacggacccgtaccccgttacccgtaccgtaaccgtacgtccgacccgtaccgtcggggggtaccaacgtacgggtacccgtaacggtaccccggtggggtacccgtccggtccggttaacgggtaccgtaaaaccggggttaccccgttaaacccgttttaaccccggggtacccggtttaaccggtaccccggttcggtacccgtacggggttaaccgggaccgggttacctacggggttaaccgaaaaccggggcccggtaacgaacggttacggttaacgtacggacgttacggactacgtaccgaagccgttaagtacgtacggacgtaccgtacggaccacgtagtacgtcgtcgtcgtacggtacgtacgcgtcgcgtacgtacgtaccgtacgtacgtacgtaggtcg

SEQ ID NO: 186065 - DNA, 542 bp, Homo sapiens
  misc_feature: GYAE6OF02GMSMW.30.68.G02.1.454.CMB.1.raw
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
  modified_base (507)..(511): a, c, t, g, unknown or other
  misc_feature (507)..(511): n is a, c, g, or t
  modified_base (515)..(515): a, c, t, g, unknown or other
  misc_feature (515)..(515): n is a, c, g, or t
  modified_base (518)..(522): a, c, t, g, unknown or other
  misc_feature (518)..(522): n is a, c, g, or t
  modified_base (524)..(542): a, c, t, g, unknown or other
  misc_feature (524)..(542): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaaggccggttcaccatctccagggacagttcgaagaacacactgtttctgcaaatgaacagcctgagagtcgaggacacggccgtatattactgtgcgctttcaccctggagtgggattacaaggcatacttccacacgtggggccgggcaccgtggtcagcgtctcctcagccctccaccgaacggccccagtccggtccttcccccgtggcctacccctccctccaacgacgcctaaccctccgtcgggggccaccgacgccgacgccccgtggggcctcggccctgggtaccaaacggaccttaccgttcccgaacggtacggaccgtgccgtgggaacggtccgggtcgtcgggacgaacgggccgtacgagttacgcgngacgngnnnnngagngcnnnnngnnnnnnnnnnnnnnnnnnn

SEQ ID NO: 186066 - DNA, 446 bp, Homo sapiens
  misc_feature: GYAE6OF02IFSMQ.30.68.G02.1.454.CMB.1.raw
  modified_base (433)..(446): a, c, t, g, unknown or other
  misc_feature (433)..(446): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaaggcccatccggtcttccccctggccacccctccctccaagacgcaccctctgggggcacagcacgccctgggctgcctggtcaaggactacttccacgtagcgtgctgagcgggctggcaaggcgcagtagnnnnnnnnnnnnnn

SEQ ID NO: 186067 - DNA, 447 bp, Homo sapiens
  misc_feature: GYAE6OF02F2IKY.30.68.G02.1.454.CMB.1.raw
  modified_base (333)..(333): a, c, t, g, unknown or other
  misc_feature (333)..(333): n is a, c, g, or t
  modified_base (435)..(447): a, c, t, g, unknown or other
  misc_feature (435)..(447): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcagtacttccaccactggggccggggcaccctggtcagcgtctcctcagcctccaccaaggcccatcggtcttcccctggccaccctccnccaagagccacctcgtcgggggcacagcacgccctgggctcgctggtcaaggcctacttccacggtagcgtgctgacgcgggctgggcaacgggcgcatagnnnnnnnnnnnnn

SEQ ID NO: 186068 - DNA, 446 bp, Homo sapiens
  misc_feature: GYAE6OF02IY4Q0.30.68.G02.1.454.CMB.1.raw
  modified_base (406)..(406): a, c, t, g, unknown or other
  misc_feature (406)..(406): n is a, c, g, or t
  modified_base (415)..(446): a, c, t, g, unknown or other
  misc_feature (415)..(446): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagattcagtctcaccatcagcagcctgtagtctgaagtattttgctagttttattattgtcagcactataaacattggcctacggtaaacttttggccaggggaccaagcttgaggatacaaaacggaactgtggctcgccactatcgtgtcttccatccttccccgcctatctagtaaacgtgtcgtgacttggacggcgggtcgtacggcgaagggtaccncgaagagtnnnnnnnnnnnnnnnnnnnnnnnnnnnnnnnn

SEQ ID NO: 186069 - DNA, 435 bp, Homo sapiens
  misc_feature: GYAE6OF02FORX1.30.68.G02.1.454.CMB.1.raw
  modified_base (422)..(422): a, c, t, g, unknown or other
  misc_feature (422)..(422): n is a, c, g, or t
  modified_base (426)..(435): a, c, t, g, unknown or other
  misc_feature (426)..(435): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgcttttcaccctggagtgggagttacaaggcatacttccaccactggggccggggcaccctggtcagcgtctcctcagcctcaccaagggcccatcggtcttccccctggccaccctcctccaagacgcacctctggggcacagcagccctgggctgcctggtcaaggactacttccacgtagcgtgctgagcgggctggcaggcgcntagnnnnnnnnnn

SEQ ID NO: 186070 - DNA, 534 bp, Homo sapiens
  misc_feature: GYAE6OF02HQW0J.30.68.G02.1.454.CMB.1.raw
  modified_base (498)..(498): a, c, t, g, unknown or other
  misc_feature (498)..(498): n is a, c, g, or t
  modified_base (503)..(503): a, c, t, g, unknown or other
  misc_feature (503)..(503): n is a, c, g, or t
  modified_base (505)..(506): a, c, t, g, unknown or other
  misc_feature (505)..(506): n is a, c, g, or t
  modified_base (508)..(534): a, c, t, g, unknown or other
  misc_feature (508)..(534): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggattacaaggcatacttccacacgtggggccggggcacccgtggtcagccgtctcctcacgcctcccaaccgaacgggcccctagtccggtaccttcccccgtcgcctacccctctaccgaaagtacgccgtaacctcggtacggggcacgacgcgaacgcccggtggcctcggccgttaggacaaacggtaccttaccgttaccgacgtacgcgtagtccgtacgggacggcgggagtcggacgaacgggcacgaagtagcagcngtacntnnannnnnnnnnnnnnnnnnnnnnnnnnnn

SEQ ID NO: 186071 - DNA, 442 bp, Homo sapiens
  misc_feature: GYAE6OF02HLMUI.30.68.G02.1.454.CMB.1.raw
  modified_base (425)..(426): a, c, t, g, unknown or other
  misc_feature (425)..(426): n is a, c, g, or t
  modified_base (428)..(442): a, c, t, g, unknown or other
  misc_feature (428)..(442): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaaggtcccatcggtcttccccctggccaccctcctccaagacgcacctctggggcacagcagccctgggctgcctgtcaagactactccacgtagcgtgctgagcgggctggcaaggcgcagtagnngnnnnnnnnnnnnnnn

SEQ ID NO: 186072 - DNA, 521 bp, Homo sapiens
  misc_feature: GYAE6OF02JJB70.30.68.G02.1.454.CMB.1.raw
  modified_base (211)..(211): a, c, t, g, unknown or other
  misc_feature (211)..(211): n is a, c, g, or t
  modified_base (270)..(270): a, c, t, g, unknown or other
  misc_feature (270)..(270): n is a, c, g, or t
  modified_base (280)..(280): a, c, t, g, unknown or other
  misc_feature (280)..(280): n is a, c, g, or t
  modified_base (337)..(337): a, c, t, g, unknown or other
  misc_feature (337)..(337): n is a, c, g, or t
  modified_base (476)..(476): a, c, t, g, unknown or other
  misc_feature (476)..(476): n is a, c, g, or t
  modified_base (481)..(481): a, c, t, g, unknown or other
  misc_feature (481)..(481): n is a, c, g, or t
  modified_base (483)..(487): a, c, t, g, unknown or other
  misc_feature (483)..(487): n is a, c, g, or t
  modified_base (493)..(494): a, c, t, g, unknown or other
  misc_feature (493)..(494): n is a, c, g, or t
  modified_base (496)..(496): a, c, t, g, unknown or other
  misc_feature (496)..(496): n is a, c, g, or t
  modified_base (498)..(499): a, c, t, g, unknown or other
  misc_feature (498)..(499): n is a, c, g, or t
  modified_base (502)..(506): a, c, t, g, unknown or other
  misc_feature (502)..(506): n is a, c, g, or t
  modified_base (508)..(511): a, c, t, g, unknown or other
  misc_feature (508)..(511): n is a, c, g, or t
  modified_base (513)..(515): a, c, t, g, unknown or other
  misc_feature (513)..(515): n is a, c, g, or t
  modified_base (517)..(521): a, c, t, g, unknown or other
  misc_feature (517)..(521): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtacattaacngtgcgctttcacctggagtggagttacaaggcatactccaccacgtgggccgggcaccngtcagcgtcnctcacgcctccacaacgggcccatcggtccttccccgtgccaccctccacaacgacncacctcgtaggggcacgagcacgcccgtagggctcgccgtgtaccgaaaggtacctaactttccgaacgtacgtaccgtggtacccgtaggacggtccggggtccgttacggaccgaacgggtaccgcgtaagtacgangcagngnnnnngagagnngnannacnnnnnannnnannncnnnnn

SEQ ID NO: 186073 - DNA, 506 bp, Homo sapiens
  misc_feature: GYAE6OF02HWODR.30.68.G02.1.454.CMB.1.raw
  modified_base (292)..(292): a, c, t, g, unknown or other
  misc_feature (292)..(292): n is a, c, g, or t
  modified_base (472)..(473): a, c, t, g, unknown or other
  misc_feature (472)..(473): n is a, c, g, or t
  modified_base (476)..(477): a, c, t, g, unknown or other
  misc_feature (476)..(477): n is a, c, g, or t
  modified_base (479)..(506): a, c, t, g, unknown or other
  misc_feature (479)..(506): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccgactggggccggggcacccgtggtcagcgtctcctcngcctccaccaacgggcccagttcggtccttccccctcggccaccccttcctcccgaagacgcctacctcgtcgggggcacgcggcacgcccgtggggcctggcccgtggtccaacggtacctaccttccacgtagtcgtcggctggacggcgggtctgggaccgaagggcgactagtggnngcnnannnnnnnnnnnnnnnnnnnnnnnnnnnn

SEQ ID NO: 186074 - DNA, 477 bp, Homo sapiens
  misc_feature: GYAE6OF02G37RR.30.68.G02.1.454.CMB.1.raw
  modified_base (210)..(210): a, c, t, g, unknown or other
  misc_feature (210)..(210): n is a, c, g, or t
  modified_base (255)..(255): a, c, t, g, unknown or other
  misc_feature (255)..(255): n is a, c, g, or t
  modified_base (454)..(457): a, c, t, g, unknown or other
  misc_feature (454)..(457): n is a, c, g, or t
  modified_base (459)..(477): a, c, t, g, unknown or other
  misc_feature (459)..(477): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattacngtgcgctttcaccctggagtggagttacaaggcatacttccaccncgtggggccggggcacccgtggtcagcgtctcctcagcctccaccaacggcccacgtccggtccttcccctcggccaccctccctccaacgacgcacctcgtcggggcacgacgcacgcccgtcgggctcgcctggtcaaggactacgtccacgtacgtcgtgcgtgacggcgggcgtcggacgacggcgacgagtagnnnncnnnnnnnnnnnnnnnnnnn

SEQ ID NO: 186075 - DNA, 526 bp, Homo sapiens
  misc_feature: GYAE6OF02I2AOP.30.68.G02.1.454.CMB.1.raw
  modified_base (288)..(288): a, c, t, g, unknown or other
  misc_feature (288)..(288): n is a, c, g, or t
  modified_base (493)..(493): a, c, t, g, unknown or other
  misc_feature (493)..(493): n is a, c, g, or t
  modified_base (495)..(526): a, c, t, g, unknown or other
  misc_feature (495)..(526): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgtctttccaccctggagtgggagttacaaggcatacctccaccacgtgggccggggcaccctggtcagcgtccncctcagccctccaccgaagggcccagtccggttccttcccccgtggcccacccctcctaccaagacgccacccgtcgcggggcacgacgccacggcccctagggcctcggcccgtcgggtcaaacgggtacccttaaccgtccgaacgttacggcgttcgcgtaggacggcgggtctgggaccgaacggtcgaccaaggtacgangnnnnnnnnnnnnnnnnnnnnnnnnnnnnnnnn

SEQ ID NO: 186076 - DNA, 541 bp, Homo sapiens
  misc_feature: GYAE6OF02IX103.30.68.G02.1.454.CMB.1.raw
  modified_base (221)..(221): a, c, t, g, unknown or other
  misc_feature (221)..(221): n is a, c, g, or t
  modified_base (477)..(477): a, c, t, g, unknown or other
  misc_feature (477)..(477): n is a, c, g, or t
  modified_base (480)..(480): a, c, t, g, unknown or other
  misc_feature (480)..(480): n is a, c, g, or t
  modified_base (483)..(483): a, c, t, g, unknown or other
  misc_feature (483)..(483): n is a, c, g, or t
  modified_base (488)..(488): a, c, t, g, unknown or other
  misc_feature (488)..(488): n is a, c, g, or t
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
  modified_base (499)..(499): a, c, t, g, unknown or other
  misc_feature (499)..(499): n is a, c, g, or t
  modified_base (515)..(515): a, c, t, g, unknown or other
  misc_feature (515)..(515): n is a, c, g, or t
  modified_base (526)..(526): a, c, t, g, unknown or other
  misc_feature (526)..(526): n is a, c, g, or t
  modified_base (533)..(533): a, c, t, g, unknown or other
  misc_feature (533)..(533): n is a, c, g, or t
  modified_base (536)..(537): a, c, t, g, unknown or other
  misc_feature (536)..(537): n is a, c, g, or t
tcagcacgctacgtcacgaccggtgctcgatttagtcgatagtgaagggaaaggggtcgtggaatgggtctcaagtattgctggtaagtggtgatacgcacatactacgcagccatcgtgaagggccggttcaccatctccagggacagttcgaagaacacactgtttctgcaaatgaacacgcctgagagtcgaggacacggccgtatattactgtcgcnctttcacctggagtgggagttacaaggcatacttccaccagttcggggccgggcaccctggtccagcgtcctcctcgacgcctccacacggccagtccggtcctcccctggccacctccgccaagcgccacctcgtcggggcacgcgcgacgccgttcgggctggcctcgggtaccaaggtaccttacgtccaacgtcgacgtcgcgttcggacggcgggctcgggacgaacggcctacgacttagctctagcagnacngtnacgtncgntcgcncgngcgacgcgcgacgtcncgacgacgtanagcgcgngcnntgcg

SEQ ID NO: 186077 - DNA, 471 bp, Homo sapiens
  misc_feature: GYAE6OF02JCJX3.30.68.G02.1.454.CMB.1.raw
  modified_base (288)..(288): a, c, t, g, unknown or other
  misc_feature (288)..(288): n is a, c, g, or t
  modified_base (454)..(471): a, c, t, g, unknown or other
  misc_feature (454)..(471): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggattacaaggcatactccaccacgtggggccgggcacccgtggtcagcgtctcctnacgcctccaccaagggccccatccggtccttcccccgtggccacccctctacccgaagcgccacctccgagacgcacacgcccgcccgtggggcctcggcccgtggtcaacggtaccttaccttccgaacgttgctcgctggacgcgggctggcgacggcgcatgnnnnnnnnnnnnnnnnnn

SEQ ID NO: 186078 - DNA, 501 bp, Homo sapiens
  misc_feature: GYAE6OF02GMVVW.30.68.G02.1.454.CMB.1.raw
  modified_base (466)..(466): a, c, t, g, unknown or other
  misc_feature (466)..(466): n is a, c, g, or t
  modified_base (471)..(473): a, c, t, g, unknown or other
  misc_feature (471)..(473): n is a, c, g, or t
  modified_base (475)..(501): a, c, t, g, unknown or other
  misc_feature (475)..(501): n is a, c, g, or t
tcagcacgctacgtcacgaccggtgctcgatttagtcgatagtgaagggaaagggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctccctcagcctccaccaacgggcccactcggtccttcccccgtcggccaccctcctacccaacgacgcaccctcctgggggccacgagcacgcccctgggctcggccgtcggtcgaaggtacttaccttccacgttagccggttgcgttgagcgggctgggcgaagggacgccgagtacgngacgnnngnnnnnnnnnnnnnnnnnnnnnnnnnnn

SEQ ID NO: 186079 - DNA, 479 bp, Homo sapiens
  misc_feature: GYAE6OF02FUW7Y.30.68.G02.1.454.CMB.1.raw
  modified_base (328)..(328): a, c, t, g, unknown or other
  misc_feature (328)..(328): n is a, c, g, or t
  modified_base (459)..(460): a, c, t, g, unknown or other
  misc_feature (459)..(460): n is a, c, g, or t
  modified_base (463)..(479): a, c, t, g, unknown or other
  misc_feature (463)..(479): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtggggccggggccacccgtggtcagcgtctcctcagcctccaccaacgggcccatccggtccttcccccnggccacccctcctccaacgacgccaccgtcgtggggccacagcacgcccgtgggctcggcctggtacgaaggacctaccttccgagtacgcgtgctggaggcgggctgggaccgaagggccgacgagtagnncgnnnnnnnnnnnnnnnnn

SEQ ID NO: 186080 - DNA, 572 bp, Homo sapiens
  misc_feature: GYAE6OF02J16GB.30.68.G02.1.454.CMB.1.raw
  modified_base (341)..(341): a, c, t, g, unknown or other
  misc_feature (341)..(341): n is a, c, g, or t
  modified_base (535)..(535): a, c, t, g, unknown or other
  misc_feature (535)..(535): n is a, c, g, or t
  modified_base (537)..(538): a, c, t, g, unknown or other
  misc_feature (537)..(538): n is a, c, g, or t
  modified_base (540)..(557): a, c, t, g, unknown or other
  misc_feature (540)..(557): n is a, c, g, or t
  modified_base (559)..(572): a, c, t, g, unknown or other
  misc_feature (559)..(572): n is a, c, g, or t
tcagcacgctacgtcacgaccggtgctcgatttagtcgatagtgaagggaaaggggcgtggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcataccttccaccacgtggggccggggcacccgtggtcacgcgtcgtcctcacgcctccaccgaacgggcccacgtccggtccttcccccgtggccncccgttaccctccaacgacgccaccgtcgtacgggggccacgacggccacgccccgttgggccctcggtcccgtcgggttaccgaaacgggtaccctaaccgttacccgtaaccgttacgggaccgttcggtccgtaacgggcgggtcccgggccgttacgggacccgtaaacggggccgacaacgttacggcngnngnnnnnnnnnnnnnnnnnngnnnnnnnnnnnnnn

SEQ ID NO: 186081 - DNA, 492 bp, Homo sapiens
  misc_feature: GYAE6OF02JJ3YZ.30.68.G02.1.454.CMB.1.raw
  modified_base (448)..(448): a, c, t, g, unknown or other
  misc_feature (448)..(448): n is a, c, g, or t
  modified_base (463)..(463): a, c, t, g, unknown or other
  misc_feature (463)..(463): n is a, c, g, or t
  modified_base (466)..(492): a, c, t, g, unknown or other
  misc_feature (466)..(492): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggattacaaggcatactccaccacgtggggccggggcacccgtggtcagcgtctcctcacgcctcccaccaagggccccagtccggtccttccccctcggccacccctccctccaagacgccaccctcgtcggggcacgagccacgcccgtgggctcggccgtggtaccgaacggtaccttaccttccgacgtacgcgtcgcgtgacggccgggcgnggacgaggcgcgagngcnnnnnnnnnnnnnnnnnnnnnnnnnnn

SEQ ID NO: 186082 - DNA, 441 bp, Homo sapiens
  misc_feature: GYAE6OF02GODMB.30.68.G02.1.454.CMB.1.raw
  modified_base (359)..(359): a, c, t, g, unknown or other
  misc_feature (359)..(359): n is a, c, g, or t
  modified_base (417)..(417): a, c, t, g, unknown or other
  misc_feature (417)..(417): n is a, c, g, or t
  modified_base (430)..(430): a, c, t, g, unknown or other
  misc_feature (430)..(430): n is a, c, g, or t
  modified_base (434)..(441): a, c, t, g, unknown or other
  misc_feature (434)..(441): n is a, c, g, or t
tcagcacgctacgtcacgaccggtgctcgatttagtcgatagtgaagggaaagggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcgccgtacggtcacgcgtctcctccagcctccacccaagggcccgactcggtcttccccgtcggcaccctcctccacgagcacctctggggcncagcagcctgggctgctcgtcgacggactacttccacgtacgcgtcgctcgagcgggngtcggcgagcgcntagnnnnnnnn

SEQ ID NO: 186083 - DNA, 523 bp, Homo sapiens
  misc_feature: GYAE6OF02HGWX3.30.68.G02.1.454.CMB.1.raw
  modified_base (315)..(315): a, c, t, g, unknown or other
  misc_feature (315)..(315): n is a, c, g, or t
  modified_base (329)..(329): a, c, t, g, unknown or other
  misc_feature (329)..(329): n is a, c, g, or t
  modified_base (333)..(333): a, c, t, g, unknown or other
  misc_feature (333)..(333): n is a, c, g, or t
  modified_base (477)..(477): a, c, t, g, unknown or other
  misc_feature (477)..(477): n is a, c, g, or t
  modified_base (481)..(481): a, c, t, g, unknown or other
  misc_feature (481)..(481): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
  modified_base (488)..(489): a, c, t, g, unknown or other
  misc_feature (488)..(489): n is a, c, g, or t
  modified_base (492)..(494): a, c, t, g, unknown or other
  misc_feature (492)..(494): n is a, c, g, or t
  modified_base (498)..(498): a, c, t, g, unknown or other
  misc_feature (498)..(498): n is a, c, g, or t
  modified_base (500)..(509): a, c, t, g, unknown or other
  misc_feature (500)..(509): n is a, c, g, or t
  modified_base (511)..(515): a, c, t, g, unknown or other
  misc_feature (511)..(515): n is a, c, g, or t
  modified_base (517)..(519): a, c, t, g, unknown or other
  misc_feature (517)..(519): n is a, c, g, or t
  modified_base (521)..(523): a, c, t, g, unknown or other
  misc_feature (521)..(523): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacgaaggcataccttccaccacgtgggggcccgggcaccccgtggtccagccgtctcctcacgcccccacacggcccnctcgtccttccccncgcnccctcctccacgagccaccgtcgtcgggcacacgtcgcccgtggtcgtcgtccgtcggtcgaacggtaaccgtaccttccgtacgtacgcggttcgaccgtggaacgggtcggggcgtcgggaccgaagggccgcgtaagaggncgangcngncnncgnnncgcncnnnnnnnnnnannnnncnnncnnn

SEQ ID NO: 186084 - DNA, 505 bp, Homo sapiens
  misc_feature: GYAE6OF02F4T7E.30.68.G02.1.454.CMB.1.raw
  modified_base (377)..(377): a, c, t, g, unknown or other
  misc_feature (377)..(377): n is a, c, g, or t
  modified_base (437)..(437): a, c, t, g, unknown or other
  misc_feature (437)..(437): n is a, c, g, or t
  modified_base (473)..(473): a, c, t, g, unknown or other
  misc_feature (473)..(473): n is a, c, g, or t
  modified_base (476)..(476): a, c, t, g, unknown or other
  misc_feature (476)..(476): n is a, c, g, or t
  modified_base (479)..(505): a, c, t, g, unknown or other
  misc_feature (479)..(505): n is a, c, g, or t
tcagcacgctacgtcacgaccggtgctcgatttagtcgatagtgaagggaaagggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcataccttccaccacgtggggccgggcaccctggtcagcgtctcctcagccctccaccaacgggccccagtccggtccttcccccgtggcctacccctccctaccaacgacgccaccctcgtcggggccacgngcgacgccctgggctcgtccgtggtacaacggacttactccacgtagccgtcgcgtaggnggtccgggcgtgggaccgtaagggccgacaagtcgnagncgnnnnnnnnnnnnnnnnnnnnnnnnnnn

SEQ ID NO: 186085 - DNA, 544 bp, Homo sapiens
  misc_feature: GYAE6OF02FJDCA.30.68.G02.1.454.CMB.1.raw
  modified_base (499)..(499): a, c, t, g, unknown or other
  misc_feature (499)..(499): n is a, c, g, or t
  modified_base (501)..(502): a, c, t, g, unknown or other
  misc_feature (501)..(502): n is a, c, g, or t
  modified_base (507)..(544): a, c, t, g, unknown or other
  misc_feature (507)..(544): n is a, c, g, or t
tcagcacgctacgtcacgaccggtgctcgatttagtcgatagtgaagggaaagggcagagtgttagcagcaacttagcctggtactagcagaaacctggccaggctcccaggctcctcatctatgatgcgtccaccagggtcactggtatccccagccaggttcagcggcagtgggtctgggacagagttcagtcctcaccatcagcagccctgcagtctgaagtattttgacttagtttatttattggtcagccaacgtataaacctaattgggtcccttaccgggtaaaacctttttgggcccgaacggggggaccccaaggtccttggaagtattacaaaacggaaccttaggttgggtctaggtccaacccgtactaccgttggttacctttctaacttcctttcccccggcctaacttccgtaggaaacccggtgccggtacgccgtaggacgggccggggtccgtacgggaccgaacgggccgacaacgtagntnncagcnnnnnnnnnnnnnnnnnnnnnnnnnnnnnnnnnnnnnn

SEQ ID NO: 186086 - DNA, 577 bp, Homo sapiens
  misc_feature: GYAE6OF02G5NSI.30.68.G02.1.454.CMB.1.raw
  modified_base (340)..(340): a, c, t, g, unknown or other
  misc_feature (340)..(340): n is a, c, g, or t
  modified_base (534)..(534): a, c, t, g, unknown or other
  misc_feature (534)..(534): n is a, c, g, or t
  modified_base (538)..(538): a, c, t, g, unknown or other
  misc_feature (538)..(538): n is a, c, g, or t
  modified_base (543)..(543): a, c, t, g, unknown or other
  misc_feature (543)..(543): n is a, c, g, or t
  modified_base (545)..(545): a, c, t, g, unknown or other
  misc_feature (545)..(545): n is a, c, g, or t
  modified_base (548)..(549): a, c, t, g, unknown or other
  misc_feature (548)..(549): n is a, c, g, or t
  modified_base (551)..(555): a, c, t, g, unknown or other
  misc_feature (551)..(555): n is a, c, g, or t
  modified_base (557)..(577): a, c, t, g, unknown or other
  misc_feature (557)..(577): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttccaccctggagtgggagttacaaggcatacttccacacgtggggccgggcaccctggtcacgcgtctcctcacgccctcccaccgaacgggccccagttccggtccttcccccgtggcccnccccttcctaccaagacgccacctcgtcgggggcacgacgccgacgccccgtgggtctcggcccgttcgggtaccgtaaacgggtaccttaaccgttaccccgtaacggtaccggtccggtcgaccgtttagggacgggtaccggggccgttcggggacccgtaaacggggtaccggaccgtaaggttaacggntcgngcgcngngcnncnnnnngnnnnnnnnnnnnnnnnnnnnn

SEQ ID NO: 186087 - DNA, 493 bp, Homo sapiens
  misc_feature: GYAE6OF02FVTI6.30.68.G02.1.454.CMB.1.raw
  modified_base (458)..(458): a, c, t, g, unknown or other
  misc_feature (458)..(458): n is a, c, g, or t
  modified_base (463)..(463): a, c, t, g, unknown or other
  misc_feature (463)..(463): n is a, c, g, or t
  modified_base (465)..(493): a, c, t, g, unknown or other
  misc_feature (465)..(493): n is a, c, g, or t
tcagcacgctacgtcacgaccggtgctcgatttagtcgatagtgaagggaaagggggctggaatgggtctcaagtattgctggtagtggtgatagcacatactacgcagcccatcgtgaagggccggttcaccatctccagggacagttcgaagaacacactgtttctgcaaatgaacagcctgagagtcgaggacacggccgtatacttactgtgcgcttttcaccctggagtgggagttacgaaggcataccttccaccacgtggggccggggcaccgtcgtcagcgtcgtcctcacgcctccaccaacgggcccactcggtccttcccccgtcggccaccctcctccacgacgcacctcgtcgggggcacgacgcacgcccgtcgggctcgccgtcggtacaaggaccttactccgacgtacgcgtcgcgtcgaggcgggcgtggcgacggccgnagtgnannnnnnnnnnnnnnnnnnnnnnnnnnnnn

SEQ ID NO: 186088 - DNA, 516 bp, Homo sapiens
  misc_feature: GYAE6OF02IFZE6.30.68.G02.1.454.CMB.1.raw
  modified_base (185)..(185): a, c, t, g, unknown or other
  misc_feature (185)..(185): n is a, c, g, or t
  modified_base (473)..(473): a, c, t, g, unknown or other
  misc_feature (473)..(473): n is a, c, g, or t
  modified_base (498)..(516): a, c, t, g, unknown or other
  misc_feature (498)..(516): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagngtcgagacgacggccgtatattactgtgcgctttcacccttggacgtgggagttacaaggcatacttccaccactggggccggggcacccgtggtcagcgtcgtctcagcctcccgaaccgacgggcccctaactccgggttacctcccccgtcggacctacccccttaccctcccgaacgacgcctaacccctcggtcgggggacacgtcgaccgcgccgtcggcgtacgtccgtacggtcgaacggtaccttcctaccgtacgtacgcggtgtacgtgagcgggtntcggacgacggtgaccagtagcagnnnnnnnnnnnnnnnnnnn

SEQ ID NO: 186089 - DNA, 501 bp, Homo sapiens
  misc_feature: GYAE6OF02G8H08.30.68.G02.1.454.CMB.1.raw
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (341)..(341): a, c, t, g, unknown or other
  misc_feature (341)..(341): n is a, c, g, or t
  modified_base (359)..(359): a, c, t, g, unknown or other
  misc_feature (359)..(359): n is a, c, g, or t
  modified_base (434)..(434): a, c, t, g, unknown or other
  misc_feature (434)..(434): n is a, c, g, or t
  modified_base (473)..(501): a, c, t, g, unknown or other
  misc_feature (473)..(501): n is a, c, g, or t
tcagcacgctacgtcacgaccggtgctcgatttagtcgatagtgaaggggaaaggggctggaatgggtctcaagtattgctggtagtggtgatagcacatactacgcagccatcgtgaagggccggttcaccatctccagggacagttcgaaagaacacactgtttctgacaaatgaacagcctgagagtcgaggacacggccgtatattactgtgcgtctttcaccctggagtgggagttacaaggcatactccacacgtggggccggggcacccgtggtcagcgtctcncacncctaccacacggccatcgtcctccccgtgcctccctccaccagacnctacctcgtggggcacgngaccagccgtcggctcgccgtcgggtacaaacggtacttaccctcgacgttcggcgtgcggtagacggtccgggngtacggggcaacggggccgactagtaacgcgctagctgnnnnnnnnnnnnnnnnnnnnnnnnnnnnn

SEQ ID NO: 186090 - DNA, 550 bp, Homo sapiens
  misc_feature: GYAE6OF02GZ6CD.30.68.G02.1.454.CMB.1.raw
  modified_base (351)..(351): a, c, t, g, unknown or other
  misc_feature (351)..(351): n is a, c, g, or t
  modified_base (512)..(513): a, c, t, g, unknown or other
  misc_feature (512)..(513): n is a, c, g, or t
  modified_base (522)..(524): a, c, t, g, unknown or other
  misc_feature (522)..(524): n is a, c, g, or t
  modified_base (527)..(528): a, c, t, g, unknown or other
  misc_feature (527)..(528): n is a, c, g, or t
  modified_base (530)..(535): a, c, t, g, unknown or other
  misc_feature (530)..(535): n is a, c, g, or t
  modified_base (537)..(546): a, c, t, g, unknown or other
  misc_feature (537)..(546): n is a, c, g, or t
  modified_base (548)..(550): a, c, t, g, unknown or other
  misc_feature (548)..(550): n is a, c, g, or t
tcagcacgctacgtcacgaccggtgctcgatttagtcgatagtgaagggaaagggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaacgggcccagtccggtccttcccccgtggccacccctcctaccaacgacnccacctcgtggggccacgacgccacgcccgtgggctcggccgtcggtacgaaacggaccgttaccttcccgaacggttacgccgttagtcccttaggaacggtccggggtcttacggggaccgtaaacgggccgaaccgtaagttaacgggcagcgagacnncgcgcacgnnnacnncnnnnnngnnnnnnnnnncnnn

SEQ ID NO: 186091 - DNA, 449 bp, Homo sapiens
  misc_feature: GYAE6OF02HJIB2.30.68.G02.1.454.CMB.1.raw
  modified_base (417)..(417): a, c, t, g, unknown or other
  misc_feature (417)..(417): n is a, c, g, or t
  modified_base (433)..(433): a, c, t, g, unknown or other
  misc_feature (433)..(433): n is a, c, g, or t
  modified_base (438)..(449): a, c, t, g, unknown or other
  misc_feature (438)..(449): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactgggccggggcaccctggtcagcgtctcctcagcctccaccaacggcccatccggtccttccccctggccacccctcctccaacgacgcacctcgtcggggcacgacgcacgcccgtgggctggcctgtcgaacggactaccttccacgtagcgtgctgngcgggctggcaaggcncatgnnnnnnnnnnnn

SEQ ID NO: 186092 - DNA, 522 bp, Homo sapiens
  misc_feature: GYAE6OF02F2B01.30.68.G02.1.454.CMB.1.raw
  modified_base (494)..(522): a, c, t, g, unknown or other
  misc_feature (494)..(522): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgttctgcaaatgaacagcctgagagtcgaggacacggccgtatattactgtgcgctttcaccctggagtgggagttacaaggcagtaccttccaccacgtggggccggggcacccgtggtcagcgtcctcctcacgccctcaccgaacgggccccagtccggttcccttccccctcggcctacccctccctccaaggacgcaaccgtcgtgggggccacagccacgtcccgtgggctcggcccttgggtacgaaacgggtaccttaccttaccgaaccggtcgtcggtcgactcgggacggtcgggctcgggacgaacgggccgactatagcgnnnnnnnnnnnnnnnnnnnnnnnnnnnnn

SEQ ID NO: 186093 - DNA, 767 bp, Homo sapiens
  misc_feature: GYAE6OF02GH86M.30.68.G02.1.454.CMB.1.raw
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggcgtatattacgtgtgcgtcctttacaccctggacggttagggagttaaccgaaggtaccattaccgtttacccaaccgtaacggttcggggggccccggggtaccgtaaccccggttcgggttacgacggtccggttcctccccgttacgaccggtccccttaccccgaacccgtaaacgggggcccctaacggttcccggttccccgtttccccccgcgggacccctacccccgttccctacccgaaacgtaccgtcctaacccggtcggtcgggggacctaccgacggtaccaccggtccccggttacgggccgttccggtaccggtaccggtacgtaaaccggtaaccgtttacccgttaccccgtaaggtaccgggtcgttacgggtaccgtgggtaaccgggtcccggggtacgtcggggaaccgtaacgggaccgacgttaaccgttaggccgctacgtcacgtacgacgtacgtacgtacgtcgtagtacgacgacgcgtacgtacgacgtacgtacgtacgcgacgtcgacgtcgagtacgtcgtctcgtcgtactcgtcg

SEQ ID NO: 186094 - DNA, 754 bp, Homo sapiens
  misc_feature: GYAE6OF02GJ6R5.30.68.G02.1.454.CMB.1.raw
tcagcacgctacgtcacgaccggtgctcgatttagtcgatagtgaagggaaagggggcgtggaatgggtctcaagtattgctggtagtggtgatacgcacatactacgcagtccatcgtgaaggaccggttcaccatctccagggacagttcgaagaacacactgtttctgacaaatgaacacgcctgagtagtcgaggacacggccgtatattactgtgcgctttcacccgtggagtgggagttacgaaggtacaataccttaccaccacgtcggggccgggaccacccgtggtacacgtccgtccgtcctcgaacgtccctaccgaaccgtaacggggccctacgttcccggttaccccttcccccgtggaccctaccccgtaccctaccgaacgacgtccgtaacctcggtacggggaccaacgtacggaccgtacggccccgttgggaccgttccgaccgttacgggttaaccgaaacggttaccttaacccgttacccggtaacggtaccggtaccggtttacggaccgtttacggacggggttacccggcgttaccgggtaaccggtaaccgggtccgaccgtaaaggttaccgggactacgtaaaggcgtaacgtcggtaacaccggtagtacggtaacggtcaaagggaccctgtagttaacgaacggtaccgtacgtacggtacgtaacgtacgtacgtacgtacgtacgtacgtacgtaccgtaccgtaccgtacgtacgtacg

SEQ ID NO: 186095 - DNA, 563 bp, Homo sapiens
  misc_feature: GYAE6OF02JT6IE.30.68.G02.1.454.CMB.1.raw
  modified_base (331)..(331): a, c, t, g, unknown or other
  misc_feature (331)..(331): n is a, c, g, or t
  modified_base (519)..(519): a, c, t, g, unknown or other
  misc_feature (519)..(519): n is a, c, g, or t
  modified_base (525)..(525): a, c, t, g, unknown or other
  misc_feature (525)..(525): n is a, c, g, or t
  modified_base (530)..(530): a, c, t, g, unknown or other
  misc_feature (530)..(530): n is a, c, g, or t
  modified_base (534)..(535): a, c, t, g, unknown or other
  misc_feature (534)..(535): n is a, c, g, or t
  modified_base (538)..(538): a, c, t, g, unknown or other
  misc_feature (538)..(538): n is a, c, g, or t
  modified_base (541)..(548): a, c, t, g, unknown or other
  misc_feature (541)..(548): n is a, c, g, or t
  modified_base (550)..(563): a, c, t, g, unknown or other
  misc_feature (550)..(563): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcacccgtggagtgggagttacaaggcatacttccacacgtcggggccgggcacccgtggtcagcgtctcctcagcctaccaccaagggcccactccgggtaccttcccccgnggcccacccgtccctaccaagtacgcctacctcggtcggggccacgacgcacgcccgtgggctcggcctcgggtacaaacgggtaccttaccgttaccgaacggtcgtaccggttcgaccgttggaacgggtcccggggacgttcggggaccgaaacggtcccggaacgacggttacgggcacgagtncgtacncgcgntagnngcncgnnnnnnnngnnnnnnnnnnnnnn

SEQ ID NO: 186096 - DNA, 615 bp, Homo sapiens
  misc_feature: GYAE6OF02JWJI6.30.68.G02.1.454.CMB.1.raw
  modified_base (569)..(569): a, c, t, g, unknown or other
  misc_feature (569)..(569): n is a, c, g, or t
  modified_base (576)..(576): a, c, t, g, unknown or other
  misc_feature (576)..(576): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
  modified_base (586)..(587): a, c, t, g, unknown or other
  misc_feature (586)..(587): n is a, c, g, or t
  modified_base (591)..(593): a, c, t, g, unknown or other
  misc_feature (591)..(593): n is a, c, g, or t
  modified_base (595)..(595): a, c, t, g, unknown or other
  misc_feature (595)..(595): n is a, c, g, or t
  modified_base (597)..(597): a, c, t, g, unknown or other
  misc_feature (597)..(597): n is a, c, g, or t
  modified_base (599)..(600): a, c, t, g, unknown or other
  misc_feature (599)..(600): n is a, c, g, or t
  modified_base (602)..(604): a, c, t, g, unknown or other
  misc_feature (602)..(604): n is a, c, g, or t
  modified_base (606)..(615): a, c, t, g, unknown or other
  misc_feature (606)..(615): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggcgtatattactgtgcgtctttcaccctggagtgggagttacgaaggcatactccaccacgtggggccgggcaccgtggtcagcgtcgtcctcacgccctccaccgacgggcccacgtccggtcccttcccccgtcggccaccccgtccctaccgaacgtacgccacccgtcggtcgggggaccaccgacgaccgacgtccccgtcgggaccgttcgggtacccgttcggggtaacgtaaacccggggtaaaccctttaccggttaccccgtaacggtaccgggtaccggtttacggaccggttacgggacggggtccggggtaccggttccggggaccgtaaacggggccgtaccgtaaaggttcggatcncgaccgngcgncngncnncacnnnangngnncnnncnnnnnnnnnn

SEQ ID NO: 186097 - DNA, 549 bp, Homo sapiens
  misc_feature: GYAE6OF02JJ648.30.68.G02.1.454.CMB.1.raw
  modified_base (354)..(354): a, c, t, g, unknown or other
  misc_feature (354)..(354): n is a, c, g, or t
  modified_base (509)..(509): a, c, t, g, unknown or other
  misc_feature (509)..(509): n is a, c, g, or t
  modified_base (517)..(521): a, c, t, g, unknown or other
  misc_feature (517)..(521): n is a, c, g, or t
  modified_base (523)..(531): a, c, t, g, unknown or other
  misc_feature (523)..(531): n is a, c, g, or t
  modified_base (533)..(549): a, c, t, g, unknown or other
  misc_feature (533)..(549): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttccaccctggagtgggagttacaaggcatacttccaccacgtggggccggggcaccctggtcagcgtcctctcacgcctccaccaacgggcccactccggtcccttcccccgtggccctaccctccctaccaacgngccaccgtcgtgggggccacagccacgccccgtcgggcctcggccgttaggtccgaaacgggtacctacccttacccgtacggtacggacccgttggtccgtggaccggtcggggtaccgtcgggtaccgtaaacgggccggacgaacggtacgntagcgacnnnnngnnnnnnnnncnnnnnnnnnnnnnnnnn

SEQ ID NO: 186098 - DNA, 457 bp, Homo sapiens
  misc_feature: GYAE6OF02ICEJW.30.68.G02.1.454.CMB.1.raw
  modified_base (333)..(333): a, c, t, g, unknown or other
  misc_feature (333)..(333): n is a, c, g, or t
  modified_base (364)..(364): a, c, t, g, unknown or other
  misc_feature (364)..(364): n is a, c, g, or t
  modified_base (430)..(430): a, c, t, g, unknown or other
  misc_feature (430)..(430): n is a, c, g, or t
  modified_base (436)..(457): a, c, t, g, unknown or other
  misc_feature (436)..(457): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtgggccggggcaccccgtggtcagcgtcctcctcagcctccaccaacggcccatccggtccttcccccgtggccnccctcctccaagagccactcgcggggcacgngcagcccgtggctgcctgtcaaggcctactccaacgtagcgtgctgacgcgggctggacgaaggcnagtagnnnnnnnnnnnnnnnnnnnnnn

SEQ ID NO: 186099 - DNA, 575 bp, Homo sapiens
  misc_feature: GYAE6OF02J3KJ3.30.68.G02.1.454.CMB.1.raw
  modified_base (135)..(135): a, c, t, g, unknown or other
  misc_feature (135)..(135): n is a, c, g, or t
  modified_base (182)..(182): a, c, t, g, unknown or other
  misc_feature (182)..(182): n is a, c, g, or t
  modified_base (447)..(447): a, c, t, g, unknown or other
  misc_feature (447)..(447): n is a, c, g, or t
  modified_base (528)..(528): a, c, t, g, unknown or other
  misc_feature (528)..(528): n is a, c, g, or t
  modified_base (531)..(531): a, c, t, g, unknown or other
  misc_feature (531)..(531): n is a, c, g, or t
  modified_base (534)..(534): a, c, t, g, unknown or other
  misc_feature (534)..(534): n is a, c, g, or t
  modified_base (537)..(538): a, c, t, g, unknown or other
  misc_feature (537)..(538): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
  modified_base (544)..(548): a, c, t, g, unknown or other
  misc_feature (544)..(548): n is a, c, g, or t
  modified_base (550)..(562): a, c, t, g, unknown or other
  misc_feature (550)..(562): n is a, c, g, or t
  modified_base (564)..(566): a, c, t, g, unknown or other
  misc_feature (564)..(566): n is a, c, g, or t
  modified_base (568)..(568): a, c, t, g, unknown or other
  misc_feature (568)..(568): n is a, c, g, or t
  modified_base (570)..(575): a, c, t, g, unknown or other
  misc_feature (570)..(575): n is a, c, g, or t
tcagcacgctacgtcacgaccggtgctcgatttagtcgatagtgaagggaaggggctggaatgggtctcaagtattgctggtagtggtgatagcacatactacgcagccatcgtgaacgggccgttcaccatccncgagggcagttcaagaactactacttgtttcagacaaagtcgaaacngtccgagaacgagaacgaggacacggtctgttagtacttacgcgggcggccggggaccggacaccctaccgtaccggaaccctaaccaacgaaccgaagtaaccgtcgggtcgggaccgaccggtaacccgtggtccgccgttcacctccaacgtcccaccgaccaacgggtcccagtcccgtcctccccgtcgaccctaccctactaccgaacgaccgtccgacgttcggcgggaccaacgacgccgtaccgccggtggtaccncgtccgtacggtaacaacggtacctaacgtcccgaaggccgtcgtgcgtaggcggtcgcgtggacacggtcgacagtacgnacncgntcnncncnannnnngnnnnnnnnnnnnncnnncncnnnnnn

SEQ ID NO: 186100 - DNA, 554 bp, Homo sapiens
  misc_feature: GYAE6OF02FNX1Q.30.68.G02.1.454.CMB.1.raw
  modified_base (472)..(472): a, c, t, g, unknown or other
  misc_feature (472)..(472): n is a, c, g, or t
  modified_base (478)..(478): a, c, t, g, unknown or other
  misc_feature (478)..(478): n is a, c, g, or t
  modified_base (485)..(485): a, c, t, g, unknown or other
  misc_feature (485)..(485): n is a, c, g, or t
  modified_base (492)..(492): a, c, t, g, unknown or other
  misc_feature (492)..(492): n is a, c, g, or t
  modified_base (496)..(496): a, c, t, g, unknown or other
  misc_feature (496)..(496): n is a, c, g, or t
tcagcacgctacgtcacgaccggtgctcgatttagtcgatagtgaagggaaaggggctggaatgggtctcaagtatttgctggtagtggtgatagcacatactacgcagccatcgtgaaggccggttcaccatctccagggacagttcgaagaacacactgtttctgcaaatgaacagcctgagagtcgaggacacggccgtatattactgtgcgctttcaccctggagtggggagttacaaggcactacttccgaccactggggccggggcacctggtcagcgtctcctcagcctccaccgaaggcccatcggtcttccccctggccacctcctcctaagacgctacctcgtacgggggcacacgcacgccctgggctcgcctgggcaaggacctacgttccacgtacgcgtacggccttacggaggccgggtagtcggggacgaaacgggtcccggacaacgttacgatnagacgngcagcanagacgancganacacacgacgacagacgagactcggagacgacgtacacgacgtacgtacacgatagcg

SEQ ID NO: 186101 - DNA, 655 bp, Homo sapiens
  misc_feature: GYAE6OF02GAGX2.30.68.G02.1.454.CMB.1.raw
  modified_base (222)..(222): a, c, t, g, unknown or other
  misc_feature (222)..(222): n is a, c, g, or t
  modified_base (565)..(565): a, c, t, g, unknown or other
  misc_feature (565)..(565): n is a, c, g, or t
  modified_base (576)..(576): a, c, t, g, unknown or other
  misc_feature (576)..(576): n is a, c, g, or t
  modified_base (606)..(606): a, c, t, g, unknown or other
  misc_feature (606)..(606): n is a, c, g, or t
  modified_base (631)..(631): a, c, t, g, unknown or other
  misc_feature (631)..(631): n is a, c, g, or t
  modified_base (650)..(650): a, c, t, g, unknown or other
  misc_feature (650)..(650): n is a, c, g, or t
  modified_base (654)..(654): a, c, t, g, unknown or other
  misc_feature (654)..(654): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgtctttcnccctggagtgggagttacaaggcatacttccaccactggggccgggcacccgtggtcagcgtctcctcacgccctccacccgacgggcccagtccggtcctttcccccgtggccctacccctccctaccgaacgagcctacccgtaccggtgggggacccacgaacgtccacggtaccccgtcggggctccggtcccttacggggtacaaaccggggtacctttacccgttacccgtaaccggttaccggccggtttacggtaccggttacggaacggggttcccggggtcccggttgggtaacccggaaaacggggccccgtaacggtaaggttaacccggngacgcgtacgngacgacgacgacgacgcgcgtacgcgacgncacgtcgtactcgagtcgtcgtacncgtgacgtcgcgcgacgcnctcng

SEQ ID NO: 186102 - DNA, 630 bp, Homo sapiens
  misc_feature: GYAE6OF02JSO4B.30.68.G02.1.454.CMB.1.raw
  modified_base (156)..(156): a, c, t, g, unknown or other
  misc_feature (156)..(156): n is a, c, g, or t
  modified_base (579)..(579): a, c, t, g, unknown or other
  misc_feature (579)..(579): n is a, c, g, or t
  modified_base (589)..(589): a, c, t, g, unknown or other
  misc_feature (589)..(589): n is a, c, g, or t
  modified_base (593)..(594): a, c, t, g, unknown or other
  misc_feature (593)..(594): n is a, c, g, or t
  modified_base (596)..(596): a, c, t, g, unknown or other
  misc_feature (596)..(596): n is a, c, g, or t
  modified_base (599)..(599): a, c, t, g, unknown or other
  misc_feature (599)..(599): n is a, c, g, or t
  modified_base (601)..(602): a, c, t, g, unknown or other
  misc_feature (601)..(602): n is a, c, g, or t
  modified_base (605)..(606): a, c, t, g, unknown or other
  misc_feature (605)..(606): n is a, c, g, or t
  modified_base (611)..(611): a, c, t, g, unknown or other
  misc_feature (611)..(611): n is a, c, g, or t
  modified_base (613)..(614): a, c, t, g, unknown or other
  misc_feature (613)..(614): n is a, c, g, or t
  modified_base (617)..(618): a, c, t, g, unknown or other
  misc_feature (617)..(618): n is a, c, g, or t
  modified_base (620)..(620): a, c, t, g, unknown or other
  misc_feature (620)..(620): n is a, c, g, or t
  modified_base (622)..(622): a, c, t, g, unknown or other
  misc_feature (622)..(622): n is a, c, g, or t
  modified_base (626)..(626): a, c, t, g, unknown or other
  misc_feature (626)..(626): n is a, c, g, or t
  modified_base (629)..(629): a, c, t, g, unknown or other
  misc_feature (629)..(629): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacncactgttctgcaaatgaacagcctgagagtcgaggacacggccgtatattactggtgctacgtttcacccttggagtgggaagttacgaaggctatacttccacctacggtcggggccgggcctacccgtgggtcagccggttacctccgtcacgccgtaccgaccgtaacgggccctaacgtccggttccttcccccgtagggaccctaaccccgttccgtaccgtaacgacgaccgtaccttcggtcggggacaaccgcgaccgacggccccgtggggtctacggtccggttaaggtcccgtaaacggggttaacccttacccgttacccgaccggtttaacggtccggttacggactttacgggcgggaaccgggttccgtaggacgaacgggttccgacgttacgagtccgagtgcganccggatccgntcgnncngcncnngcnncgtgncnngcnngncncgcncgnc

SEQ ID NO: 186103 - DNA, 721 bp, Homo sapiens
  misc_feature: GYAE6OF02IR123.30.68.G02.1.454.CMB.1.raw
  modified_base (165)..(165): a, c, t, g, unknown or other
  misc_feature (165)..(165): n is a, c, g, or t
  modified_base (194)..(194): a, c, t, g, unknown or other
  misc_feature (194)..(194): n is a, c, g, or t
  modified_base (210)..(210): a, c, t, g, unknown or other
  misc_feature (210)..(210): n is a, c, g, or t
  modified_base (631)..(631): a, c, t, g, unknown or other
  misc_feature (631)..(631): n is a, c, g, or t
  modified_base (636)..(636): a, c, t, g, unknown or other
  misc_feature (636)..(636): n is a, c, g, or t
  modified_base (644)..(644): a, c, t, g, unknown or other
  misc_feature (644)..(644): n is a, c, g, or t
  modified_base (667)..(667): a, c, t, g, unknown or other
  misc_feature (667)..(667): n is a, c, g, or t
tcagcacgctacgtcacgaccggtgctcgatttagtcgatagtgaagggaaggggctggaatgggtctcaagtattgctggtagtggtgatagcacatactacgcagccatcgtgaaggccggttcaccatctccagggacagttcgaagacacacgtgtttctncgaaatgaacagcctgagagtcgaggacncggccgtatacttacngtcgcgtctttaccaccgtggacgtggtacgttacaaggcataccttaccgaccgtacgtcgggggcccgggtctacccgtggtcacggtacgtcctcccttcgaacggtcccctaccgtaacccggaacgggtcccctaacgttcccgggttaccctttccccccggtcggacccctaccccgtacccctaccgaacgtaccgaccgtaacccgttccggtaggggaccacggacggaccgaccgaccccggttgggaccgttccggtccgtacgggtaccgaaacgggttaccttaacccggtttacccgacggttacggtcccggtttagcccggttacgggaaccgggtccgggtacgtacgggacccggaacgggactacccggtaagttacggccgagcggacgcgtcgcgtacncgtancgtgacgngtcacgaccgtagtcgacgtacncgtcgtacgacgtacgtacgtacgtactacgtacgtcgtacgtacgtacgtacg

SEQ ID NO: 186104 - DNA, 515 bp, Homo sapiens
  misc_feature: GYAE6OF02FLO15.30.68.G02.1.454.CMB.1.raw
  modified_base (484)..(485): a, c, t, g, unknown or other
  misc_feature (484)..(485): n is a, c, g, or t
  modified_base (487)..(490): a, c, t, g, unknown or other
  misc_feature (487)..(490): n is a, c, g, or t
  modified_base (492)..(515): a, c, t, g, unknown or other
  misc_feature (492)..(515): n is a, c, g, or t
tcagcacgctacgtcacgaccggtgctcgatttagtcgatagtgaagggaaagggggctggaatgggtctcaagtattgctggtagtggtgatagcacatactacgcagccatcgtgaagggccggttcaccatctccaggggacagttcgaagaacacactgtttctgcaaatgaacagcctgagagtcgaggacacggccgtatattactgtgcgtctttcacccgtggagtgggagttacaaggcataccttccaccacgtcggggccgggccaccgtggtcagccgtctcctcagccctccaccgaacgggcccacgtccggtccttcccccgtggcctcccctccctaccgaacggacgccacctcggtcggggccacgcgcacgcccgtgggctcgccgtggacgaacggtaccttacctccgacgtacgcgtcgcgtgacggcgggtcgtcgggaccgaacgggccgagacgtaggnngnnnngnnnnnnnnnnnnnnnnnnnnnnnn

SEQ ID NO: 186105 - DNA, 614 bp, Homo sapiens
  misc_feature: GYAE6OF02H8UP5.30.68.G02.1.454.CMB.1.raw
  modified_base (195)..(195): a, c, t, g, unknown or other
  misc_feature (195)..(195): n is a, c, g, or t
  modified_base (522)..(522): a, c, t, g, unknown or other
  misc_feature (522)..(522): n is a, c, g, or t
  modified_base (539)..(539): a, c, t, g, unknown or other
  misc_feature (539)..(539): n is a, c, g, or t
  modified_base (541)..(541): a, c, t, g, unknown or other
  misc_feature (541)..(541): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacncggccgtatattactgtgcgctttcaccctggatggggattacaaggctatacttccacctacgtggggcccgggcaccctggtcagcgtctcctcagcctccacaacggcccagtccggtacttccccgtgccacccgtcctcgaacgacgccacctcgtcggggtacaccgtacgcaacggcccgtgggcgtacgccgttacggtacgaaacgggtaccttaacccgtttccgaacggttaacgccggttagtccgttacggacggtaccggggtcgttcgggaccgaacgggccgtacgtaacgttacgagtgtaccaggtacncgactcgacactacgangnctcgtacgacgtacgtacgtactacgtcgtagacgtacgtacgtcgtacgcgcgtacgacgtacgtacgtacg

SEQ ID NO: 186106 - DNA, 541 bp, Homo sapiens
  misc_feature: GYAE6OF02HHJK4.30.68.G02.1.454.CMB.1.raw
  modified_base (166)..(166): a, c, t, g, unknown or other
  misc_feature (166)..(166): n is a, c, g, or t
  modified_base (178)..(178): a, c, t, g, unknown or other
  misc_feature (178)..(178): n is a, c, g, or t
  modified_base (291)..(291): a, c, t, g, unknown or other
  misc_feature (291)..(291): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (348)..(348): a, c, t, g, unknown or other
  misc_feature (348)..(348): n is a, c, g, or t
  modified_base (366)..(366): a, c, t, g, unknown or other
  misc_feature (366)..(366): n is a, c, g, or t
  modified_base (370)..(370): a, c, t, g, unknown or other
  misc_feature (370)..(370): n is a, c, g, or t
  modified_base (470)..(470): a, c, t, g, unknown or other
  misc_feature (470)..(470): n is a, c, g, or t
  modified_base (473)..(475): a, c, t, g, unknown or other
  misc_feature (473)..(475): n is a, c, g, or t
  modified_base (481)..(481): a, c, t, g, unknown or other
  misc_feature (481)..(481): n is a, c, g, or t
  modified_base (490)..(491): a, c, t, g, unknown or other
  misc_feature (490)..(491): n is a, c, g, or t
  modified_base (493)..(493): a, c, t, g, unknown or other
  misc_feature (493)..(493): n is a, c, g, or t
  modified_base (498)..(498): a, c, t, g, unknown or other
  misc_feature (498)..(498): n is a, c, g, or t
  modified_base (516)..(516): a, c, t, g, unknown or other
  misc_feature (516)..(516): n is a, c, g, or t
  modified_base (521)..(521): a, c, t, g, unknown or other
  misc_feature (521)..(521): n is a, c, g, or t
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
  modified_base (537)..(537): a, c, t, g, unknown or other
  misc_feature (537)..(537): n is a, c, g, or t
tcagcacgctacgtcacgaccggtgctcgatttagtcgatagtgaagggaaaggggctggaatgggtctcgaagtattgctggtagtggtgatagcacatactacgcagccatcgtgaagggccggttcaccatctccagggacagttcgaagaacacactgttcngacaaatgaacngcctgagagtcgaggacaccggccgtatacttacgtgtgccgtctttcacccgtgggagtgggattacaaggcatactccacagtcggggccggcaccgtggcacgcgtctcncacgcctccaaccgacggcccagtccggtccttccccgngcccnccctcctacagcnccacctggcgggacacgngacncgtccgtgggctcgtccgtacggtacaacgtaccttaccgtccaacggtcgcgtcgtcgtggacggcggtcgtaggacgtaacgggtcgacgtagtacgncgnnnacgtcngtcgtgcgnngntacgngcgagctgtcagctgacngttancgtcncngctcgaacngtac

SEQ ID NO: 186107 - DNA, 480 bp, Homo sapiens
  misc_feature: GYAE6OF02FKDTF.30.68.G02.1.454.CMB.1.raw
  modified_base (381)..(381): a, c, t, g, unknown or other
  misc_feature (381)..(381): n is a, c, g, or t
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
  modified_base (441)..(443): a, c, t, g, unknown or other
  misc_feature (441)..(443): n is a, c, g, or t
  modified_base (445)..(455): a, c, t, g, unknown or other
  misc_feature (445)..(455): n is a, c, g, or t
  modified_base (457)..(480): a, c, t, g, unknown or other
  misc_feature (457)..(480): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtggtctgggacagagttcagtctcacatcagcagcctgcagtctagaacgtattttgctaggttttaattagttgtcagctaactaattaaaccaagttcggcccttaccgggtaaactttttcgggaccgagggggtaccaaggtccttagacggataccgaaacgaactggtcggactgccaccattacctgtcttcacttccttccncctaacgttctagtacgtagcgtntctggnggtcgggctgggactacggcgcgagtggannntnnnnnnnnnnngnnnnnnnnnnnnnnnnnnnnnnnn

SEQ ID NO: 186108 - DNA, 745 bp, Homo sapiens
  misc_feature: GYAE6OF02IR24O.30.68.G02.1.454.CMB.1.raw
  modified_base (171)..(171): a, c, t, g, unknown or other
  misc_feature (171)..(171): n is a, c, g, or t
  modified_base (183)..(183): a, c, t, g, unknown or other
  misc_feature (183)..(183): n is a, c, g, or t
tcagcacgctacgtcacgaccggtgctcgatttagtcgatagtgaaggaaagggggcgtcggaatgggtctcaagtattggctggtagtggtgatagcacactactacgtcacgccatcgtgaagggccggttcaccatctccagggacagttcgaagaacacactgttcngcaaatcgaacngcctgacgagtcgaggacacggccgtatattactgtgcgtctttcacctggagtgggagttacaaggcagttacttccacacgtgggaccgggcaccgtggtcgacgcgtcctcctcgacgtcctaccaaccaacggaccccacgttaccggttccgttacccccgtcggtacccctccccgttaccctacccgtaacgaccgtacccgtaacccgttccggttaccgggggtacctaccggaccgtaccgacccggtaccccggtacgggtaccgtccggtacccgttacgggtaccgtaaaaccgggtacctttaaccccgttacccgtaaccgggttaccgggtaccggttaccggtaccgttacggggaacggggtcccgggggtaccggttaacgggggaacccgggtaaacgggtacccggtacgtaaaggttacgtaacgtgtacgctacacgcactgacgtgtagtctacgtcgacaacgcgtacggtaccgtcgtacgtactctacgaccgtaccgaccgaccgtaccgtccgtacgacgtaccgtaccgtcg

SEQ ID NO: 186109 - DNA, 522 bp, Homo sapiens
  misc_feature: GYAE6OF02HFT8W.30.68.G02.1.454.CMB.1.raw
  modified_base (157)..(157): a, c, t, g, unknown or other
  misc_feature (157)..(157): n is a, c, g, or t
  modified_base (210)..(210): a, c, t, g, unknown or other
  misc_feature (210)..(210): n is a, c, g, or t
  modified_base (479)..(479): a, c, t, g, unknown or other
  misc_feature (479)..(479): n is a, c, g, or t
  modified_base (481)..(481): a, c, t, g, unknown or other
  misc_feature (481)..(481): n is a, c, g, or t
  modified_base (485)..(486): a, c, t, g, unknown or other
  misc_feature (485)..(486): n is a, c, g, or t
  modified_base (488)..(489): a, c, t, g, unknown or other
  misc_feature (488)..(489): n is a, c, g, or t
  modified_base (491)..(491): a, c, t, g, unknown or other
  misc_feature (491)..(491): n is a, c, g, or t
  modified_base (493)..(494): a, c, t, g, unknown or other
  misc_feature (493)..(494): n is a, c, g, or t
  modified_base (497)..(504): a, c, t, g, unknown or other
  misc_feature (497)..(504): n is a, c, g, or t
  modified_base (506)..(507): a, c, t, g, unknown or other
  misc_feature (506)..(507): n is a, c, g, or t
  modified_base (509)..(522): a, c, t, g, unknown or other
  misc_feature (509)..(522): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacanactgtttctgcaaatgaacagcctgagagtcgaggacacggccgtatattacngtgcgtctttcaccctggagtgggagttacaaggcatacttccaccacgtggggccgggcaccctggtcagcgtctcctcacgcctccaccaacgggcccagtcgtccttcccccgtggccacccctcctaccaacgacgctacccgtcgtcggggcacgagccgagccccgtggctcgccgtggtacaacggaccttacttccgacggtacgcggttgcgtagggacggccgggtacgtggaccgtaaggggccgacgtaagtacggncncgtnngnngngnngcnnnnnnnngnngnnnnnnnnnnnnnn

SEQ ID NO: 186110 - DNA, 621 bp, Homo sapiens
  misc_feature: GYAE6OF02GDSMW.30.68.G02.1.454.CMB.1.raw
  modified_base (558)..(558): a, c, t, g, unknown or other
  misc_feature (558)..(558): n is a, c, g, or t
  modified_base (566)..(566): a, c, t, g, unknown or other
  misc_feature (566)..(566): n is a, c, g, or t
  modified_base (577)..(577): a, c, t, g, unknown or other
  misc_feature (577)..(577): n is a, c, g, or t
  modified_base (581)..(581): a, c, t, g, unknown or other
  misc_feature (581)..(581): n is a, c, g, or t
  modified_base (585)..(585): a, c, t, g, unknown or other
  misc_feature (585)..(585): n is a, c, g, or t
  modified_base (590)..(590): a, c, t, g, unknown or other
  misc_feature (590)..(590): n is a, c, g, or t
  modified_base (592)..(592): a, c, t, g, unknown or other
  misc_feature (592)..(592): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
  modified_base (604)..(605): a, c, t, g, unknown or other
  misc_feature (604)..(605): n is a, c, g, or t
  modified_base (609)..(609): a, c, t, g, unknown or other
  misc_feature (609)..(609): n is a, c, g, or t
  modified_base (611)..(611): a, c, t, g, unknown or other
  misc_feature (611)..(611): n is a, c, g, or t
  modified_base (613)..(616): a, c, t, g, unknown or other
  misc_feature (613)..(616): n is a, c, g, or t
  modified_base (620)..(620): a, c, t, g, unknown or other
  misc_feature (620)..(620): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccacgtcggggccggggcacccgtggtcagccgtctcctcagcctcccaccgaacgggcccacttccggtcccttcccccgtcgggccaccccttccctaccaacgacggccctacccgtcggtacgggggccctacgacggcacggtccccgtacggggcccgtcggccttacggggtaccgtaaacgggtacctttaccgtttacccgaaccggttacggccggtttacggtccgttcgggaacgggtccccggggggtcgttcggggaaccggaaacgggggtcccgacggtaacgttaggnacgtgcgncgcgcgacgcngtcncgcngcgcncncgcncncncgcnnctcngncnnnncgcnc

SEQ ID NO: 186111 - DNA, 645 bp, Homo sapiens
  misc_feature: GYAE6OF02JX1ZJ.30.68.G02.1.454.CMB.1.raw
  modified_base (597)..(597): a, c, t, g, unknown or other
  misc_feature (597)..(597): n is a, c, g, or t
  modified_base (601)..(603): a, c, t, g, unknown or other
  misc_feature (601)..(603): n is a, c, g, or t
  modified_base (605)..(605): a, c, t, g, unknown or other
  misc_feature (605)..(605): n is a, c, g, or t
  modified_base (608)..(609): a, c, t, g, unknown or other
  misc_feature (608)..(609): n is a, c, g, or t
  modified_base (611)..(611): a, c, t, g, unknown or other
  misc_feature (611)..(611): n is a, c, g, or t
  modified_base (613)..(613): a, c, t, g, unknown or other
  misc_feature (613)..(613): n is a, c, g, or t
  modified_base (615)..(616): a, c, t, g, unknown or other
  misc_feature (615)..(616): n is a, c, g, or t
  modified_base (618)..(626): a, c, t, g, unknown or other
  misc_feature (618)..(626): n is a, c, g, or t
  modified_base (628)..(645): a, c, t, g, unknown or other
  misc_feature (628)..(645): n is a, c, g, or t
tcagcacgctacgtcacgaccggtgctcgatttagtcgatagtgaagggaaagggcagagtgttagcagcaacttagcctgggtaccagcagaaacctggccaggctcccaggctcctcatctatgatgcgtccaccgagggtcactggtataccccgagcccagggttcaggcggctaggtgggtcgtgggacagagttcagtctcaccatcagcagcctgcagtctagtaacgtatttagacttagtttagtttagttgtcgtaagcctaacgttaattaaactaaggtttccggtaccccgttaaccgggtttaaaacgttttcggggtaacccggaacggggggtaaccctaaacggttccgttagggtaaacgtaacgtttaaaccgaaaaccggttaaacgttgggttaccggtacgtacggtaaccctaaccgtacgtttacgttcgttaccgtttaaactcccgttacccgtttacccccggacgtaaccgttacgtaacgggtaaccggttaaccgtcgttacggacgttacgggacggggtccggtacgtaccgggtaggaccgtacgtacgtaagtaagcgatacncggnnncncgnngngntnnannnnnnnnngnnnnnnnnnnnnnnnnnn

SEQ ID NO: 186112 - DNA, 488 bp, Homo sapiens
  misc_feature: GYAE6OF02IXF64.30.68.G02.1.454.CMB.1.raw
  modified_base (186)..(186): a, c, t, g, unknown or other
  misc_feature (186)..(186): n is a, c, g, or t
  modified_base (445)..(445): a, c, t, g, unknown or other
  misc_feature (445)..(445): n is a, c, g, or t
  modified_base (449)..(450): a, c, t, g, unknown or other
  misc_feature (449)..(450): n is a, c, g, or t
  modified_base (452)..(488): a, c, t, g, unknown or other
  misc_feature (452)..(488): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagngttcagtctccaccatcagcagcctgcatctagaagtattttgctagtttattattgcagtcaactaataactaattcggggggggtaccttaccggtaaacgtttcggaccgaggggtaccaacgtacttagacgactacgaaacgtaactggtcggcgtacgacacactctgtcttactacttcctaccgcctacttcgtagtaacgtacgtacgtgtcgtaggacggcgggtcgtacggacgacggacgacagtangcannannnnnnnnnnnnnnnnnnnnnnnnnnnnnnnnnnnnn

SEQ ID NO: 186113 - DNA, 566 bp, Homo sapiens
  misc_feature: GYAE6OF02F6V2V.30.68.G02.1.454.CMB.1.raw
  modified_base (233)..(233): a, c, t, g, unknown or other
  misc_feature (233)..(233): n is a, c, g, or t
  modified_base (296)..(296): a, c, t, g, unknown or other
  misc_feature (296)..(296): n is a, c, g, or t
  modified_base (344)..(344): a, c, t, g, unknown or other
  misc_feature (344)..(344): n is a, c, g, or t
  modified_base (515)..(515): a, c, t, g, unknown or other
  misc_feature (515)..(515): n is a, c, g, or t
  modified_base (524)..(524): a, c, t, g, unknown or other
  misc_feature (524)..(524): n is a, c, g, or t
  modified_base (527)..(528): a, c, t, g, unknown or other
  misc_feature (527)..(528): n is a, c, g, or t
  modified_base (530)..(530): a, c, t, g, unknown or other
  misc_feature (530)..(530): n is a, c, g, or t
  modified_base (532)..(533): a, c, t, g, unknown or other
  misc_feature (532)..(533): n is a, c, g, or t
  modified_base (537)..(537): a, c, t, g, unknown or other
  misc_feature (537)..(537): n is a, c, g, or t
  modified_base (542)..(551): a, c, t, g, unknown or other
  misc_feature (542)..(551): n is a, c, g, or t
  modified_base (553)..(559): a, c, t, g, unknown or other
  misc_feature (553)..(559): n is a, c, g, or t
  modified_base (561)..(566): a, c, t, g, unknown or other
  misc_feature (561)..(566): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacaccggccgtatacttactgtgccgtctttcaccctgggngtgggattacgaaggcactacttccacacgtggggccgggcaccgtcgtcacgcgtctccctnacgtcctaccgacccgaacgggccccagtccggttacccttcccccgngggaccctaccccgttcccaccgtaaacgacgtcctacccgtcggtacgggggaccacgtacgccgtacgccccggttggggccctcggccgtcggggtaacaacgggtaaccttaccgtttacccacggttacgcggtcgcgtagacggcgggcgtcgggaacagggcgngacgtgcgngcnncngnngatnagtcnnnnnnnnnngnnnnnnncnnnnnn

SEQ ID NO: 186114 - DNA, 725 bp, Homo sapiens
  misc_feature: GYAE6OF02IG59B.30.68.G02.1.454.CMB.1.raw
  modified_base (211)..(211): a, c, t, g, unknown or other
  misc_feature (211)..(211): n is a, c, g, or t
  modified_base (664)..(664): a, c, t, g, unknown or other
  misc_feature (664)..(664): n is a, c, g, or t
  modified_base (684)..(684): a, c, t, g, unknown or other
  misc_feature (684)..(684): n is a, c, g, or t
  modified_base (686)..(686): a, c, t, g, unknown or other
  misc_feature (686)..(686): n is a, c, g, or t
  modified_base (701)..(701): a, c, t, g, unknown or other
  misc_feature (701)..(701): n is a, c, g, or t
  modified_base (703)..(703): a, c, t, g, unknown or other
  misc_feature (703)..(703): n is a, c, g, or t
  modified_base (705)..(705): a, c, t, g, unknown or other
  misc_feature (705)..(705): n is a, c, g, or t
  modified_base (708)..(708): a, c, t, g, unknown or other
  misc_feature (708)..(708): n is a, c, g, or t
  modified_base (717)..(717): a, c, t, g, unknown or other
  misc_feature (717)..(717): n is a, c, g, or t
  modified_base (719)..(720): a, c, t, g, unknown or other
  misc_feature (719)..(720): n is a, c, g, or t
  modified_base (723)..(723): a, c, t, g, unknown or other
  misc_feature (723)..(723): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggcgtatattactgngtcgctttccacctggagtgggtagttacaaggccaattaccgttaccacccgacgttcgggggcccgggggtcgaccccgtcgggtccgtaacggccgttccgttccccgttccgaccggtcccgttccccaacccgaacggggacccccgaacgttccggttcccgtttcccccgttaccgggcctacccccgttcccctaaccccgtaaacgtacgtacccgacccgttccggtacgggggggtaccaaccgtaacggaccgaccggtaccccgtcggggtaccgtcgaccggtttacgggtaccgaaacgggtaaccgttacccgtttaacccggtaaaccggtacgggtccgtttaccggtccggtaggaacccgggttcggggacccgttacggggacccggttaaacgggtacccggacctacgggttaacgtgacgtgacacggngcgcgcagcgacgacgtagngngctcatagcgcgtcncngntcncgacgacgnannagntc

SEQ ID NO: 186115 - DNA, 538 bp, Homo sapiens
  misc_feature: GYAE6OF02G5P2M.30.68.G02.1.454.CMB.1.raw
  modified_base (380)..(380): a, c, t, g, unknown or other
  misc_feature (380)..(380): n is a, c, g, or t
  modified_base (406)..(406): a, c, t, g, unknown or other
  misc_feature (406)..(406): n is a, c, g, or t
  modified_base (505)..(506): a, c, t, g, unknown or other
  misc_feature (505)..(506): n is a, c, g, or t
  modified_base (509)..(538): a, c, t, g, unknown or other
  misc_feature (509)..(538): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacacttgtttcctgcaaatgaaacagcctgagagtcgaggacacggccgtatattactgtgcgtctttccaccctggagtgggagttacaaggcatacttccacacgtcggggccgggcacccgtggtcagcgttcctcctcgacgtccctccaccgaacgggccccagtccggtccttcccccgtggccctacccctctaccgaagacgtcccgaccgttcggnggggacccaacagcctacggccccgngggtccctcggtacccgtgggtaccgaacgggtacctactcccgacgtacggcgtcgagtcggacggcgggtcgtggaccgaagggtcacgagttacgnngcnnnnnnnnnnnnnnnnnnnnnnnnnnnnnn

SEQ ID NO: 186116 - DNA, 620 bp, Homo sapiens
  misc_feature: GYAE6OF02JPZ3A.30.68.G02.1.454.CMB.1.raw
  modified_base (177)..(177): a, c, t, g, unknown or other
  misc_feature (177)..(177): n is a, c, g, or t
  modified_base (508)..(508): a, c, t, g, unknown or other
  misc_feature (508)..(508): n is a, c, g, or t
  modified_base (515)..(515): a, c, t, g, unknown or other
  misc_feature (515)..(515): n is a, c, g, or t
  modified_base (519)..(519): a, c, t, g, unknown or other
  misc_feature (519)..(519): n is a, c, g, or t
  modified_base (524)..(524): a, c, t, g, unknown or other
  misc_feature (524)..(524): n is a, c, g, or t
  modified_base (530)..(531): a, c, t, g, unknown or other
  misc_feature (530)..(531): n is a, c, g, or t
  modified_base (533)..(533): a, c, t, g, unknown or other
  misc_feature (533)..(533): n is a, c, g, or t
  modified_base (535)..(536): a, c, t, g, unknown or other
  misc_feature (535)..(536): n is a, c, g, or t
  modified_base (541)..(541): a, c, t, g, unknown or other
  misc_feature (541)..(541): n is a, c, g, or t
  modified_base (554)..(554): a, c, t, g, unknown or other
  misc_feature (554)..(554): n is a, c, g, or t
  modified_base (562)..(562): a, c, t, g, unknown or other
  misc_feature (562)..(562): n is a, c, g, or t
  modified_base (581)..(581): a, c, t, g, unknown or other
  misc_feature (581)..(581): n is a, c, g, or t
  modified_base (591)..(591): a, c, t, g, unknown or other
  misc_feature (591)..(591): n is a, c, g, or t
  modified_base (616)..(616): a, c, t, g, unknown or other
  misc_feature (616)..(616): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtcaccagggtcactggtatcccagccaggttcagcggcagtgggtcngggacagagttcagtctcaccatcagctacgctcgacagtctaggaacgttatttcgcttagttttaattacgttcggtacaggtcaaccgttaataactaagttcgaccgttaccggtaaactttttcgggaccgttacggggaacctacggtacgtttacgagtacgtaccaaacggtaacgttgtaccggtacgtcgtaccgacctactcgttcggttacttacacgttccctaccgtcacttaccgtacggtacggttaacctcggtactacggttacgaccgggtcggacgttacgggacgtaacggcgcgtaaacgtgtagcgtntcgagtnacgngtacnggtacnncngnngactnactgtgacgtacncgtacgtnacgtagacctagtaaccgngtacgcgtanacgtacgcgacgtacgtacgtacgntacg

SEQ ID NO: 186117 - DNA, 587 bp, Homo sapiens
  misc_feature: GYAE6OF02FYHNN.30.68.G02.1.454.CMB.1.raw
  modified_base (299)..(299): a, c, t, g, unknown or other
  misc_feature (299)..(299): n is a, c, g, or t
  modified_base (333)..(333): a, c, t, g, unknown or other
  misc_feature (333)..(333): n is a, c, g, or t
  modified_base (508)..(508): a, c, t, g, unknown or other
  misc_feature (508)..(508): n is a, c, g, or t
  modified_base (513)..(513): a, c, t, g, unknown or other
  misc_feature (513)..(513): n is a, c, g, or t
  modified_base (521)..(521): a, c, t, g, unknown or other
  misc_feature (521)..(521): n is a, c, g, or t
  modified_base (524)..(524): a, c, t, g, unknown or other
  misc_feature (524)..(524): n is a, c, g, or t
  modified_base (534)..(534): a, c, t, g, unknown or other
  misc_feature (534)..(534): n is a, c, g, or t
  modified_base (539)..(539): a, c, t, g, unknown or other
  misc_feature (539)..(539): n is a, c, g, or t
  modified_base (541)..(541): a, c, t, g, unknown or other
  misc_feature (541)..(541): n is a, c, g, or t
  modified_base (545)..(546): a, c, t, g, unknown or other
  misc_feature (545)..(546): n is a, c, g, or t
  modified_base (550)..(550): a, c, t, g, unknown or other
  misc_feature (550)..(550): n is a, c, g, or t
  modified_base (575)..(575): a, c, t, g, unknown or other
  misc_feature (575)..(575): n is a, c, g, or t
  modified_base (578)..(578): a, c, t, g, unknown or other
  misc_feature (578)..(578): n is a, c, g, or t
  modified_base (584)..(584): a, c, t, g, unknown or other
  misc_feature (584)..(584): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgttctgcaaatgaacagcctgagagtcgaggacaggccgtatattactgttgcgtctttcaccctgagtgggacttacgaaggcataccttccgacacggtcggggccgggccaccgtcggtcagtcgtctcctcgacncctaccaccgacggcccagtccggtcccttcccncggctacccctccctacgaacgacgtccaccgtcgcggggtaccacgacgccgacgtcccgtcgggtacctcggtccgtacggtaccaaacgggtacccttacttaccggaccgtacgtccgggtactacgcggtacgggtacgcggtcggtaaccggtaggccgtagtaacggngtacngcgacgtnacnacgtgcacgngatcncncganncgcntcgcgtcgtacgcgtacgtgcgtcntcnctcgtntac

SEQ ID NO: 186118 - DNA, 515 bp, Homo sapiens
  misc_feature: GYAE6OF02HSQJN.30.68.G02.1.454.CMB.1.raw
  modified_base (290)..(290): a, c, t, g, unknown or other
  misc_feature (290)..(290): n is a, c, g, or t
  modified_base (352)..(352): a, c, t, g, unknown or other
  misc_feature (352)..(352): n is a, c, g, or t
  modified_base (374)..(374): a, c, t, g, unknown or other
  misc_feature (374)..(374): n is a, c, g, or t
  modified_base (385)..(385): a, c, t, g, unknown or other
  misc_feature (385)..(385): n is a, c, g, or t
  modified_base (475)..(475): a, c, t, g, unknown or other
  misc_feature (475)..(475): n is a, c, g, or t
  modified_base (480)..(515): a, c, t, g, unknown or other
  misc_feature (480)..(515): n is a, c, g, or t
tcagcacgctacgtcacgaccggtgctcgatttagtcgatagtgaagggaaagggggctggaatgggtctcaagtattgctggtagtggtgatagcacatactacgcagccatcgtgaagggccggttcaccatctccagggacagttcgaagaacacactgtttctgacaaatgaacagcctgagagtcgaggacacggcgtatattactgtgcgtctttcaccctggagtgggattacaaggcatacttccacacgtggggccgggcaccctggtcagcgtctcctcngtccctccacccgaagggccccaagtccggtccttccccctgaccaccccctctaccaaganccaacctcgtcggggctaacgngtcacgtcccnggggtacctcgccgtggtacaaggtacgttccgttaccacgtaacgcgtcgtctggacggtccgggacttcgggacgaacggcgacttanacggnnnnnnnnnnnnnnnnnnnnnnnnnnnnnnnnnnnn

SEQ ID NO: 186119 - DNA, 609 bp, Homo sapiens
  misc_feature: GYAE6OF02GJZNC.30.68.G02.1.454.CMB.1.raw
  modified_base (142)..(142): a, c, t, g, unknown or other
  misc_feature (142)..(142): n is a, c, g, or t
  modified_base (328)..(328): a, c, t, g, unknown or other
  misc_feature (328)..(328): n is a, c, g, or t
  modified_base (536)..(536): a, c, t, g, unknown or other
  misc_feature (536)..(536): n is a, c, g, or t
  modified_base (549)..(549): a, c, t, g, unknown or other
  misc_feature (549)..(549): n is a, c, g, or t
  modified_base (558)..(558): a, c, t, g, unknown or other
  misc_feature (558)..(558): n is a, c, g, or t
  modified_base (564)..(564): a, c, t, g, unknown or other
  misc_feature (564)..(564): n is a, c, g, or t
  modified_base (569)..(569): a, c, t, g, unknown or other
  misc_feature (569)..(569): n is a, c, g, or t
  modified_base (574)..(574): a, c, t, g, unknown or other
  misc_feature (574)..(574): n is a, c, g, or t
  modified_base (580)..(580): a, c, t, g, unknown or other
  misc_feature (580)..(580): n is a, c, g, or t
  modified_base (583)..(584): a, c, t, g, unknown or other
  misc_feature (583)..(584): n is a, c, g, or t
  modified_base (590)..(590): a, c, t, g, unknown or other
  misc_feature (590)..(590): n is a, c, g, or t
  modified_base (594)..(594): a, c, t, g, unknown or other
  misc_feature (594)..(594): n is a, c, g, or t
  modified_base (599)..(599): a, c, t, g, unknown or other
  misc_feature (599)..(599): n is a, c, g, or t
  modified_base (602)..(602): a, c, t, g, unknown or other
  misc_feature (602)..(602): n is a, c, g, or t
  modified_base (605)..(605): a, c, t, g, unknown or other
  misc_feature (605)..(605): n is a, c, g, or t
tcagcacgctacgtcacgaccggtgctcgatttagtcgatagtgaagggaaaggggctggaatgggtctcaagtattgctggtagtggtgatagcacatactacgcagccatcgtggaacgggccggttcaaaaaaaaaccntctcgagggactagttacgaagaacacacttgtttctgacaaatcgaacacgcctgagagtcgaggacacggctatacttacgtgtcgcgtcctttcacccgtgggtacggtgggacttaacgaaggtcctacttacctccaaccgacggtcgggggccggccaccgtggtcagtccgtctcctcncgcctcaccgtaacgggcccacgtcgtccttaccccgtggacctacccctcctaccgaacgcgtacctaccgttccggtggggaccaacgacgcgacggtacccgtcggtcgtcgtccgtacggtacgaacggtccttaccgtccgacgtacggtaccgtacgtcgtacgggtacggcgggtacgtacgggacgagggtaccgacgtntacgtgcacgctngactacgancgcgcncgacntcgangacacncgnncgtctnacgngacgncgncgngctc

SEQ ID NO: 186120 - DNA, 485 bp, Homo sapiens
  misc_feature: GYAE6OF02F58WO.30.68.G02.1.454.CMB.1.raw
  modified_base (415)..(415): a, c, t, g, unknown or other
  misc_feature (415)..(415): n is a, c, g, or t
  modified_base (451)..(451): a, c, t, g, unknown or other
  misc_feature (451)..(451): n is a, c, g, or t
  modified_base (457)..(485): a, c, t, g, unknown or other
  misc_feature (457)..(485): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgtctttcaccctggagtgggagttacaaggcataccttccaccacgtggggccggggcaccctggtcagcgtctcctcagccctccaccagggcccagtccgtcctcccctggccaccctcctccagcgccacctcgtcggggcacagcacgcccgtggctcgccgtgacaggtcctactccgacgtacgcgtagcgtagnggccggggctcgggacgtaagggccacggtatacgncagtcnnnnnnnnnnnnnnnnnnnnnnnnnnnnn

SEQ ID NO: 186121 - DNA, 566 bp, Homo sapiens
  misc_feature: GYAE6OF02JYW3X.30.68.G02.1.454.CMB.1.raw
  modified_base (394)..(394): a, c, t, g, unknown or other
  misc_feature (394)..(394): n is a, c, g, or t
  modified_base (530)..(530): a, c, t, g, unknown or other
  misc_feature (530)..(530): n is a, c, g, or t
  modified_base (534)..(539): a, c, t, g, unknown or other
  misc_feature (534)..(539): n is a, c, g, or t
  modified_base (541)..(566): a, c, t, g, unknown or other
  misc_feature (541)..(566): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttactgacaaatgaacagcctgagagtcgaggcacggccgtatattactgtgcgtctttcacccgtggagtgggatacaggcatactccacagtcgggcggcacctggcagcgtcctctcgacgccctaccaccgtaacgggcccctaggttcccggtacccttacccccgtggacccctacccccttccgtaccgaaacgcgacccgtaccgttcggacgggggaccaacnccggaccgtaccggtccccggtggggccccgttacgcccggttggtaaccaacggtaaccctccgttaccgaaccgggttgccgtacggctacgggacgggtcggcgttacgggaacacgggccagttaagccgtngacnnnnnngnnnnnnnnnnnnnnnnnnnnnnnnnn

SEQ ID NO: 186122 - DNA, 511 bp, Homo sapiens
  misc_feature: GYAE6OF02G79EW.30.68.G02.1.454.CMB.1.raw
  modified_base (254)..(254): a, c, t, g, unknown or other
  misc_feature (254)..(254): n is a, c, g, or t
  modified_base (463)..(464): a, c, t, g, unknown or other
  misc_feature (463)..(464): n is a, c, g, or t
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
  modified_base (483)..(483): a, c, t, g, unknown or other
  misc_feature (483)..(483): n is a, c, g, or t
  modified_base (486)..(490): a, c, t, g, unknown or other
  misc_feature (486)..(490): n is a, c, g, or t
  modified_base (494)..(494): a, c, t, g, unknown or other
  misc_feature (494)..(494): n is a, c, g, or t
  modified_base (497)..(497): a, c, t, g, unknown or other
  misc_feature (497)..(497): n is a, c, g, or t
  modified_base (499)..(500): a, c, t, g, unknown or other
  misc_feature (499)..(500): n is a, c, g, or t
  modified_base (502)..(503): a, c, t, g, unknown or other
  misc_feature (502)..(503): n is a, c, g, or t
  modified_base (505)..(509): a, c, t, g, unknown or other
  misc_feature (505)..(509): n is a, c, g, or t
  modified_base (511)..(511): a, c, t, g, unknown or other
  misc_feature (511)..(511): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgacaaatgaacagcctgagagtcgaggacacggccgtatattactgtgcgctttcaccgtggagtggagttacaaggcatactccacncgtggggccgggcaccgtggtcagcgtctcctcacgcctcaccgaacgggccccagtccggtccttcccccgtggccctaccctcctaccacgacgccaccgttcgcggggcacgacgcacgccgtgggctcgccgtggtacgaaacggactacttaccgacgtacgcgtcgactgaggccgggtctcggcgaacggcgactacgtagnngcatgcnangctagcgacngannnnnatgntcnanncnncnnnnnan

SEQ ID NO: 186123 - DNA, 645 bp, Homo sapiens
  misc_feature: GYAE6OF02GQ06O.30.68.G02.1.454.CMB.1.raw
  modified_base (245)..(245): a, c, t, g, unknown or other
  misc_feature (245)..(245): n is a, c, g, or t
  modified_base (591)..(591): a, c, t, g, unknown or other
  misc_feature (591)..(591): n is a, c, g, or t
  modified_base (596)..(596): a, c, t, g, unknown or other
  misc_feature (596)..(596): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
  modified_base (608)..(609): a, c, t, g, unknown or other
  misc_feature (608)..(609): n is a, c, g, or t
  modified_base (611)..(613): a, c, t, g, unknown or other
  misc_feature (611)..(613): n is a, c, g, or t
  modified_base (615)..(616): a, c, t, g, unknown or other
  misc_feature (615)..(616): n is a, c, g, or t
  modified_base (619)..(619): a, c, t, g, unknown or other
  misc_feature (619)..(619): n is a, c, g, or t
  modified_base (626)..(626): a, c, t, g, unknown or other
  misc_feature (626)..(626): n is a, c, g, or t
  modified_base (631)..(631): a, c, t, g, unknown or other
  misc_feature (631)..(631): n is a, c, g, or t
  modified_base (633)..(633): a, c, t, g, unknown or other
  misc_feature (633)..(633): n is a, c, g, or t
  modified_base (635)..(636): a, c, t, g, unknown or other
  misc_feature (635)..(636): n is a, c, g, or t
  modified_base (638)..(641): a, c, t, g, unknown or other
  misc_feature (638)..(641): n is a, c, g, or t
  modified_base (643)..(643): a, c, t, g, unknown or other
  misc_feature (643)..(643): n is a, c, g, or t
tcagcacgctacgtcacgaccggtgctcgatttagtcgatagtgaagggaaaggggctggaatgggtctcaagtattgctggtagtggtgatagcacatactacgcagccaatcgtgaagggccggttcaccatctccagggacagttcgaagaacacactgtttctgcaaatgaacagcctgagagtcgagacacggccgtatattactgtgcgctttcacctggagtggaagttaacaacggnaattacttccaaccacgtaggggccgggcctaccgtcggtcaacgtcgtacctccgtctacggaccttccgaaacccgaagggtaccccaacgtaccgggttaccctttcccccgtacggacccgtaaccccttcccttacccgtaaacgacggcctaaccccgtccggtacggggggccaaccgaaaggccgaaacgccccgttcggggtaccgtcggtccgttacgggttacgaaacggtacgtttaacccttaccgtaaccggtaacggtccggttacgggtaccttgggaacggtcggggaccgttacgggacgaacggggtcgtaccgaagttaacgctancgtancagcgtangngnngnnncnncgncgcacgnacagncnannannnnancg

SEQ ID NO: 186124 - DNA, 638 bp, Homo sapiens
  misc_feature: GYAE6OF02I69CS.30.68.G02.1.454.CMB.1.raw
  modified_base (540)..(540): a, c, t, g, unknown or other
  misc_feature (540)..(540): n is a, c, g, or t
  modified_base (556)..(556): a, c, t, g, unknown or other
  misc_feature (556)..(556): n is a, c, g, or t
  modified_base (562)..(562): a, c, t, g, unknown or other
  misc_feature (562)..(562): n is a, c, g, or t
  modified_base (566)..(566): a, c, t, g, unknown or other
  misc_feature (566)..(566): n is a, c, g, or t
  modified_base (574)..(574): a, c, t, g, unknown or other
  misc_feature (574)..(574): n is a, c, g, or t
  modified_base (581)..(581): a, c, t, g, unknown or other
  misc_feature (581)..(581): n is a, c, g, or t
  modified_base (585)..(585): a, c, t, g, unknown or other
  misc_feature (585)..(585): n is a, c, g, or t
  modified_base (592)..(592): a, c, t, g, unknown or other
  misc_feature (592)..(592): n is a, c, g, or t
  modified_base (596)..(596): a, c, t, g, unknown or other
  misc_feature (596)..(596): n is a, c, g, or t
  modified_base (637)..(637): a, c, t, g, unknown or other
  misc_feature (637)..(637): n is a, c, g, or t
tcagcacgctacgtcacgaccggtgctcgatttagtcgatagtgaagggaaaggggcgtggaatgggtctcaagtattgctggtagtggtgatagcacatactacgcagccatcgtgaagggccggttcaccatctccaggacagttcgaagaacactactgtttactgacaatgaacagcctagacgagtcgacggactacgggcctatattactgtgcgtctttacaccgtaggagtacgggacgttaacgaaggcctaatccttccgaacgcggtcggggaccggggcctaaccgttggacacgtcgtacctccgtacacgaccttaccgaacgtaacgggccctaagtttccggtccgttccccgtacggtaccaccccgttcctaccgaacggctaccacccgtttacgggcgggaccttaacgacggaccgaccggtcccgtgggtaacctccggtaccgtggtaaccgaggttacctaccgttaccgcgttagccgttcacgttggaccggccggtcgtagccggtaacggcnccgttaaagcgtacgntacgcncgancgttacgnagtcganacangtacgangcgngacgtacgcgactacacagacgactacgacacacgtcgtana

SEQ ID NO: 186125 - DNA, 643 bp, Homo sapiens
  misc_feature: GYAE6OF02FMPR0.30.68.G02.1.454.CMB.1.raw
  modified_base (376)..(376): a, c, t, g, unknown or other
  misc_feature (376)..(376): n is a, c, g, or t
  modified_base (550)..(550): a, c, t, g, unknown or other
  misc_feature (550)..(550): n is a, c, g, or t
  modified_base (562)..(562): a, c, t, g, unknown or other
  misc_feature (562)..(562): n is a, c, g, or t
  modified_base (569)..(569): a, c, t, g, unknown or other
  misc_feature (569)..(569): n is a, c, g, or t
  modified_base (580)..(580): a, c, t, g, unknown or other
  misc_feature (580)..(580): n is a, c, g, or t
  modified_base (611)..(611): a, c, t, g, unknown or other
  misc_feature (611)..(611): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtcgacggacgacggccgtatattactgtgcgctttccaccgtggaggtgggattacgaaggcataccgtaccaccacggtcggggccggggccacccgtggtcgagcgtcctcctacacgtccctacccacgaacggcccctagtccggttccgttccccgtcgacctaccccgtcctacctaacggacncctacccgttacggtcggggaccaccgacgccgaccgtcccggtcgggctacgtccgtcgggtacgaaccggtacccttacccgtacgtaccgtacggtcgtacgtcgtcgtacggtcgggtcgtacggaccggtaaacgggccgtacgtaagtacgtcgacgtcacgtactanagaccgatacgnacgtacncgtatcgtacncgtcgacgtcacggtcgtacgagtcgtaccncgtacgtacgacgtacgacgtacgtacgtacg

SEQ ID NO: 186126 - DNA, 666 bp, Homo sapiens
  misc_feature: GYAE6OF02GG0PY.30.68.G02.1.454.CMB.1.raw
  modified_base (584)..(584): a, c, t, g, unknown or other
  misc_feature (584)..(584): n is a, c, g, or t
  modified_base (590)..(590): a, c, t, g, unknown or other
  misc_feature (590)..(590): n is a, c, g, or t
  modified_base (597)..(597): a, c, t, g, unknown or other
  misc_feature (597)..(597): n is a, c, g, or t
  modified_base (605)..(605): a, c, t, g, unknown or other
  misc_feature (605)..(605): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
  modified_base (614)..(614): a, c, t, g, unknown or other
  misc_feature (614)..(614): n is a, c, g, or t
  modified_base (616)..(618): a, c, t, g, unknown or other
  misc_feature (616)..(618): n is a, c, g, or t
  modified_base (622)..(622): a, c, t, g, unknown or other
  misc_feature (622)..(622): n is a, c, g, or t
  modified_base (631)..(631): a, c, t, g, unknown or other
  misc_feature (631)..(631): n is a, c, g, or t
  modified_base (635)..(635): a, c, t, g, unknown or other
  misc_feature (635)..(635): n is a, c, g, or t
  modified_base (644)..(644): a, c, t, g, unknown or other
  misc_feature (644)..(644): n is a, c, g, or t
  modified_base (646)..(646): a, c, t, g, unknown or other
  misc_feature (646)..(646): n is a, c, g, or t
  modified_base (652)..(655): a, c, t, g, unknown or other
  misc_feature (652)..(655): n is a, c, g, or t
  modified_base (661)..(661): a, c, t, g, unknown or other
  misc_feature (661)..(661): n is a, c, g, or t
  modified_base (664)..(665): a, c, t, g, unknown or other
  misc_feature (664)..(665): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgccgtccaccagggtcactggtactcccagccaggttcagcgacagtggtctgggacagtagttcacgtcctacaccagtcagtcacgtccgtgctagtacctagtaagttacttttgacgtttagttttaattagttcgtacgtaacgtcctaacttaactaaacgtaacgtttcggtaccggtttaaccccggtttaaacgttttcgggacccccgtaaggggggtaaacccaacggttaccgttaagtacggtaaaccgtttaccgaaaaaccggtaacggtttacggaccggggttactccgtaaccgtaaccggttacttaccggtttcggttacctttacggtaccttcccgttccccgtactacttcggttaacggtaaccgtacggtcgtacggtctaacgggtacgggtccgtacgtagggaccgaacgggtacgtaactaccggtancgaacngacgtcngtatcgancgngngatnannnatgngtacacgtncgancgacgtgtncnactcgnnnngcgctnctnnc

SEQ ID NO: 186127 - DNA, 686 bp, Homo sapiens
  misc_feature: GYAE6OF02JHMCM.30.68.G02.1.454.CMB.1.raw
  modified_base (182)..(182): a, c, t, g, unknown or other
  misc_feature (182)..(182): n is a, c, g, or t
  modified_base (191)..(191): a, c, t, g, unknown or other
  misc_feature (191)..(191): n is a, c, g, or t
  modified_base (233)..(233): a, c, t, g, unknown or other
  misc_feature (233)..(233): n is a, c, g, or t
  modified_base (273)..(273): a, c, t, g, unknown or other
  misc_feature (273)..(273): n is a, c, g, or t
  modified_base (631)..(631): a, c, t, g, unknown or other
  misc_feature (631)..(631): n is a, c, g, or t
  modified_base (642)..(642): a, c, t, g, unknown or other
  misc_feature (642)..(642): n is a, c, g, or t
  modified_base (645)..(648): a, c, t, g, unknown or other
  misc_feature (645)..(648): n is a, c, g, or t
  modified_base (651)..(652): a, c, t, g, unknown or other
  misc_feature (651)..(652): n is a, c, g, or t
  modified_base (661)..(661): a, c, t, g, unknown or other
  misc_feature (661)..(661): n is a, c, g, or t
  modified_base (664)..(664): a, c, t, g, unknown or other
  misc_feature (664)..(664): n is a, c, g, or t
  modified_base (666)..(666): a, c, t, g, unknown or other
  misc_feature (666)..(666): n is a, c, g, or t
  modified_base (672)..(672): a, c, t, g, unknown or other
  misc_feature (672)..(672): n is a, c, g, or t
  modified_base (674)..(674): a, c, t, g, unknown or other
  misc_feature (674)..(674): n is a, c, g, or t
  modified_base (676)..(676): a, c, t, g, unknown or other
  misc_feature (676)..(676): n is a, c, g, or t
  modified_base (678)..(678): a, c, t, g, unknown or other
  misc_feature (678)..(678): n is a, c, g, or t
  modified_base (685)..(685): a, c, t, g, unknown or other
  misc_feature (685)..(685): n is a, c, g, or t
tcagcacgctacgtcacgaccggtgctcgatttagtcgatagtgaagggaaagggggctggaatgggtctcaagtattgctggtagtggtgatagcacatactacgcagccatcgtgaagggccggttcaccatctccagggacagttcgaagaaccacactgtttactgacaaatgaaacngcctgaagngtcgaggacaccggccgtatattacgtgtgccgtctttaccnccgtggacggtgggaacgttacacggctactacttaaccnccgtacggttcgggccgggtaccgtacccgtcgggtccaggtccgtccgttaccctccgaccgtcccgtacccgaacccgaccggacccgtaccgttccggttccccttccccgtcggtccccgtaccccttacccgttaccgaacggtaaccgccgtaaccccgttccgggtccggggtaccaaccgtacggcccgtaacggcccggttacgggtccgtcggttccggttacgggaaccttaacgggttaccttaacccgttcgaccggtttaacggccggttacggcgttacgggtacgggtccgggcggtacgggacgtaccgggtccgacggtaaccgtggagcgtctacgctncgaatcgagcngcnnnncgnntcgcgtcgngcncncgcgcncncngngcgtctng

SEQ ID NO: 186128 - DNA, 520 bp, Homo sapiens
  misc_feature: GYAE6OF02GTTBD.30.68.G02.1.454.CMB.1.raw
  modified_base (485)..(486): a, c, t, g, unknown or other
  misc_feature (485)..(486): n is a, c, g, or t
  modified_base (488)..(488): a, c, t, g, unknown or other
  misc_feature (488)..(488): n is a, c, g, or t
  modified_base (491)..(520): a, c, t, g, unknown or other
  misc_feature (491)..(520): n is a, c, g, or t
tcagcacgctacgtcacgaccggtgctcgatttagtcgatagtgaagggaaagggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgcttttcaccctggagtgggagttacaaggcatactccaccacgtcggggccggggcaccctggtcagccgtctcctcacgcctccacctaaggggccccagtccggtccttcccccgtggccacccctccctccaacgacgccacccgtcgtcgggggccacaggcacgcccgtgggctcggccgtggtccaaaggtacctacttcccgacgttacgccgtagcgtggacggcggggcgtcgggacgaagggccggacagttaagcgtnncngcnnnnnnnnnnnnnnnnnnnnnnnnnnnnnn

SEQ ID NO: 186129 - DNA, 633 bp, Homo sapiens
  misc_feature: GYAE6OF02GHUFJ.30.68.G02.1.454.CMB.1.raw
  modified_base (439)..(439): a, c, t, g, unknown or other
  misc_feature (439)..(439): n is a, c, g, or t
  modified_base (479)..(479): a, c, t, g, unknown or other
  misc_feature (479)..(479): n is a, c, g, or t
  modified_base (531)..(531): a, c, t, g, unknown or other
  misc_feature (531)..(531): n is a, c, g, or t
  modified_base (537)..(537): a, c, t, g, unknown or other
  misc_feature (537)..(537): n is a, c, g, or t
  modified_base (542)..(542): a, c, t, g, unknown or other
  misc_feature (542)..(542): n is a, c, g, or t
  modified_base (555)..(555): a, c, t, g, unknown or other
  misc_feature (555)..(555): n is a, c, g, or t
tcagcacgctacgtcacgaccggtgctcgatttagtcgatagtgaagggaaaggggctggaatgggtctcaagtattgctgtagtggtgatagcacatactacgcagccatcgtgaagggccggttcaccatctccagggacagttcgaagaacacactgttctgcaaatgaacagcctgagagtcgaggacacggcctatacttactgtgcgcttttccgaccctggtagtaggagttacaagtcatacgtccacacgtggggccggtaccacctcggtacacgtcgtccgtcctcacggccttacccacgtaaccgggcctaacgtcggttaccctacccccgttggccgaaccccttcccaccaacggtaccgacctaaccgtccgtagggggccactacgacaccgggtccctagggccctgacccgtcggtaanacgggtaaaccttacgttcccgaacggtacggtacgtcgngttagaccgacggtccgtaggaccgacgggaccgtacgaaccgttggaaccngtacgngcgangacgtctagacgngtcgacgtacgacgctacgtacgtactgtagtagacgacgccgagtagtacacggtacgtggtaacggacgacgtacc

SEQ ID NO: 186130 - DNA, 617 bp, Homo sapiens
  misc_feature: GYAE6OF02JJ3KU.30.68.G02.1.454.CMB.1.raw
  modified_base (180)..(180): a, c, t, g, unknown or other
  misc_feature (180)..(180): n is a, c, g, or t
  modified_base (231)..(231): a, c, t, g, unknown or other
  misc_feature (231)..(231): n is a, c, g, or t
  modified_base (529)..(529): a, c, t, g, unknown or other
  misc_feature (529)..(529): n is a, c, g, or t
  modified_base (557)..(557): a, c, t, g, unknown or other
  misc_feature (557)..(557): n is a, c, g, or t
  modified_base (570)..(570): a, c, t, g, unknown or other
  misc_feature (570)..(570): n is a, c, g, or t
  modified_base (576)..(576): a, c, t, g, unknown or other
  misc_feature (576)..(576): n is a, c, g, or t
  modified_base (582)..(582): a, c, t, g, unknown or other
  misc_feature (582)..(582): n is a, c, g, or t
  modified_base (586)..(586): a, c, t, g, unknown or other
  misc_feature (586)..(586): n is a, c, g, or t
  modified_base (593)..(593): a, c, t, g, unknown or other
  misc_feature (593)..(593): n is a, c, g, or t
  modified_base (614)..(614): a, c, t, g, unknown or other
  misc_feature (614)..(614): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgactgcgtccaccgagggtcactggtactcccagccaggttcagcggcaggtggtntgggacagtagttcagtctcaccatcgagcagtcctgacagtctagaagtnttttgacttagttttattcttgtacagcgtaactactaactagttcggaccgtacggttaacgtttcggaccgtacgggaacctaagtaccgttgtacgtacgtaaccgaaacgtacgtcggtcgtcgtacgtaccaacctacgttacttacggtcttactaccgttccgttacccgtacctacgttaccgttaacgtaaacgtcgtacgtacgtacgtacgggacggtaccgggtcgttacggtacgaacgggtaccgaggttaacgacgtagtccgtagtccgtatacgtgttacncgtagcctgtcagtcagttccgagtcgntgcgtcagcgttnaccgtncgtagngtangtacgtncgtagtcacttggactcggtnacg

SEQ ID NO: 186131 - DNA, 539 bp, Homo sapiens
  misc_feature: GYAE6OF02I4W3Z.30.68.G02.1.454.CMB.1.raw
  modified_base (495)..(495): a, c, t, g, unknown or other
  misc_feature (495)..(495): n is a, c, g, or t
  modified_base (497)..(498): a, c, t, g, unknown or other
  misc_feature (497)..(498): n is a, c, g, or t
  modified_base (500)..(539): a, c, t, g, unknown or other
  misc_feature (500)..(539): n is a, c, g, or t
tcagcacgctacgtcacgaccggtgctcgatttagtcgatagtgaagggaaagggcagagtgttagcagcaacttagcctggtaccagcagaaacctggccaggctcccaggctcctcatctatgatgcgtccaccagggtcactggtatcccagccaggttcagcggcagtgggtctgggacagagttcagtctcaccatcagcagtcctgccagtctagaagtattttgactagttttattattgtcagtcaactataagtaattcggcccttaccgggttaaaattttcgggtacgacgggggtaacctaaaggtcgtttagaagtacttaaccgaaaacggttaacgtggtacggcctagaccaaccctattaccgttgtacctttacacctttccccttccccggtaccattccgttacggaacggttagtccggtgtacccgtaggcgggccgggttcgtacggacgtaacggacggacctagtaacgnanncnnnnnnnnnnnnnnnnnnnnnnnnnnnnnnnnnnnnnnnn

SEQ ID NO: 186132 - DNA, 581 bp, Homo sapiens
  misc_feature: GYAE6OF02GTO6U.30.68.G02.1.454.CMB.1.raw
  modified_base (256)..(256): a, c, t, g, unknown or other
  misc_feature (256)..(256): n is a, c, g, or t
  modified_base (272)..(272): a, c, t, g, unknown or other
  misc_feature (272)..(272): n is a, c, g, or t
  modified_base (536)..(536): a, c, t, g, unknown or other
  misc_feature (536)..(536): n is a, c, g, or t
  modified_base (541)..(542): a, c, t, g, unknown or other
  misc_feature (541)..(542): n is a, c, g, or t
  modified_base (549)..(549): a, c, t, g, unknown or other
  misc_feature (549)..(549): n is a, c, g, or t
  modified_base (551)..(552): a, c, t, g, unknown or other
  misc_feature (551)..(552): n is a, c, g, or t
  modified_base (554)..(558): a, c, t, g, unknown or other
  misc_feature (554)..(558): n is a, c, g, or t
  modified_base (560)..(573): a, c, t, g, unknown or other
  misc_feature (560)..(573): n is a, c, g, or t
  modified_base (575)..(581): a, c, t, g, unknown or other
  misc_feature (575)..(581): n is a, c, g, or t
tcagcacgctacgtcacgaccggtgctcgatttagtcgatagtgaagggaaagggggctggaatgggtctcaagtattgctggtagtggtgatagcacatactacgcagccatcgtgaagggccggttcaccatctccagggacagttcgaagaacacacttgtttctgacaaatgaacagcctgagagtcgaggacacgggccgtatacttaactggtgccgtctttcgaaccctggaggtgggtacgtacaggntaactaccttccaccncgtcggggccggggcacccgtggtcagtccgtctcctcacgcctccaaccgaacggcccgactccggtcccttcccccgtgacccctccccgttccctaccgaacgacctccgtaccccgtcgggtacgggacgaaccagggtacccgaacgtccccggtcggtacgtccgtaccggttaggaccgtaaggtcctaccgttaccgtacgtgcgtcgcgtggaccggcgggacgtcgggaaccgaaggcccggtacaggaacgtnccggnngactggngnngnnnnncnnnnnnnnnnnnnncnnnnnnn

SEQ ID NO: 186133 - DNA, 685 bp, Homo sapiens
  misc_feature: GYAE6OF02G68XO.30.68.G02.1.454.CMB.1.raw
  modified_base (186)..(186): a, c, t, g, unknown or other
  misc_feature (186)..(186): n is a, c, g, or t
  modified_base (210)..(210): a, c, t, g, unknown or other
  misc_feature (210)..(210): n is a, c, g, or t
  modified_base (217)..(217): a, c, t, g, unknown or other
  misc_feature (217)..(217): n is a, c, g, or t
  modified_base (238)..(238): a, c, t, g, unknown or other
  misc_feature (238)..(238): n is a, c, g, or t
  modified_base (543)..(543): a, c, t, g, unknown or other
  misc_feature (543)..(543): n is a, c, g, or t
  modified_base (678)..(678): a, c, t, g, unknown or other
  misc_feature (678)..(678): n is a, c, g, or t
  modified_base (682)..(682): a, c, t, g, unknown or other
  misc_feature (682)..(682): n is a, c, g, or t
tcagcacgctacgtcacgaccggtgctcgatttagtcgatagtgaagggaaagggcagagtgttagcagcaacttagcctggtaccagcagaaacctggccaggctcccgaggcctcctcatctatgatgcctccaccgaggtctctgtactcccagccgtaggttcgagcggcaggtgggtacgnggacagtagttcacgttcacaccntacagcngcctgctgtacgtagaagttntttgacgtttagtttaattcgttgtcaacgactaactaactaactaagttcggaccttaccggttaacgtttcggaccgacgggaccagtcgttagatacgtacaaacgtacgtgtcggactacgccaacgttactcgtacgttcctctaaacctttccccgtacctaccgtaccgttacgtttaaaccggaaccggttacgttcccggtacggtcggttacccgggtaaaccgggtccggggttaccgggttaggggaaaccccggtttacggaacccggtttaaccgaaacgtttcggggtcngtacgtacgtaccacgtacgtacgtacgtacgtacgtactacgtcgcgactactacgagtacgtactagtcgtacgtacagtacctctacgtagtacgtacgagtgttaccgtcctagtccgtaaccgtcggtcncgtntac

SEQ ID NO: 186134 - DNA, 664 bp, Homo sapiens
  misc_feature: GYAE6OF02IJ2WH.30.68.G02.1.454.CMB.1.raw
  modified_base (614)..(614): a, c, t, g, unknown or other
  misc_feature (614)..(614): n is a, c, g, or t
  modified_base (619)..(619): a, c, t, g, unknown or other
  misc_feature (619)..(619): n is a, c, g, or t
  modified_base (624)..(625): a, c, t, g, unknown or other
  misc_feature (624)..(625): n is a, c, g, or t
  modified_base (627)..(629): a, c, t, g, unknown or other
  misc_feature (627)..(629): n is a, c, g, or t
  modified_base (632)..(632): a, c, t, g, unknown or other
  misc_feature (632)..(632): n is a, c, g, or t
  modified_base (634)..(634): a, c, t, g, unknown or other
  misc_feature (634)..(634): n is a, c, g, or t
  modified_base (639)..(640): a, c, t, g, unknown or other
  misc_feature (639)..(640): n is a, c, g, or t
  modified_base (643)..(644): a, c, t, g, unknown or other
  misc_feature (643)..(644): n is a, c, g, or t
  modified_base (646)..(646): a, c, t, g, unknown or other
  misc_feature (646)..(646): n is a, c, g, or t
  modified_base (649)..(649): a, c, t, g, unknown or other
  misc_feature (649)..(649): n is a, c, g, or t
  modified_base (651)..(653): a, c, t, g, unknown or other
  misc_feature (651)..(653): n is a, c, g, or t
  modified_base (655)..(656): a, c, t, g, unknown or other
  misc_feature (655)..(656): n is a, c, g, or t
  modified_base (658)..(663): a, c, t, g, unknown or other
  misc_feature (658)..(663): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaaagaacacacttgtttctgacaaatgaacagcctagaggacgtcggaggaccacgggaccttagtattactggtcgcgtctttcacccgtggtaggtgggtaacgttaacgaaggtctaacgttaccctttacccgaaccgttacgggtccggggggaccccgggtacctacccggttggtccgaacggtccggttcctaccgttccgaccgtcctaacccgacccgaacggggtcccctacgttacccggttcctttcccccggcggtacccctaccccgttccgtaccgaaaggtacgcccctacggtcggggttacggggaccacgacgtaccgaccggtcccgttggggcctaccggtcgtcggtaaagaccgttacctaccggtccgtacgtttacgggcctcggtacgtacgggtacggccggtacgtcgggacgtacggcgaaccgtgtaacgctanccgtncgtcnncnnngcncncgtcnnctnngngcncnnntnngnnnnnnc

SEQ ID NO: 186135 - DNA, 713 bp, Homo sapiens
  misc_feature: GYAE6OF02IV3Q8.30.68.G02.1.454.CMB.1.raw
  modified_base (163)..(163): a, c, t, g, unknown or other
  misc_feature (163)..(163): n is a, c, g, or t
  modified_base (219)..(219): a, c, t, g, unknown or other
  misc_feature (219)..(219): n is a, c, g, or t
  modified_base (328)..(328): a, c, t, g, unknown or other
  misc_feature (328)..(328): n is a, c, g, or t
tcagcacgctacgtcacgaccggtgctcgatttagtcgatagtgaagggaaagggctggaatgggtctcaagtattgctggtagtggtgatagcacatactacgcagcatcgtgaggccgttcaccatctcgaggactagttcgaagaacactacttgtttcncgacaatacgaacacgcctagagagtacgacggactacggtccgttatatttacgngtcgaccttcgtttccgacccgtgggtaggtaggtaaacgttacgaacggacctaacgttaacctcccgtacgacgggtccgggggaccccggccaccgttcggtacgngtccggtcctctcgacgtccaccgtaccgacgtcctacgtaccgttcccttacccggcgaaccctccccgttaccaccgtacgaccgtacgtccccggtacggtacgggccgaaccgtccgaccggtacgtccccgtgggtacccgtcggtaccgttacgtacgtaaccgttacccgtattaccggtaccgtacggtcgttacgtacggtaccgggacggtccggttacggtaacgtaccggagggtaccacggtacgtaacgtcgacgttacgacggtcacgcgcgtacgacgtacgcgtacgacgtcgtacgtcgtacgtacgtcgacgtacgtcgctcgtactacgtacgtacgtacgtaccgtacgtacgtacgtacgtcg

SEQ ID NO: 186136 - DNA, 691 bp, Homo sapiens
  misc_feature: GYAE6OF02GFIUU.30.68.G02.1.454.CMB.1.raw
  modified_base (229)..(229): a, c, t, g, unknown or other
  misc_feature (229)..(229): n is a, c, g, or t
  modified_base (589)..(589): a, c, t, g, unknown or other
  misc_feature (589)..(589): n is a, c, g, or t
  modified_base (604)..(604): a, c, t, g, unknown or other
  misc_feature (604)..(604): n is a, c, g, or t
  modified_base (616)..(616): a, c, t, g, unknown or other
  misc_feature (616)..(616): n is a, c, g, or t
  modified_base (632)..(632): a, c, t, g, unknown or other
  misc_feature (632)..(632): n is a, c, g, or t
  modified_base (680)..(680): a, c, t, g, unknown or other
  misc_feature (680)..(680): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacacttgtttctgcaaatgaacagcctgagagtacgaggacacggccgtattattactgtagcgtctttcaccngggagtggagttacaggtctactacgttaccacgacggttcggggccgggtcctaacccgtggtactacgtccgttcctacttaccgcgacccttaccgaccgacgggtcccctagttcccgggttcccttcccccgtggacccctccccttaccctaaccgaacgtcggaccctaaccggtcggtccggggtaaccacaaaccgggctaacccggtcccggtcgggtcctacggtcccggtaggttaccgaacgggtaacctttaacccggttaccgaacggttaacgtcggtacgtaccgtaggggaccggtccgggtcggtaacggcggtaaaccgggaccgttaccgacggttaanggttccgacgttaanccgtcgatcggnaacgcacgtacgtacnctacgacgacgcgtacgtcgacgctcacacgtatacgtacacgacacncgtagtatacg

SEQ ID NO: 186137 - DNA, 674 bp, Homo sapiens
  misc_feature: GYAE6OF02I2VWI.30.68.G02.1.454.CMB.1.raw
  modified_base (251)..(251): a, c, t, g, unknown or other
  misc_feature (251)..(251): n is a, c, g, or t
  modified_base (573)..(573): a, c, t, g, unknown or other
  misc_feature (573)..(573): n is a, c, g, or t
  modified_base (579)..(579): a, c, t, g, unknown or other
  misc_feature (579)..(579): n is a, c, g, or t
  modified_base (590)..(590): a, c, t, g, unknown or other
  misc_feature (590)..(590): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (622)..(622): a, c, t, g, unknown or other
  misc_feature (622)..(622): n is a, c, g, or t
tcagcacgctacgtcacgaccggtgctcgatttagtcgatagtgaagggaaaggggctggaatgggtctcaagtattgctggtagtggtgatagcacatactacgcagccatcgtgaagggccggttcaccatctccagggacagttcgaagaacacactgtttctgcaaatgaacagcctgagagtacgaggtaccacggccgtatattacgtgtgcgtctttccaccctggagtgggacgttacagganactactccaccacgtggggccgggcctaccgtggtcgacgccgtcctccgtccaccgtcctacccgaaccgtaaccgggacccgtacctcccggttccccttcccccgtcgtaccccgtacccctaccccgtaccgaacggacgacctaccccgtcggtaccggggcaaccgcgaccgtaccggcccgtgggtcctacggccgtttagggtaaccgtaacgggtaacccttaaccgttccgtaacggtacggtacccggtgtaccgttaggggacgggtcgggtaccgtaccgggaaggaacgggtccgcgtaaaagtcggngaccgnacgcgtagacncgtncngcgactacgacgtacgactggcgacngacgtagtcgacgaacgacgtacgtacgacgtacgacgtatactaccgtacg

SEQ ID NO: 186138 - DNA, 166 bp, Homo sapiens
  misc_feature: GYAE6OF01EDWR3.5.14.B03.1.454.CMB.1.raw
  modified_base (166)..(166): a, c, t, g, unknown or other
  misc_feature (166)..(166): n is a, c, g, or t
tcagatcagacacgcacgaccggtgctcgatttagtgtgagtagttccgcgggcacgaccggtgctcgatttagtcacgcgagaaagggaaaggggctggccctgacgtgtttctgttcccgccctcctccgtgtctgatctgagcgggctggcaaggcgcatagn

SEQ ID NO: 186139 - DNA, 167 bp, Homo sapiens
  misc_feature: GYAE6OF02F4TRZ.5.14.B03.1.454.CMB.1.raw
  modified_base (167)..(167): a, c, t, g, unknown or other
  misc_feature (167)..(167): n is a, c, g, or t
tcagatcagacacgcacgaccggtgctcgatttagtgtgagtagttccgcgggcacgaccggtgctcgatttagtcacgcgagaaagggaaagggggctggccctgacgtgtttctgttcccgccctcctccgtgtctgatctgagcgggctggcaaggcgcatagn

SEQ ID NO: 186140 - DNA, 168 bp, Homo sapiens
  misc_feature: GYAE6OF02FP870.5.14.B03.1.454.CMB.1.raw
  modified_base (167)..(168): a, c, t, g, unknown or other
  misc_feature (167)..(168): n is a, c, g, or t
tcagatcagacacgcacgaccggtgctcgatttagtgtgagtagttccgcgggcacgaccggtgctcgatttagtcacgcgagaaagggaaagggggctggccctgacgtgtttctgttcccgccctcctccgtgtctgatctgagcgggctggcaaggcgcatagnn

SEQ ID NO: 186141 - DNA, 123 bp, Homo sapiens
  misc_feature: GYAE6OF01A3LQ4.49.67.G01.1.454.CMB.1.raw
tcagagtcgagagacacgaccggtgctcgatttagagtatacatattgggcacagcggccctgggctgcctggtcaaggactacttcctctctcgactctgagcgggctggcaaggcgcatag

SEQ ID NO: 186142 - DNA, 123 bp, Homo sapiens
  misc_feature: GYAE6OF02JCAVK.49.67.G01.1.454.CMB.1.raw
  modified_base (123)..(123): a, c, t, g, unknown or other
  misc_feature (123)..(123): n is a, c, g, or t
tcagagtcgagagacacgaccggtgctcgatttagagtatacatattggcacagcggccctgggctgcctggtcaaggactacttcctctctcgactctgagcgggctggcaaggcgcatagn

SEQ ID NO: 186143 - DNA, 144 bp, Homo sapiens
  misc_feature: GYAE6OF02FZEFN.49.67.G01.1.454.CMB.1.raw
  modified_base (125)..(144): a, c, t, g, unknown or other
  misc_feature (125)..(144): n is a, c, g, or t
tcagagtcgagagacacgaccggtgctcgatttagagtatacatattgggcgacagcggccctgggctgcctggtcaaggactacttcctctctcgactctgagcgggctggcaaggcgcatagnnnnnnnnnnnnnnnnnnnn

SEQ ID NO: 186144 - DNA, 124 bp, Homo sapiens
  misc_feature: GYAE6OF02FPBDY.49.67.G01.1.454.CMB.1.raw
  modified_base (124)..(124): a, c, t, g, unknown or other
  misc_feature (124)..(124): n is a, c, g, or t
tcagagtcgagagacacgaccggtgctcgatttagagtatacatattgggcacagcggccctgggctgcctggtcaaggactacttcctctctcgactctgagcgggctggcaaggcgcatagn

SEQ ID NO: 186145 - DNA, 124 bp, Homo sapiens; identical to SEQ ID NO: 186144
  misc_feature: GYAE6OF02GXTM1.49.67.G01.1.454.CMB.1.raw
  modified_base (124)..(124): a, c, t, g, unknown or other
  misc_feature (124)..(124): n is a, c, g, or t

SEQ ID NO: 186146 - DNA, 173 bp, Homo sapiens
  misc_feature: GYAE6OF01CKEE8.17.86.H09.1.454.CMB.1.raw
  modified_base (173)..(173): a, c, t, g, unknown or other
  misc_feature (173)..(173): n is a, c, g, or t
tcagcgtagactagcacgaccggtgctcgatttagtgctatagacttgggtttgggggaagaggaagactgacggtcccccaggagttcaggtgctgggcacagcggccctgggctgcctggtcaaggactacttccctagtctacgctgagcgggctggcaaggcgcatagn

SEQ ID NO: 186147 - DNA, 188 bp, Homo sapiens
  misc_feature: GYAE6OF01DC7KP.17.86.H09.1.454.CMB.1.raw
  modified_base (173)..(188): a, c, t, g, unknown or other
  misc_feature (173)..(188): n is a, c, g, or t
tcagcgtagactagcacgaccggtgctcgatttagtgctatagacttgggtttgggggaagaggaagactgacggtcccccaggagttcaggtgctgggcacagcggccctgggctgcctggtcaaggactacttccctagtctacgctgagcgggctggcaaggcgcatagnnnnnnnnnnnnnnnn

SEQ ID NO: 186148 - DNA, 547 bp, Homo sapiens
  misc_feature: GYAE6OF01C7N9E.17.86.H09.1.454.CMB.1.raw
  modified_base (211)..(211): a, c, t, g, unknown or other
  misc_feature (211)..(211): n is a, c, g, or t
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (277)..(277): a, c, t, g, unknown or other
  misc_feature (277)..(277): n is a, c, g, or t
  modified_base (442)..(442): a, c, t, g, unknown or other
  misc_feature (442)..(442): n is a, c, g, or t
tcagcgtagactagcacgaccggtgctcgatttagtgctatagacttgggtttggggggggtctcaggaggcagcgctctcaggacatctccaccatggcctgggctctgctgctcctcaccctcctcactcagggccacagggtcctgggcccagtctgccctgactcagcctgcctccgtgtctgggtctcctggacagtcgatcaccntctcctgcactgtaaccngcagtgacctttagngcttataactatgtctctgtaccaacagcaccnggcaacggtccccaaagccatgatttatgagtcagtaatcggcctcgtagggtttctaatcgtcttctctggtctcaagtctggacaacacggccctccctcaccatctctcgactcacgctgacggacgagctgattattactgctatctactatttagtaagntagtacgtccgttgttcgtttacgtcgggtacggacgggtaaccgaagcgttcggaacccgttccgtcgggtaccacgacccgaacggccgttccgtccccccgg

SEQ ID NO: 186149 - DNA, 733 bp, Homo sapiens
  misc_feature: GYAE6OF01CLV2Q.17.86.H09.1.454.CMB.1.raw
  modified_base (229)..(229): a, c, t, g, unknown or other
  misc_feature (229)..(229): n is a, c, g, or t
tcagcgtagactagcacgaccggtgctcgatttagtgctatagacttgggtttggggggggtctcaggaggcagcgctctcaggacatctccaccatggcctgggctctgctgctcctcaccctcctcactcagggcacgagggtcctgggcccagtctgccctgactcagcctgcctccgtgtctgggtctcctggacagtcgatcaccatctcctgcactgtaaccngctagtcgaccttagtgtcttaataactatcgtctcctggtaaccaacacgaccaccaggaccaaaccgggtaccccaaaagcccaagttacgtaattttacgtaggtacggttactaaaggttaaacgtcccgggtaccccttacggtaacgggggttttacctaaacgttccggtctttcgtccgttacgggtcctaccgtaagttccgtacggaccaaccgcccggtcccttaccctacctacctacttccttaccgtcggaacccttacccgacgtacccgttagggaacggacggacgggttaccttaggtaactttaacttacgtcgactacgttcctacttaagtttacgaacgtactagttacgttcgtttgttacggtttacggtccgggtacgggaacggtaaccgtaaggtccgttacggtaaccccggtttccggtacgggtccctaaaccgggaccccggtaacggtcccgttccccgggttaccccccgg

SEQ ID NO: 186150 - DNA, 651 bp, Homo sapiens
  misc_feature: GYAE6OF01DSITY.17.86.H09.1.454.CMB.1.raw
  modified_base (224)..(224): a, c, t, g, unknown or other
  misc_feature (224)..(224): n is a, c, g, or t
tcagcgtagactagcacgaccggtgctcgatttagtgctatagacttggtttggggggggtctcaggaggcagcgctctcaggacatctccaccatggcctgggctctgctgctctcacctctcactcagggcacagggtcctgggcccagtctcgccctgactcagcctgcctcgtgtctgggtctccgtggacagtcgatcacatctcctgcactgtaaccngcagtcgtaaccttgcgtacttataactatcgtcctccgtacgtaaccaacacgaccaccgacggaccgaaccggtaaccccgaaacgacctacgttagttaatttagtaggtacgtacgtaagttaacgtcccggtacccgttacggtacgggtttactaacgttccgttcttcgtcgtacgtcctacgtacgtcgtacggaccaaccgaccgtccctccctacacctactcctcgtcgacctccacgtcgtaggacggacgtacggtctagttatttactacgtacgtactacttactacttagtttagtaacgtctacgttacgttcgtttggttacgtttacggtcgggtacggtacggtaaccgtagtcgtacgtacgttcggtccggttacggtaccgaccggacccgtcgtcccgtcccg

SEQ ID NO: 186151 - DNA, 591 bp, Homo sapiens
  misc_feature: GYAE6OF01CUN96.17.86.H09.1.454.CMB.1.raw
  modified_base (231)..(231): a, c, t, g, unknown or other
  misc_feature (231)..(231): n is a, c, g, or t
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
  modified_base (275)..(275): a, c, t, g, unknown or other
  misc_feature (275)..(275): n is a, c, g, or t
  modified_base (357)..(357): a, c, t, g, unknown or other
  misc_feature (357)..(357): n is a, c, g, or t
  modified_base (379)..(379): a, c, t, g, unknown or other
  misc_feature (379)..(379): n is a, c, g, or t
  modified_base (453)..(453): a, c, t, g, unknown or other
  misc_feature (453)..(453): n is a, c, g, or t
  modified_base (458)..(458): a, c, t, g, unknown or other
  misc_feature (458)..(458): n is a, c, g, or t
tcagcgtagactagcacgaccggtgctcgatttagtgctatagacttgggtttggggggggtctcaggaggcagcgctctcaggacatctccaccatggcctgggctctgctgctcctcaccctcctcactcagggcacacgggtcctgggcccagtcctgccctgactcagcctgcctccgtgtctgggtctccgtggacagtccgatcaccatctctgcactgtaaccngcagtgtacttagngacttataactatntactcctaggtaccanacgcaccaggacaaggtaccccaaagccatagatttataggagtactagtaatccggcctcgtagggtttctaatcgtcttntctggctcaagtcgtgcaaacncggccctacctcaccactctctcggacctccgacgtccgtaggacggacgaggtacctgtatttacgttaacgngtacnttactctaagttttacgtacgctagtacgttccgttgttacgtttacgtcggacggtaacgggtacaaacggcgttccggaacccgttcgtacggtaccgtacgaacccgaacggtccgtccggtccccccgg

SEQ ID NO: 186152 - DNA, 829 bp, Homo sapiens
  misc_feature: GYAE6OF01EVD5D.17.86.H09.1.454.CMB.1.raw
  modified_base (244)..(244): a, c, t, g, unknown or other
  misc_feature (244)..(244): n is a, c, g, or t
tcagcgtagactagcacgaccggtgctcgattttagtgctatagacttgggggtttggggggggtctccaggaggcagcgctctcaggacatctccgacccatggcctgggctcgtgcctgctcctcaccctcctcacctcgagggccaacagggtcctgggcccagtctgccctgactcacgccctgcctccgtgtctgggtcctcgtggacagtcgatcaccatctcctgccactgtaaccngctaggttcgaccttaggtcgtcgttactaactatcgtcctccgtaggtaacccaacgacgacccaacccgtaggaccaacgggttacccccaaaagtacccgtagttaggttaattttaacgtaggtacgggttcctaaggttaacgttccggccccgtcggtaacggggttttctaacgttccgtctttcgttacgtgggtacccttaccgaacgttccgttaccgggaacctaaaccgtacccgggtacccccttacccctaccgtaccccgtaacttcccgttaccgttaccgggtaacccttacccgtacggttacccgttcgggtaaccgggtacgtaacgggtcctttaacgggtaaccttttaacgttacgttacggtaccttaacgtttccgtttaaccttaacgtttttaccgttaacggttccggtaaccggttaacgggttaccggtacccgttttagggtttacgtttacgggttaccggggtacgggaaccgggttaaccgtacggtccggtacggtacccggttccggtagggtacccaccgggtcccgtaacgggttccctcccccggg

SEQ ID NO: 186153 - DNA, 713 bp, Homo sapiens
  misc_feature: GYAE6OF01BYY5R.17.86.H09.1.454.CMB.1.raw
  modified_base (225)..(225): a, c, t, g, unknown or other
  misc_feature (225)..(225): n is a, c, g, or t
  modified_base (242)..(242): a, c, t, g, unknown or other
  misc_feature (242)..(242): n is a, c, g, or t
tcagcgtagactagcacgaccggtgctcgatttagtgctatagacttgggtttggggggggtctcaggaggcagcgctctcgaggacatctcaccatggcctggctctgctgctcctcacctcctcactcagggcacgacggtcctggcccagtctcgccctgactcagcctgcctcgtgtcgtgggtctcgtgacagtcgatcacatctctgcactagtaaccngctagtcgtaccttagngtacttaactactactcgtacctaccgtacgtaaccaacgacgaccaaccgacggaccgtaaccggtaccgaacgtcctaagttagtacgtttagtacggtaacgtacgtaacgtacgtccggtaccgttacggttacggtttacctacgttccgtacttcgtcgtacgtaccgtacgtacgtccgtacgacctaccgtcccgtccctacctactacctctccgtacgtacgtacctaccgacgtcgtaacggtacggtacgtacgtactacgttaacttacgttacgtagtaccttacttacgttaacgttacgttaacgtaacgtacgttaacggttcggttacgtttaacggttacggttaccgggtaccgggtaacggtaaccggtaaccgtacgtaccggttaccggtacccggttcggtaccgggtaccaccggtacccggtccgtccccgttccccggtccccg

SEQ ID NO: 186154 - DNA, 597 bp, Homo sapiens
  misc_feature: GYAE6OF01C89GJ.17.86.H09.1.454.CMB.1.raw
  modified_base (231)..(231): a, c, t, g, unknown or other
  misc_feature (231)..(231): n is a, c, g, or t
  modified_base (246)..(246): a, c, t, g, unknown or other
  misc_feature (246)..(246): n is a, c, g, or t
tcagcgtagactagcacgaccggtgctcgatttagtgctatagacttgggtttgggggggtctcaggaggcagcgctctcaggacatctccaccatggcctgggctctgctgctcctcaccctcctcactcagggcacagggtcctgggccccagtctgccctgactcagcctgcctccgtgtctgggtcctcctggacagtcgatcaccatcctcctgacactgtaaccngcagtgacctttagncttataactatgtctcctggtaccaacagcaccaggcaacggtaccccaaagcccaatgatttatgaggtacagtaatccggcctcgtagggtttctaatcgtcttctcgtggtctccgaagttcgtggtacaaccacggtccctcccttccacctactcctacgtcggaccttacccgacgacccgttaggacggacggaggtccgtagtactttagtttactgctattctactagttttagtaagtcaagttacgtcgtttgttgtttacgtccggtacggacgggaaccgtaaggcctacggacccgttcgtcgggtcaacgccgaaacggcgtcccgtaccccccgg

SEQ ID NO: 186155 - DNA, 908 bp, Homo sapiens
  misc_feature: GYAE6OF01B9ZX1.17.86.H09.1.454.CMB.1.raw
  modified_base (202)..(202): a, c, t, g, unknown or other
  misc_feature (202)..(202): n is a, c, g, or t
tcagcgtagactagcacgaccggtgctcgatttagtgctatagacttgggtttgggggggggtctcaggaggcagcgctctcaggacatctccacatggcctgggctctgctgctcctcaccctcctcactcagggcacacgggtcctgggcccagtctggccctgactcagcctgcctccgtgtctgggtctccgtggacnggtcgatccacatctcctgccactcgtaacccagcctagtacgtaccttagtcgtacttaataacttaagtcggttccttacccgttacggtaacccgaaactacggaccaaccccgaacggtaccgtaaaccgggttaacccccgaaaaggaccccgtaattaccgggtaatttttaacgtaggtaacggttccgtaaaggttaaaccgttcccgggtaccccgttacggttaacgggggttttaacctaaacgtttccggtcctttccggttcttcgggtaccttaaccgtaaacggttccggttaaccgggaccttaaaacccggcccggtacccccgtttaccccgtaaccccgtaacccttaattcccgtttaccggtaccgggtacccgtaccccgtaaccgcccgtaacgggtaccgggaaaccgggtcgggtaccttaacggttacttttaacgtttaaacgtcggaaccttaacgttccgtttacgttaacttttacgggtaacgtaccgttaacggttaacggttcccgtttagggttttaaccggttaccggttcccggggtaacggggtaacccggggtaaacctacggggttaaaccgttccggggttaaacccggttcccgggtttacgggggtaaccccgtaaacgggtaccccggtaaacgggtccccgttcccggttaaaccccccggg

SEQ ID NO: 186156 - DNA, 662 bp, Homo sapiens
  misc_feature: GYAE6OF01BPI4S.17.86.H09.1.454.CMB.1.raw
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (230)..(230): a, c, t, g, unknown or other
  misc_feature (230)..(230): n is a, c, g, or t
tcagcgtagactagcacgaccggtgctcgatttagtgctatagacttgggtttggggggggtctcaggaggcagcgctctcaggacatctccaccatggcctgggctctgctgctcctcaccctcctcactcagggcacgacgggtcctgggcccagtctgccctgactcacgcctgcctccgtgtctgggtctcctggacagtcgatcacntcncctgcactgtaaccngcagtcgaccttagtgtacttataactatcgtcctccgtcgtaaccaacgacgaccacccgacggacctaaccggtaccccaaacgcctacgtagtatttagtaggtacggtacgtaagtaacgtccggtaccgttacgttacgggtttcctaacgttcgtccttcgttcgtcggtacctaccgtacgtcgtacggaccaaccgacccgtccctccctccacctacttcctcgtacgacctccgacgccgtacggacggtacgacggtcgtacgtaatttagttactgactacttcttacttagtttacgtaacgtcgtagttacgtcgtttgttcgtttacgttcgggacggtacgggaccgtaggtccgttccggtaccggtcccggttcgggtaccgacggacccgtacgggtcccgtcccggcccccg

SEQ ID NO: 186157 - DNA, 802 bp, Homo sapiens
  misc_feature: GYAE6OF01ANQS4.17.86.H09.1.454.CMB.1.raw
  modified_base (250)..(250): a, c, t, g, unknown or other
  misc_feature (250)..(250): n is a, c, g, or t
tcagcgtagactagcacgaccggtgctcgatttagtgctatagacttggggtttgggggggggtctcaggaggcagcgctctcaggacatctccaccatggcctggctctgctgctcctcaccctcctcacctcgacgggcacgtacgggtcctgggcccagtctcgccctgactcagcctcgccgtccgtgtcgtcgggtctccgtgacagtcgatcacctactcctccgtcgacaccgtacgtaaccngtacagttcgtaccttagtctacgttaactaacttgtcgtcctaccgtacgtaaccaagtcgaccacccgacggtaaccgtaacccggtaccccaaaacgtcctagttacgtacttttacggacggtaacgtacgtaacgtaccggtaccggtccccgttacgggttaacggtttacttaacgttccgtcctttacgtacgttaccgtacgtaccggttacgtccgtacggtaacccgtaaccgtacccggtccctaccccgtacgtacctaaccgttccgtaaccggtaccgtaccctcgtaaccggtcgtaacggaccggtacgtacggtccgttaaacgtactttaacggtacctccgtacgttactttacttacgtttaacggttaccgttaagaccgttacggtttacccggtagttttcgtaaccgggtttccgggacggttaaccgggtaacccggtacggtcccggtacggtaccggtttccggtcccggttaacgtacccggtaacccgaacccggtcggtcccgtccccggttaaccccggg

SEQ ID NO: 186158 - DNA, 764 bp, Homo sapiens
  misc_feature: GYAE6OF01BVSL2.17.86.H09.1.454.CMB.1.raw
  modified_base (221)..(221): a, c, t, g, unknown or other
  misc_feature (221)..(221): n is a, c, g, or t
  modified_base (559)..(559): a, c, t, g, unknown or other
  misc_feature (559)..(559): n is a, c, g, or t
  modified_base (574)..(574): a, c, t, g, unknown or other
  misc_feature (574)..(574): n is a, c, g, or t
  modified_base (670)..(670): a, c, t, g, unknown or other
  misc_feature (670)..(670): n is a, c, g, or t
tcagcgtagactagcacgaccggtgctcgatttagtgctatagacttggggtttggggggggtctcgaggaggcagcgctctcaggacatctccaccatggcctgggctctgctcgctcctcaccctcctcactcgacggcacgtcgggtccgtcgggcctggtcctcgcccgtagcctccgcgtccctcgtccctccggtgtcgtcgggtccttaccggnggactcggtcactccacctcttcctctacgacctacgttacgtaaccgagcgttacgtacgttacgtttacggtacttactttaacttaacggtttcgttcgttaccccgtttaccgggtaaccgtaaaccaacgcccggttaccccgaacccggtaaaggtaaccccgaaaccccggttaaccaacggtctaaggtttacgtagttttagacggtaaccggtacttaacggttaaccggtcccgggtaaccgtttggggttaacgttttaaccgctccggtctttaaccgttcgcgtcccttaacggttgccgttaacggacccaacccggttcccncccttaacgctaccncgttcctcgtaccgctacgacgtcgacggagactgtacgtagttactatcgactctcgttcctagttacgtagtacgttaccgttgtttaccgttnttaacggttcggttacggacggtacggacggtagtcccggtacgtccgtacccgtacggtccgtacgaccgtaccgtcgtccgtccccgttccg

SEQ ID NO: 186159 - DNA, 514 bp, Homo sapiens
  misc_feature: GYAE6OF02FQJ7P.17.86.H09.1.454.CMB.1.raw
  modified_base (242)..(242): a, c, t, g, unknown or other
  misc_feature (242)..(242): n is a, c, g, or t
tcagcgtagactagcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactgtaaccagcagtgaccttagngcttataactatgtctcctggtaccaacagcacccaggcaaggtccccaaagccatgatttatgaggtcagtaatcggccctcgaggggtttctaatcgcttctctggctcaagtctggcacacggcctccctcaccatctctggactccagcctgaggacgaggctgattattactgcatctctatttgtaagctagtactccttgtgttattcgggcgtagggacaagctgacccgtcgtcgggtcacgcccgaaggcctcggtcccccg

SEQ ID NO: 186160 - DNA, 560 bp, Homo sapiens
  misc_feature: GYAE6OF02F0H1P.17.86.H09.1.454.CMB.1.raw
  modified_base (244)..(244): a, c, t, g, unknown or other
  misc_feature (244)..(244): n is a, c, g, or t
  modified_base (320)..(320): a, c, t, g, unknown or other
  misc_feature (320)..(320): n is a, c, g, or t
  modified_base (370)..(370): a, c, t, g, unknown or other
  misc_feature (370)..(370): n is a, c, g, or t
  modified_base (393)..(393): a, c, t, g, unknown or other
  misc_feature (393)..(393): n is a, c, g, or t
tcagcgtagactagcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactgtaaccagcagtcgaccttaggngcttaataactatgtctcctggtaccaacagcacccaggcaaggtccccaaagccatgatttatgaggtcagtaancggccctcgagggtttcaagtcgcttctctggctaccaagtctggcaacnccggcctccctcacctatcctcncggtacctccgacgtcctggacggacgtaggcctagatttacttactgtacattctatatttagtaagctagtactccgttgttagttagtcggcggaacgggtaccaaggtccgtacggaccgttcgtcggggtaccacggcccgaaggtccctcggtaccccccg

SEQ ID NO: 186161 - DNA, 781 bp, Homo sapiens
  misc_feature: GYAE6OF02HZU68.17.86.H09.1.454.CMB.1.raw
  modified_base (127)..(127): a, c, t, g, unknown or other
  misc_feature (127)..(127): n is a, c, g, or t
  modified_base (200)..(200): a, c, t, g, unknown or other
  misc_feature (200)..(200): n is a, c, g, or t
  modified_base (280)..(280): a, c, t, g, unknown or other
  misc_feature (280)..(280): n is a, c, g, or t
tcagcgtagactagcacgaccggtgctcgatttagtgctatagacttgggtttggggggggtctcaggaggcagcgctctcaggacatctccaccatggcctgggctctgctgctcctcacctcctnactcagggcacagggtcctgggcccagtctgccctgacctcagcctgccctccgtgtctgggtctcctggacngtcgatcaccatctcctgcactgaaccagcagtgaccttagtcgcttaataacttatacgtcttcctacggtaccaaacncgccacccgtaaggccgaacgggtacccccaaaaggcccaataggtatttaagtggtaaggtacaagttaacgccggtacccgtacggttaggggtttacctaaacgttccgtccgttttaccttccgttcgggtacccgttacccgtaaacgggttccgtacgggtaacccgtaaaacccggtaacccggtcccccgttacccccctacctaacccctaattccccgttacgtcccggtaaccgttcccctaacggtcccgtaggacgggtaacggacggtaccggtattaacgtttaactttaacgcgtaaccgtcttaccttaccgttaagtttacggttaaacgacgtaaggttaccgtacgttttcgtttacgttttacggttccggggacggggtaacgggaacgtaaacggtccgtaaccgggtaacccgttcccgggttagggtacccgtaccggaacccggtaaccgggttccctcccgggtaaccccccgg

SEQ ID NO: 186162 - DNA, 579 bp, Homo sapiens
  misc_feature: GYAE6OF02IMEBZ.17.86.H09.1.454.CMB.1.raw
  modified_base (246)..(246): a, c, t, g, unknown or other
  misc_feature (246)..(246): n is a, c, g, or t
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
  modified_base (406)..(406): a, c, t, g, unknown or other
  misc_feature (406)..(406): n is a, c, g, or t
tcagcgtagactagcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatccaccatctcctgcactgtaaccagcagtgacccttagngcttaataacttatcgtctcctggtaccaacagcacccgaggcaacggtaccccaaagcccaatgtatttactgaggtcaagtaatcggccctgtaggggtttctagtcgtctttcnctgctcaagtcngcacacgcctcctcacatctctcggactccncgcctggacggaacggaggcttagaactttattaacgtcgactattcctattagttttagtaacgcttaagttacgtctttacgttggtttaacgtcgggaacggacggaaccgtaacgcgttacgtaccgtccgttcgggtacaccggaccgtaaggccgtccgtacccccg

SEQ ID NO: 186163 - DNA, 579 bp, Homo sapiens
  misc_feature: GYAE6OF02HP5Z8.17.86.H09.1.454.CMB.1.raw
  modified_base (243)..(243): a, c, t, g, unknown or other
  misc_feature (243)..(243): n is a, c, g, or t
tcagcgtagactagcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactgtaaccagcagtgacctttagngcttataactatgtctcctggtaccaacagccaccaggcaacggtccccaaagccatgatttatgaggtcagtaatcggccctgaggggtttctaatcgtctttctcgtggtctacaagttctgcaacgaccggtcctccctccacctactcctcgtcgacctccagcctgacggacgaggctagtaatttactactcgacaattcctaccttattttagtaacgctaagtacgtctttgtagtttagttcgggcgggtaacgggtaccaaggtccgtacgaacccgttccgttacgggtcaccggtacccgaacgggtccttccggtaccccccg

SEQ ID NO: 186164 - DNA, 560 bp, Homo sapiens
  misc_feature: GYAE6OF02GAX7S.17.86.H09.1.454.CMB.1.raw
  modified_base (242)..(242): a, c, t, g, unknown or other
  misc_feature (242)..(242): n is a, c, g, or t
tcagcgtagactagcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactgtaaccagcagtgaccttagngcttataactatgtctcctggtaccaacagcacccaggcaaggtccccaaagccatgatttatgaggtcagtaatcggccctcgtaggggtttactaatcgtctttctcgtgctccaagtctgcaacacggccctccctcaccatctcgtcggacctccagcctggacggacggaggactgtaattacttactgtcatctactagttttgtaaagctaagtgtcctttggttgtttagttcgggacgggaagggtaccgaagccgtcgacccgttccgtcgggtacgaccgacccgtaacggtcctccgtccccccgg

SEQ ID NO: 186165 - DNA, 605 bp, Homo sapiens
  misc_feature: GYAE6OF02IFS3F.17.86.H09.1.454.CMB.1.raw
  modified_base (242)..(242): a, c, t, g, unknown or other
  misc_feature (242)..(242): n is a, c, g, or t
  modified_base (366)..(366): a, c, t, g, unknown or other
  misc_feature (366)..(366): n is a, c, g, or t
  modified_base (424)..(424): a, c, t, g, unknown or other
  misc_feature (424)..(424): n is a, c, g, or t
tcagcgtagactagcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactgtaaccagcagtgaccttagngcttataactatgtctcctggtaccaacagcaccaggcaaggtccccaaagccatgatttatgagtcagtaatcgcctcgagggtttctaatcgcttctcgtggccttcaaagtctaggcaacncggcctccctacaccatctctggacttccagcctgaggacgaggctgatttatatcgnattctactatttagtaacgcgaagttacgtaccgtttgttacgttttaacgttccggggtacgggtacggggtaaacccctaaagggtccgtaacgggttaaccccggttccggttacgggggtttacccaacggggtaacccccctaaaaggggtcccttaacccggttcccccccccgg

SEQ ID NO: 186166 - DNA, 628 bp, Homo sapiens
  misc_feature: GYAE6OF02F5DRN.17.86.H09.1.454.CMB.1.raw
  modified_base (230)..(230): a, c, t, g, unknown or other
  misc_feature (230)..(230): n is a, c, g, or t
tcagcgtagactagcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactcgtaaccngccagtcgaccttagtgcttataactatgtctcctggtaccaacagccaccgaggcaacggtccccaaagccatgtatttataggaggtacaagtaacgtccggtcctacgtacggggtttctaagtccgtctttctcgtgtctctaagtcgtaggacaaccgaccggtccctccctaccacctactctcgtacggtacctccgacgtccgtaggacggacgacggtctaggttacttacttacgtgactacttctacttagtttacgtaacgtcgtaagttacgtccgtttggttacgtttacggttcgggacgggtacggaaccgtacggtcgtacggttacccggttcggtacgggtccgaccggacccggtaccggtccgtcccgtacccccgg

SEQ ID NO: 186167 - DNA, 692 bp, Homo sapiens
  misc_feature: GYAE6OF02FGCZB.17.86.H09.1.454.CMB.1.raw
  modified_base (195)..(195): a, c, t, g, unknown or other
  misc_feature (195)..(195): n is a, c, g, or t
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
tcagcgtagactagcacgaccggtgctcgatttagtgctatagacttgggtttggggggggtctcaggaggcagcgctctcaggacatctccaccatggcctgggctctgctgctcctcaccctcctcactcgagggcacgagggtcctgggcccagtctcgccctgactcagcctgcctcgtgtctggtctccnggacagtcgatccaccntcnctgcactgaaccngcagtcgaccttagngcttataactatgtctctggtaccacagcaccagcaacggtaccccaaagccatgtactttatgtagtctagtaacgtccggtccccttacgacggggttttactaacgttcgtaccgtttcttccgttcgggtaccttaccgtaacgttaccgtcggtaaccaaaccgtacccgggtaccctcccctaccaaccctaacgtcctccgttacggtaccctacccgaacggtcccttaggaacgggacggtaacggtcgtaggttaactttaacttacgtcgtctaagtccttactagttttacggtaatacgttaacgtacgttccgtttagttacggttaacgtttcggggaccgggtaacggtaaccgtaacggtaccgtaccggtaacccggttccggtaccggtcgaacccggtcccggtaacggtccctccggttaccccccgg

SEQ ID NO: 186168 - DNA, 814 bp, Homo sapiens
  misc_feature: GYAE6OF02F9M9N.17.86.H09.1.454.CMB.1.raw
  modified_base (650)..(650): a, c, t, g, unknown or other
  misc_feature (650)..(650): n is a, c, g, or t
tcagcgtagactagcacgaccggtgctcgatttagtgctatagacttggggtttgggggggggtctcaggaggcagcgctctcaggacatctccaccatggcctgggctctgctgctcctcaccctcctcactcagggcacgagggtcctgggcccagtctgccctgactcagcctgcctcgtgtctgggtcctcctggacagtcgatcacctactcctcctgacctactacgtaaaccgagccgaagttcgtaaccgtttaggtcgtaacctttaataaaaccttagttcgttacctcccggttagggttaaaccccaaacgtacgtacccgaaccccggtaagggaaccctaaaaccggggttaaccccccaaaaacggccctaacgtttacggtaatttttaaacgacgggaaggttaactaaggttaaaaccgtccccggggtacccctttaacgggttaacggggttttaaccttaaaccgttccggttacctttcgttacgtcgggttacctaccgtaaacggttccgacgggtaacaacccggacggttacccctaccctacgtaaccctaactccgtttcgtaaccggtactcccgaagtcggtacggaggacggtcgtacgtagttaacttaattaccgtntaccgtattcctacgttagtttacgaacgtacgtagttcgtaccgtttgggttacgttacgggtcgttaacggggaacggtaaccgtaacgtccggttacgtaacccggttccggtacggttaccggaccgtaacccggtacgtcccggtacccgttcccccgg

SEQ ID NO: 186169 - DNA, 834 bp, Homo sapiens
  misc_feature: GYAE6OF02HMDH8.17.86.H09.1.454.CMB.1.raw
tcagcgtagactagcacgaccggtgctcgatttagtgctatagacttgggtttggggggggtctcaggaggcagcgctctcaggacatctccaccatggcctggctctgctgctcctcacctcctcactcagggcacgacgggtcctgggcccagtctcgccctgactcacgcctgcctcgtgtcgtgggtctccgtggacacgtcgaatcaccatctcctgctactacgtaaccagcagtcgtacctttagcgtacttaaataaccttatgttcctcgtacggtaaccaacgaacgaccaccgaaaggtaccgtaaccggtaaccccaaaagtcccgtaaagttacgttaagtttacgtacggtaaacgtaccgtaaaggttaaacgtccgggtaccccgttaaggttaacgggggttttaacaaacgttccggttactttccggttacgtacggggtacccttaaccgtaaacggtttcctaaccggggaaaccctaaccgtaacccggtccctaccccgttaccgaacccttagttacccgtcggtaacggtacccaccgtacgtacggtaaccggtaagggaaccggtacggtaacgttacggttaaattttaaccgttaaacgtcggtaacctaaggtttaccttacggtttaaatttacggaaacgtaccgttaacgttaaccggtctttagggttacgttaacgggttaccgggaacggtaacgggtaaacccgaacggttcgtaaccggttaccccgggttaacggtccggggtaaccctaaccggtaccccggtaaacggttccgtacccccggttaacccccgg

SEQ ID NO: 186170 - DNA, 402 bp, Homo sapiens
  misc_feature: GYAE6OF02F5JNP.17.86.H09.1.454.CMB.1.raw
  modified_base (180)..(180): a, c, t, g, unknown or other
  misc_feature (180)..(180): n is a, c, g, or t
  modified_base (369)..(369): a, c, t, g, unknown or other
  misc_feature (369)..(369): n is a, c, g, or t
  modified_base (384)..(386): a, c, t, g, unknown or other
  misc_feature (384)..(386): n is a, c, g, or t
  modified_base (388)..(402): a, c, t, g, unknown or other
  misc_feature (388)..(402): n is a, c, g, or t
tcagcgtagactagcacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaccggacaaccgtcgcccggcaacatagccttctccgtcccccttgcagtaacaccaagtacaggaatattaacctgtttcccatcgactacgcctttcggcctcgccttaggggtcactcaccctgccccgtattaacggttggacaggtaccctggtccttcggcgagcgggntggcaggcgcatagnnngnnnnnnnnnnnnnnn

SEQ ID NO: 186171 - DNA, 804 bp, Homo sapiens
  misc_feature: GYAE6OF02GSAX3.17.86.H09.1.454.CMB.1.raw
  modified_base (220)..(220): a, c, t, g, unknown or other
  misc_feature (220)..(220): n is a, c, g, or t
  modified_base (233)..(233): a, c, t, g, unknown or other
  misc_feature (233)..(233): n is a, c, g, or t
  modified_base (249)..(249): a, c, t, g, unknown or other
  misc_feature (249)..(249): n is a, c, g, or t
tcagcgtagactagcacgaccggtgctcgatttagtgctatagacttgggtttgggggggggtctcaggaggcagcgctctcaggacatctccaccatggcctgggctctgctgctcctcaccctcctcactcgagggcacagggtcctgggcccagtctcgccctgactcagcctgcctccgtgtctgggtctccgtggacagtcgatcaccatctccngctactgtaaccngccagtcgaccttagntacttaataactatgtcctccgtacgtaccaacacgaccaaccgacggaccaaacgggtaccccaaacgtccaagtacgtaatttagtaggtacggttactaacgttaacgtcccgggtaccccgttacgggtaacggggttttacttaacgttcgtaccgtttcttccgtacggtacctaccgtaacggttaccgtgggaaccctaaaccggtaccggtccccttacccgtaccctaacccgtaactttcccgttccgttaaccggtaccttacccggtaaccggtacccggttacggggaaacgggtaaccgggtaccgggttaaccgtttacgggttaaaccttttacgtttaaccgtacggtacccttaacggtttccttaaccggtttaagttttacgtaaacggtacgttacgttacggttcccgttttaggtttacggttacggttccggggaccgggtaacggtaaccgtaacgttccggtaccgtacccggttccggtagggtaccgaaccggtacccggaacgttaccgtcccggtacccccggg

SEQ ID NO: 186172 - DNA, 692 bp, Homo sapiens
  misc_feature: GYAE6OF02G9T0Z.17.86.H09.1.454.CMB.1.raw
  modified_base (226)..(226): a, c, t, g, unknown or other
  misc_feature (226)..(226): n is a, c, g, or t
  modified_base (292)..(292): a, c, t, g, unknown or other
  misc_feature (292)..(292): n is a, c, g, or t
  modified_base (352)..(352): a, c, t, g, unknown or other
  misc_feature (352)..(352): n is a, c, g, or t
  modified_base (671)..(671): a, c, t, g, unknown or other
  misc_feature (671)..(671): n is a, c, g, or t
  modified_base (679)..(679): a, c, t, g, unknown or other
  misc_feature (679)..(679): n is a, c, g, or t
tcagcgtagactagcacgaccggtgctcgatttagtgctatagacttgggtttggggggggtctcaggaggcagcgctctcaggcatctccaccatggcctgggctctgctgctcctcacctctcactcgagggtcacagggtcctcgggccctagtcctcgccctgactcgacgtcctgcctccgtgtcgtgggtcctctaggacggtcatcacctatcctcgtnccactagaaccagcctaggtcaacctttgacgtcttaagtaactatgtacctcgtacgtaacaacncgtacaccgaggacgtaaccggtacccaaacggcctaagtacgtatttaagtggtacgtntaacggtaatacccggtccctacgggttacgggtttaacaacgttaccgtctttcgtccgtcggtaccctacgtaacgtgttacggaccaaaccgacccggtacccgtccctaccgtaacctacttccgtacgtacgtacccgtactaccggttcggacggaacggtacccggaggttaaccgtagtttaacgtttattaaaccgtcggtaacctaagtttccctaacgttaacttttacggaacgttacgtaacggttctaccgtttgttagttacgtcgggtaggacggtaactaagcgtagaccgttcgacggtanccgacgcncgttacctcccgg

SEQ ID NO: 186173 - DNA, 290 bp, Homo sapiens
  misc_feature: GYAE6OF01CL4V6.11.75.G09.1.454.CMB.1.raw
  modified_base (286)..(290): a, c, t, g, unknown or other
  misc_feature (286)..(290): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagaatccggttttcggcggagggactaagctgaccgtcctaagtcagcccaaggctgcccctcggtcactctgttcccacctcctcgtatctctcgctgagcgggctggcaaggcgcatagnnnnn

SEQ ID NO: 186174 - DNA, 295 bp, Homo sapiens
  misc_feature: GYAE6OF01CQOAA.11.75.G09.1.454.CMB.1.raw
  modified_base (288)..(295): a, c, t, g, unknown or other
  misc_feature (288)..(295): n is a, c, g, or t
tcagcgagagataccacgaccggtgctcgatttagtatagacatcaggggtccctgaccggttcgtctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctggtcactctgttcccaccctcctcgtatctctcgctgagcgggctggcaaggcgcatagnnnnnnnn

SEQ ID NO: 186175 - DNA, 288 bp, Homo sapiens
  misc_feature: GYAE6OF01ECVFM.11.75.G09.1.454.CMB.1.raw
  modified_base (287)..(288): a, c, t, g, unknown or other
  misc_feature (287)..(288): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttcccgccctctcgtatctctcgctgagcgggctggcaaggcgcatagnn

SEQ ID NO: 186176 - DNA, 291 bp, Homo sapiens
  misc_feature: GYAE6OF01EOH1X.11.75.G09.1.454.CMB.1.raw
  modified_base (288)..(291): a, c, t, g, unknown or other
  misc_feature (288)..(291): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttcccgccctcctcgtatctctcgctgagcgggctggcaaggcgcatagnnnn

SEQ ID NO: 186177 - DNA, 290 bp, Homo sapiens
  misc_feature: GYAE6OF01DDCQ4.11.75.G09.1.454.CMB.1.raw
  modified_base (287)..(290): a, c, t, g, unknown or other
  misc_feature (287)..(290): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgcccctcggtcactctgttcccaccctcctcgtatctctcgctgagcgggctggcaaggcgcatagnnnn

SEQ ID NO: 186178 - DNA, 290 bp, Homo sapiens
  misc_feature: GYAE6OF01AM5T0.11.75.G09.1.454.CMB.1.raw
  modified_base (288)..(290): a, c, t, g, unknown or other
  misc_feature (288)..(290): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttcccaccctcctcgtatctctcgctgagcgggctggcaaggcgcatagnnn

SEQ ID NO: 186179 - DNA, 290 bp, Homo sapiens
  misc_feature: GYAE6OF01B04K8.11.75.G09.1.454.CMB.1.raw
  modified_base (289)..(290): a, c, t, g, unknown or other
  misc_feature (289)..(290): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttccccaccctcctcgtatctctcgctgagcgggctggcaaggcgcatagnn

SEQ ID NO: 186180 - DNA, 290 bp, Homo sapiens
  misc_feature: GYAE6OF01ACSLE.11.75.G09.1.454.CMB.1.raw
  modified_base (288)..(290): a, c, t, g, unknown or other
  misc_feature (288)..(290): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttcccgccctcctcgtatctctcgctgagcgggctggcaaggcgcatagnnn

SEQ ID NO: 186181 - DNA, 295 bp, Homo sapiens
  misc_feature: GYAE6OF01CAH9Y.11.75.G09.1.454.CMB.1.raw
  modified_base (286)..(295): a, c, t, g, unknown or other
  misc_feature (286)..(295): n is a, c, g, or t
tcagcgagagataccacgaccggtgctcgatttagtatagacatcaggggtccctggaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctggtcactctgttcccgcctctcgtatctctcgctgagcgggctggcaaggcgcatagnnnnnnnnnn

SEQ ID NO: 186182 - DNA, 289 bp, Homo sapiens
  misc_feature: GYAE6OF01C1TIZ.11.75.G09.1.454.CMB.1.raw
  modified_base (288)..(289): a, c, t, g, unknown or other
  misc_feature (288)..(289): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttcccgccctcctcgtatctctcgctgagcgggctggcaaggcgcatagnn

SEQ ID NO: 186183 - DNA, 304 bp, Homo sapiens
  misc_feature: GYAE6OF01D6Y6G.11.75.G09.1.454.CMB.1.raw
  modified_base (287)..(304): a, c, t, g, unknown or other
  misc_feature (287)..(304): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgcccctcggtcactctgttcccgccctcctcgtatctctcgctgagcgggctggcaaggcgcatagnnnnnnnnnnnnnnnnnn

SEQ ID NO: 186184 - DNA, 291 bp, Homo sapiens
  misc_feature: GYAE6OF01DOS77.11.75.G09.1.454.CMB.1.raw
  modified_base (287)..(291): a, c, t, g, unknown or other
  misc_feature (287)..(291): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgcccctcggtcactctgttcccaccctcctcgtatctctcgctgagcggctggccaaggcgcatagnnnnn

SEQ ID NO: 186185 - DNA, 289 bp, Homo sapiens
  misc_feature: GYAE6OF01A9DZ6.11.75.G09.1.454.CMB.1.raw
  modified_base (287)..(289): a, c, t, g, unknown or other
  misc_feature (287)..(289): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgcccctcggtcactctgttcccaccctcctcgtatctctcgctgagcgggctggcaaggcgcatagnnn

SEQ ID NO: 186186 - DNA, 287 bp, Homo sapiens
  misc_feature: GYAE6OF01EX3YA.11.75.G09.1.454.CMB.1.raw
  modified_base (284)..(287): a, c, t, g, unknown or other
  misc_feature (284)..(287): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtcagtcctttgacattaaactggatgtggtattcggcggagggacccacgtaaccgtcctaggtcagcccaaggctgccccctggtcactctgttcccaccctcctcgtatctctcgctgagcgggctggcaaggcgcatagnnnn

SEQ ID NO: 186187 - DNA, 295 bp, Homo sapiens
  misc_feature: GYAE6OF01AOQGE.11.75.G09.1.454.CMB.1.raw
  modified_base (290)..(295): a, c, t, g, unknown or other
  misc_feature (290)..(295): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctcgttccccaccctcctcgtatctctcgctgagcgggctggcaaggcgcatagnnnnnn

SEQ ID NO: 186188 - DNA, 326 bp, Homo sapiens
  misc_feature: GYAE6OF01EZPOL.11.75.G09.1.454.CMB.1.raw
  modified_base (286)..(286): a, c, t, g, unknown or other
  misc_feature (286)..(286): n is a, c, g, or t
  modified_base (289)..(326): a, c, t, g, unknown or other
  misc_feature (289)..(326): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctggtcactctgttccccgccctcctcgtactctctcgctgagcggcgtggcgaggcgcanagnnnnnnnnnnnnnnnnnnnnnnnnnnnnnnnnnnnnnn

SEQ ID NO: 186189 - DNA, 300 bp, Homo sapiens
  misc_feature: GYAE6OF01C2WMT.11.75.G09.1.454.CMB.1.raw
  modified_base (290)..(300): a, c, t, g, unknown or other
  misc_feature (290)..(300): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggtttcggcggagggactaagctgaccgtcctaagtcagccaaggctcgcccctggtcactctcgtccccacctcctcgtatctctcgctgcggcggctggacgaaggcgtacagagcnnnnnnnnnnn

SEQ ID NO: 186190 - DNA, 295 bp, Homo sapiens
  misc_feature: GYAE6OF01CJTNY.11.75.G09.1.454.CMB.1.raw
  modified_base (289)..(295): a, c, t, g, unknown or other
  misc_feature (289)..(295): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtctaagtcagcccaaggctcgccccctcggtcactctcgttccccgcctcctcgtatctctcgctgagcgggctggcaaggcgcatagnnnnnnn

SEQ ID NO: 186191 - DNA, 291 bp, Homo sapiens
  misc_feature: GYAE6OF01DMCQ8.11.75.G09.1.454.CMB.1.raw
  modified_base (289)..(291): a, c, t, g, unknown or other
  misc_feature (289)..(291): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctcgccccctcggtcactctcgtcccgccctcctcgtatctctcgctgagcgggctggcaaggcgcatagnnn

SEQ ID NO: 186192 - DNA, 323 bp, Homo sapiens
  misc_feature: GYAE6OF01CPNRB.11.75.G09.1.454.CMB.1.raw
  modified_base (262)..(262): a, c, t, g, unknown or other
  misc_feature (262)..(262): n is a, c, g, or t
  modified_base (268)..(268): a, c, t, g, unknown or other
  misc_feature (268)..(268): n is a, c, g, or t
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
  modified_base (302)..(323): a, c, t, g, unknown or other
  misc_feature (302)..(323): n is a, c, g, or t
tcagcgagagataccacgaccggtgctcgatttagtatagacatcgaggggtccctgaccggttctctggctccaagtctggctcttccgcctcctgccatcactgggctcgaggctgacgatgaggctgattactactgtctgtcctatagaccgacgacctacgacgtacctccggtttcggcggaggacctaagcctagaccggtcctaagccaggccctaagcctcgccccgtgtccactctccgtccaccctccgtntactcnctcgcgtggcgcggctaggccaaggcncgntagnnnnnnnnnnnnnnnnnnnnnn

SEQ ID NO: 186193 - DNA, 357 bp, Homo sapiens
  misc_feature: GYAE6OF01CMOWE.11.75.G09.1.454.CMB.1.raw
  modified_base (314)..(357): a, c, t, g, unknown or other
  misc_feature (314)..(357): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagacttccggtttcggcggtagggactaagctcgaccgtcctaagtcacgcccgaaggctcgccccctggtcactcctcgttccccaccctcctacgtactctccgtcgcttggagtcgggctggacaacggggcacaagtagctgactnnnnnnnnnnnnnnnnnnnnnnnnnnnnnnnnnnnnnnnnnnnn

SEQ ID NO: 186194 - DNA, 290 bp, Homo sapiens
  misc_feature: GYAE6OF02GDOU2.11.75.G09.1.454.CMB.1.raw
  modified_base (285)..(290): a, c, t, g, unknown or other
  misc_feature (285)..(290): n is a, c, g, or t
tcagcgagagataccacgaccggtgctcgatttagtatagacatcagggtccctgaccggttcgtctggctccaagtctggctcttccgcctccttggccatcactgggctcgaggctgacgatgaggctgattactactgtctgtcctatgacgacgacctacagactccggtttcggcggagggactaagctgaccgtcctaagtcagcccaaggctgcccctcggtcactctgttcccacctcctcgtatctctcgctgagcgggctggcaaggcgcatagnnnnnn

SEQ ID NO: 186195 - DNA, 294 bp, Homo sapiens
  misc_feature: GYAE6OF02IE0Z7.11.75.G09.1.454.CMB.1.raw
  modified_base (286)..(294): a, c, t, g, unknown or other
  misc_feature (286)..(294): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgcccctggtcactctgttcccgccctcctcgtatctctcgctgagcgggctggcaaggcgcatagnnnnnnnnn

SEQ ID NO: 186196 - DNA, 338 bp, Homo sapiens
  misc_feature: GYAE6OF02GCMXN.11.75.G09.1.454.CMB.1.raw
  modified_base (293)..(293): a, c, t, g, unknown or other
  misc_feature (293)..(293): n is a, c, g, or t
  modified_base (295)..(299): a, c, t, g, unknown or other
  misc_feature (295)..(299): n is a, c, g, or t
  modified_base (301)..(338): a, c, t, g, unknown or other
  misc_feature (301)..(338): n is a, c, g, or t
tcagcgagagataccacgaccggtgctcgatttagtatagacatcgtagggggtccctgaccggttctctggctccaagtctggctcttccgcctccttggccatcactggctcgaggctgacgatgaggctgattactactgtctgtcctatgacgacgacctacagactccggttttcgcggagggactaagcgtgaccgtccctaagtcacgcccaaggctgcccccgtcggtcgactctgttcccaccctcctcgtatcctctcgctgagcggctggcaagcgcatagncnnnnntnnnnnnnnnnnnnnnnnnnnnnnnnnnnnnnnnnnnnn

SEQ ID NO: 186197 - DNA, 288 bp, Homo sapiens
  misc_feature: GYAE6OF02H1GBX.11.75.G09.1.454.CMB.1.raw
  modified_base (288)..(288): a, c, t, g, unknown or other
  misc_feature (288)..(288): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttcccgccctcctcgtatctctcgctgagcgggctggcaaggcgcatagn

SEQ ID NO: 186198 - DNA, 292 bp, Homo sapiens
  misc_feature: GYAE6OF02GB0VU.11.75.G09.1.454.CMB.1.raw
  modified_base (285)..(292): a, c, t, g, unknown or other
  misc_feature (285)..(292): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattattattgcagctcatatgcaggcagcaccaatttggtgttcggcggagggaccaagctgaccgtcctaggtcagcccaaggctgccccctcggtcactctgttcccgccctcctcgtatctctcgctgagcgggctggcaaggcgcatagnnnnnnnn

SEQ ID NO: 186199 - DNA, 292 bp, Homo sapiens
  misc_feature: GYAE6OF02G6CVS.11.75.G09.1.454.CMB.1.raw
  modified_base (289)..(292): a, c, t, g, unknown or other
  misc_feature (289)..(292): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttcccgccctcctcgtatcctctcgctgagcgggctggcaaggcgcatagnnnn

SEQ ID NO: 186200 - DNA, 293 bp, Homo sapiens
  misc_feature: GYAE6OF02GVQ7J.11.75.G09.1.454.CMB.1.raw
  modified_base (290)..(293): a, c, t, g, unknown or other
  misc_feature (290)..(293): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctcgttccccgccctcctcgtatctctcgctgagcgggctggcaaggcgcatagnnnn

SEQ ID NO: 186201 - DNA, 289 bp, Homo sapiens
  misc_feature: GYAE6OF02HW7TN.11.75.G09.1.454.CMB.1.raw
  modified_base (286)..(289): a, c, t, g, unknown or other
  misc_feature (286)..(289): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgcccctggtcactctgttcccaccctcctcgtatctctcgctgagcgggctggcaaggcgcatagnnnn

SEQ ID NO: 186202 - DNA, 311 bp, Homo sapiens
  misc_feature: GYAE6OF02HZFWO.11.75.G09.1.454.CMB.1.raw
  modified_base (245)..(245): a, c, t, g, unknown or other
  misc_feature (245)..(245): n is a, c, g, or t
  modified_base (285)..(285): a, c, t, g, unknown or other
  misc_feature (285)..(285): n is a, c, g, or t
  modified_base (292)..(311): a, c, t, g, unknown or other
  misc_feature (292)..(311): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtctaagtcagcccaaggctcgcccctcggtcactctcgttccccnccctctcgtatcctctcgctgaggcgggctggccaaggcnccatagnnnnnnnnnnnnnnnnnnnn

SEQ ID NO: 186203 - DNA, 311 bp, Homo sapiens
  misc_feature: GYAE6OF02I3C8B.11.75.G09.1.454.CMB.1.raw
  modified_base (288)..(311): a, c, t, g, unknown or other
  misc_feature (288)..(311): n is a, c, g, or t
tcagcgagagataccacgaccggtgctcgatttagtatagacatcagggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctcgcccctcgtcactctcgtccccaccctcctcgtatctctcgctgagcggctggcaaggcgcatagnnnnnnnnnnnnnnnnnnnnnnnn

SEQ ID NO: 186204 - DNA, 293 bp, Homo sapiens
  misc_feature: GYAE6OF02HLTZS.11.75.G09.1.454.CMB.1.raw
  modified_base (289)..(293): a, c, t, g, unknown or other
  misc_feature (289)..(293): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagacttccggtttcggcggagggactaagctgaccgtctaagtcagcccaaggctgccccctcggtcactctcgttcccaccctcctcgtactctctcgctgagcgggctggcaaggcgcatagnnnnn

SEQ ID NO: 186205 - DNA, 306 bp, Homo sapiens
  misc_feature: GYAE6OF02FWGRY.11.75.G09.1.454.CMB.1.raw
  modified_base (274)..(274): a, c, t, g, unknown or other
  misc_feature (274)..(274): n is a, c, g, or t
  modified_base (290)..(290): a, c, t, g, unknown or other
  misc_feature (290)..(290): n is a, c, g, or t
  modified_base (296)..(306): a, c, t, g, unknown or other
  misc_feature (296)..(306): n is a, c, g, or t
tcagcgagagataccacgaccggtgctcgatttagtatagacatcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggcctgcccccctcggtcactcctcgttccccaccctcctcgtactctctcgcttgancggggctggcaaggcncatagnnnnnnnnnnn

SEQ ID NO: 186206 - DNA, 298 bp, Homo sapiens
  misc_feature: GYAE6OF02IQ4SR.11.75.G09.1.454.CMB.1.raw
  modified_base (163)..(163): a, c, t, g, unknown or other
  misc_feature (163)..(163): n is a, c, g, or t
  modified_base (289)..(298): a, c, t, g, unknown or other
  misc_feature (289)..(298): n is a, c, g, or t
tcagcgagagataccacgaccggtgctcgatttagtatagacatcaggggtccctgaccggttctctggctcaagtctggctcttccgcctccttggccatcactgggctcgaggctgacgatgaggctgattactactgtctgtcctatgacgacgacctanagactccggtttcggcggagggactaagctgaccgtcctaagtcagcccaaggctcgcccctggtcactctcgttcccgtccctcctcgtatcctctcgctggagcgggctggcaaggcgcatagnnnnnnnnnn

SEQ ID NO: 186207 - DNA, 768 bp, Homo sapiens
  misc_feature: GYAE6OF02GM9VT.11.75.G09.1.454.CMB.1.raw
  modified_base (330)..(330): a, c, t, g, unknown or other
  misc_feature (330)..(330): n is a, c, g, or t
tcagcgagagataccacgaccggtgctcgatttagtatagacatcaggggtccctgaccggttctctggctccaagtctggcacctcagcctcctggccatcagtgggctccagtctgatgatgaggctgattattactgtgcagcagtggatgacacctgaactcggtacttgtgtggtttcggcggacggacagctagaccgtcgtaggtacacgtaccgaacggtccgtccgacccctacggtacacgtcgtacgtcccgacccttcgtacgtactctcgtacgtacttaggacgcggactacgacgtaacggcgtacaagtagtcntacgctagactgacgtagacgtccgataccggtacaggttacaaccggattccggacggattacggtaggtaacacggtctacggtaggaacgttacaggggtttaaccacgggtaattccggaaacgtggttactaaccggttagaacccttcgggggtaaaaccgttcgtaaaccggtcgtaacgtaaaccgtttacgggtaaaccgtaacgtaaacgtaacgtacggttttaaaccgtaccgttaaacggttaacggttaaacccggttaccgttaaacggttacgtacccgggttaagtaacccggttaaaccggtacgtttaaccgggtaaccggtaaacgggttaaccccgtaaccggtaacggtttaaccggttaacggttaccgtaaaccgggttaaaccggttacgtacggggttttaaaacccggacg

SEQ ID NO: 186208 - DNA, 354 bp, Homo sapiens
  misc_feature: GYAE6OF01E15SJ.49.8.A08.1.454.CMB.1.raw
  modified_base (342)..(354): a, c, t, g, unknown or other
  misc_feature (342)..(354): n is a, c, g, or t
tcagagtcgagagacacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctccgtcagcctccaccaagggcccatcggtcttccccctggcgccctgctccaggagcacctctgggggcacagcggccctgggctgcctggtcaaggctactccagtactctatctgagcggctggcaaggcgacatagnnnnnnnnnnnnn

SEQ ID NO: 186209 - DNA, 361 bp, Homo sapiens
  misc_feature: GYAE6OF01B992H.49.8.A08.1.454.CMB.1.raw
  modified_base (350)..(361): a, c, t, g, unknown or other
  misc_feature (350)..(361): n is a, c, g, or t
tcagagtcgagagacacgaccggtgctcgatttagcatactctacgagggacaacgccaagaactcactgtatctgcaaatgaacagcctgagagccgaggacacggccgtatattactgtgcgagagttatccctcacggtgacaatcgctattctacgacggtatggacgtctggggccaagggaccacggtcgccgtctccgtcagcctccaccaagggcccatcggtcttcccctggcgccctgctccaggagcacctcgtgggggcacgagcggccctgggctgcctggtcaaggactaacgttccagtactcgtatctgaagcgggctggcaaggcgacatagnnnnnnnnnnnn

SEQ ID NO: 186210 - DNA, 294 bp, Homo sapiens
  misc_feature: GYAE6OF01EEGWN.49.8.A08.1.454.CMB.1.raw
  modified_base (288)..(294): a, c, t, g, unknown or other
  misc_feature (288)..(294): n is a, c, g, or t
tcagagtcgagagacacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtcttccccctggccgccctcctctctctcgactctgagcgggctggcaaggcgcatagnnnnnnn

SEQ ID NO: 186211 - DNA, 348 bp, Homo sapiens
  misc_feature: GYAE6OF01CR6VM.49.8.A08.1.454.CMB.1.raw
  modified_base (241)..(241): a, c, t, g, unknown or other
  misc_feature (241)..(241): n is a, c, g, or t
  modified_base (340)..(348): a, c, t, g, unknown or other
  misc_feature (340)..(348): n is a, c, g, or t
tcagagtcgagagacacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtctcccctggcnccctgctccaggagcacctctgggggcacgagcggcctgggctgcctggtcaaggattactccagtactctatctgagcgggctggcaaggcgcatagnnnnnnnnn

SEQ ID NO: 186212 - DNA, 342 bp, Homo sapiens
  misc_feature: GYAE6OF01A4KB2.49.8.A08.1.454.CMB.1.raw
  modified_base (340)..(342): a, c, t, g, unknown or other
  misc_feature (340)..(342): n is a, c, g, or t
tcagagtcgagagacacgaccggtgctcgatttagcatactctacagggacaacgccaagaactcactgtatctgcaaatgaacagcctgagagccgaggacacggccgtatattactgtgcgagagttatccctcacggtgacaatcgctattctacgacggtatggacgtctggggccaagggaccacggtcgccgtctcctcagcctccaccaagggcccatcggtcttcccctggcgccctgctccaggagcacctctgggggcacagcggccctgggctgcctggtcaaggctacttccagtactctatctgagcgggctggcaaggcgcatagnnn

SEQ ID NO: 186213 - DNA, 344 bp, Homo sapiens
  misc_feature: GYAE6OF01BZ8R3.49.8.A08.1.454.CMB.1.raw
  modified_base (341)..(344): a, c, t, g, unknown or other
  misc_feature (341)..(344): n is a, c, g, or t
tcagagtcgagagacacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtcttccccctggcgccctgctccaggagcacctctgggggcacagcggccctgggctgcctggtcaaggctactccagtactctatctgagcgggctggcaaggcgcatagnnnn

SEQ ID NO: 186214 - DNA, 291 bp, Homo sapiens
  misc_feature: GYAE6OF01D1JZS.49.8.A08.1.454.CMB.1.raw
  modified_base (289)..(291): a, c, t, g, unknown or other
  misc_feature (289)..(291): n is a, c, g, or t
tcagagtcgagagacacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatccggtcttccccctggccgccctcctctctctcgactctgagcgggctggcaaggcgcatagnnn

SEQ ID NO: 186215 - DNA, 345 bp, Homo sapiens
  misc_feature: GYAE6OF01DZ1TV.49.8.A08.1.454.CMB.1.raw
  modified_base (342)..(345): a, c, t, g, unknown or other
  misc_feature (342)..(345): n is a, c, g, or t
tcagagtcgagagacacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtcttcccctggcgccctgctccaggagcacctctgggggcacagcggccctgggctgcctggtcaaggactacttccagtactctatctgagcgggctggcaaggcgcatagnnnn

SEQ ID NO: 186216 - DNA, 287 bp, Homo sapiens
  misc_feature: GYAE6OF01DEMYN.49.8.A08.1.454.CMB.1.raw
  modified_base (287)..(287): a, c, t, g, unknown or other
  misc_feature (287)..(287): n is a, c, g, or t
tcagagtcgagagacacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtcttccccctggcgccctcctctctctcgactctgagcgggctggcaaggcgcatagn

SEQ ID NO: 186217 - DNA, 494 bp, Homo sapiens
  misc_feature: GYAE6OF01BE3EV.49.8.A08.1.454.CMB.1.raw
  modified_base (426)..(427): a, c, t, g, unknown or other
  misc_feature (426)..(427): n is a, c, g, or t
  modified_base (431)..(431): a, c, t, g, unknown or other
  misc_feature (431)..(431): n is a, c, g, or t
  modified_base (434)..(435): a, c, t, g, unknown or other
  misc_feature (434)..(435): n is a, c, g, or t
  modified_base (438)..(446): a, c, t, g, unknown or other
  misc_feature (438)..(446): n is a, c, g, or t
  modified_base (448)..(492): a, c, t, g, unknown or other
  misc_feature (448)..(492): n is a, c, g, or t
  modified_base (494)..(494): a, c, t, g, unknown or other
  misc_feature (494)..(494): n is a, c, g, or t
tcagagtcgagagacacgaccggtgctcgatttagcatactctacaggggacaacgccaagaactcactgtatctgcaaaatgaacagcctgagagccgaggacacggccgtatattactgtgcgagagtttatccctcacggtgacaatcgctatttctacgacggtatgggacgtctgggggccaaaggggccacgggtcgccgtctcctcagccctccaccgaacggggccccatccggtccttccccccgtgggcccgcccctgcctcccgagggtacgcctacctcgtgggggggccaccgacggccggccccgtggggctcggccctgggtccaaacgggacctaccttccgaagtaccgtctaagttcctaggacggccgggggcttggggaccgaaacgggtcggaccagttaagcanngcangcnncgnnnnnnnnncnnnnnnnnnnnnnnnnnnnnnnnnnnnnnnnnnnnnnnnnnnnnngn

SEQ ID NO: 186218 - DNA, 364 bp, Homo sapiens
  misc_feature: GYAE6OF01CI5AG.49.8.A08.1.454.CMB.1.raw
  modified_base (349)..(364): a, c, t, g, unknown or other
  misc_feature (349)..(364): n is a, c, g, or t
tcagagtcgagagacacgaccggtgctcgatttagcatactctacagggacaacgccaagaactcactgtatctgcaaatgaacagcctgagagccgaggacacggccgtatattactgtgcgagagttatccctcacggtgacaatcgctattctacgacggtatggacgtctggggccaagggccacggtcgccgtctcctcagcctccaccaagggcccatcggtcttcccctggccgccctgctccaggagccacctcgtcgggggcacgagccggccctggggctcgcctggtcaaggactactccagtactctatctgagcgggctggcaaggcgacagtagnnnnnnnnnnnnnnnn

SEQ ID NO: 186219 - DNA, 347 bp, Homo sapiens
  misc_feature: GYAE6OF01DYJFA.49.8.A08.1.454.CMB.1.raw
  modified_base (340)..(340): a, c, t, g, unknown or other
  misc_feature (340)..(340): n is a, c, g, or t
  modified_base (343)..(347): a, c, t, g, unknown or other
  misc_feature (343)..(347): n is a, c, g, or t
tcagagtcgagagacacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaaggcccatccggtctcccctggcgccctgctccaggagcacctcgtggggcacgagccggcccgtgggcctgcctggtcaaggactacttccagtactctatctgagcggctggcaggcgcanagnnnnn

SEQ ID NO: 186220 - DNA, 349 bp, Homo sapiens
  misc_feature: GYAE6OF01AM1ZD.49.8.A08.1.454.CMB.1.raw
  modified_base (341)..(349): a, c, t, g, unknown or other
  misc_feature (341)..(349): n is a, c, g, or t
tcagagtcgagagacacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaaggcccatcggtcttcccctgcgccctgctccaggagcacctcgtcgggggcacgagccggccctgggctgcctggtcaagactacttccagtactctatctgagcggctggcaggcgcatagnnnnnnnnn

SEQ ID NO: 186221 - DNA, 368 bp, Homo sapiens
  misc_feature: GYAE6OF01CIDQ1.49.8.A08.1.454.CMB.1.raw
  modified_base (252)..(252): a, c, t, g, unknown or other
  misc_feature (252)..(252): n is a, c, g, or t
  modified_base (342)..(342): a, c, t, g, unknown or other
  misc_feature (342)..(342): n is a, c, g, or t
  modified_base (352)..(352): a, c, t, g, unknown or other
  misc_feature (352)..(352): n is a, c, g, or t
  modified_base (358)..(368): a, c, t, g, unknown or other
  misc_feature (358)..(368): n is a, c, g, or t
tcagagtcgagagacacgaccggtgctcgatttagcatactctacagggacaacgccaagaactcactgtatctgcaaatgaacagcctgagagccgaggacacggccgtatattactgtgcgagagttactccctcacggtgacaatcgctatttctacgacggtatggacgtcgtggggccaagggaccacggtcgccgtctccgtcagcctccaccgaagggccccatccggtccttcccccgtggccnccctgcctccgaggagccaccgtcgtgggggcacgagtccggccgtggctgcctggcaaggtctactccagtactctatcgtgaggcggntggcaaggcncaatgnnnnnnnnnnn

SEQ ID NO: 186222 - DNA, 444 bp, Homo sapiens
  misc_feature: GYAE6OF01C39BU.49.8.A08.1.454.CMB.1.raw
  modified_base (433)..(444): a, c, t, g, unknown or other
  misc_feature (433)..(444): n is a, c, g, or t
tcagagtcgagagacacgaccggtgctcgatttagcatactctacagggacaacgccaagaactcactgtatctgcaaatgaacagcctgagagccgaggacacggccgtatattactgtgcgagagttatcccctcacggtgacaatcgctatttctacgacggtatggacgtcgtggggccaagggaccacggtcgcccgtctcctcacgccctccaccgaacgggccccagttccggtcccttccccccgtgggcccgtccccgttgccctcccgaagggacgcccgaaccgtccggtcggggggaccaccgaggcccggtcccgtcggggcctcggcccgtgggtaccaaacgggtaccttacctttccaacggttacctcttaactcgtcggacggccgggtcgtagggacgacggccgtacagtagnnnnnnnnnnnn

SEQ ID NO: 186223 - DNA, 496 bp, Homo sapiens
  misc_feature: GYAE6OF01CBAYR.49.8.A08.1.454.CMB.1.raw
  modified_base (119)..(119): a, c, t, g, unknown or other
  misc_feature (119)..(119): n is a, c, g, or t
  modified_base (270)..(270): a, c, t, g, unknown or other
  misc_feature (270)..(270): n is a, c, g, or t
  modified_base (396)..(396): a, c, t, g, unknown or other
  misc_feature (396)..(396): n is a, c, g, or t
  modified_base (418)..(418): a, c, t, g, unknown or other
  misc_feature (418)..(418): n is a, c, g, or t
  modified_base (428)..(428): a, c, t, g, unknown or other
  misc_feature (428)..(428): n is a, c, g, or t
  modified_base (430)..(431): a, c, t, g, unknown or other
  misc_feature (430)..(431): n is a, c, g, or t
  modified_base (435)..(435): a, c, t, g, unknown or other
  misc_feature (435)..(435): n is a, c, g, or t
  modified_base (438)..(439): a, c, t, g, unknown or other
  misc_feature (438)..(439): n is a, c, g, or t
  modified_base (441)..(442): a, c, t, g, unknown or other
  misc_feature (441)..(442): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
  modified_base (449)..(450): a, c, t, g, unknown or other
  misc_feature (449)..(450): n is a, c, g, or t
  modified_base (452)..(452): a, c, t, g, unknown or other
  misc_feature (452)..(452): n is a, c, g, or t
  modified_base (455)..(471): a, c, t, g, unknown or other
  misc_feature (455)..(471): n is a, c, g, or t
  modified_base (473)..(496): a, c, t, g, unknown or other
  misc_feature (473)..(496): n is a, c, g, or t
tcagagtcgagagacacgaccggtgctcgattttagcatactctacaggggacaacgccaagaactcactgtatctgcaaatgaacaggcctgagagccgaggcacggcctatattacngtgcgaagacgttatccctcgacggttgacaatccgacttatttcacgaacggtatggacgtcgtcggggccaagggaccacgggtcgcccgttctcctcacggccctaccaaccgaacggggccccaagttccgggtccctttcccccgngggtcccgcccttgcctccggaagggactcctaccgtcggtggggggaccacggacggccggtccgtcgggtctcggaccgttcgggtacaacggacctaccgttccgagtcctctactcgacggnggccggcgtaggaccgaggccncacgtaggcncnncgancgnngnngngnacnncncgnnnnnnnnnnnnnnnnngnnnnnnnnnnnnnnnnnnnnnnnn

SEQ ID NO: 186224 - DNA, 289 bp, Homo sapiens
  misc_feature: GYAE6OF02HGQA0.49.8.A08.1.454.CMB.1.raw
  modified_base (287)..(289): a, c, t, g, unknown or other
  misc_feature (287)..(289): n is a, c, g, or t
tcagagtcgagagacacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtcttccccctggcgccctcctctctctcgactctgagcgggctggcaaggcgcatagnnn

SEQ ID NO: 186225 - DNA, 291 bp, Homo sapiens
  misc_feature: GYAE6OF02FE9OT.49.8.A08.1.454.CMB.1.raw
  modified_base (288)..(291): a, c, t, g, unknown or other
  misc_feature (288)..(291): n is a, c, g, or t
tcagagtcgagagacacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggccccatcggtcttccccctggcgccctcctctctctcgactctgagcgggctggcaaggcgcatagnnnn

SEQ ID NO: 186226 - DNA, 349 bp, Homo sapiens
  misc_feature: GYAE6OF02GZS9K.49.8.A08.1.454.CMB.1.raw
  modified_base (343)..(349): a, c, t, g, unknown or other
  misc_feature (343)..(349): n is a, c, g, or t
tcagagtcgagagacacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtcttccccctggcgccctgctccaggagcacctctgggggcacagcggccctgggctgcctggtcaaggactacttccagtactctatctgagcgggctggcaaggcgcatagnnnnnnn

SEQ ID NO: 186227 - DNA, 292 bp, Homo sapiens
  misc_feature: GYAE6OF02GPX38.49.8.A08.1.454.CMB.1.raw
  modified_base (287)..(292): a, c, t, g, unknown or other
  misc_feature (287)..(292): n is a, c, g, or t
tcagagtcgagagacacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtcttccccctggcaccctcctctctctcgactctgagcgggctggcaaggcgcatagnnnnnn

SEQ ID NO: 186228 - DNA, 348 bp, Homo sapiens
  misc_feature: GYAE6OF02G3MR7.49.8.A08.1.454.CMB.1.raw
  modified_base (344)..(348): a, c, t, g, unknown or other
  misc_feature (344)..(348): n is a, c, g, or t
tcagagtcgagagacacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtcttccccctggcgccctgctccaggagcacctctggggggcacagcggccctgggctgcctggtcaaggactacttccagtactctatctgagcgggctggcaaggcgcatagnnnnn

SEQ ID NO: 186229 - DNA, 346 bp, Homo sapiens
  misc_feature: GYAE6OF02IXI0P.49.8.A08.1.454.CMB.1.raw
  modified_base (339)..(346): a, c, t, g, unknown or other
  misc_feature (339)..(346): n is a, c, g, or t
tcagagtcgagagacacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtcttcccctggcgccctgctccaggagcacctctgggggcacagcggccctggctgcctggtcaaggactactccagtactctatctgagcgggctggcaggcgcatagnnnnnnnn

SEQ ID NO: 186230 - DNA, 351 bp, Homo sapiens
  misc_feature: GYAE6OF02F0QPM.49.8.A08.1.454.CMB.1.raw
  modified_base (342)..(351): a, c, t, g, unknown or other
  misc_feature (342)..(351): n is a, c, g, or t
tcagagtcgagagacacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtcttccccctggcgccctgctccaggagcacctctgggggcacagcggccctgggctgcctggtcaaggactactccagtactctatctgagcgggctggcaaggcgcatagnnnnnnnnnn

SEQ ID NO: 186231 - DNA, 430 bp, Homo sapiens
  misc_feature: GYAE6OF02FX7BY.49.8.A08.1.454.CMB.1.raw
  modified_base (246)..(246): a, c, t, g, unknown or other
  misc_feature (246)..(246): n is a, c, g, or t
  modified_base (261)..(261): a, c, t, g, unknown or other
  misc_feature (261)..(261): n is a, c, g, or t
  modified_base (278)..(278): a, c, t, g, unknown or other
  misc_feature (278)..(278): n is a, c, g, or t
  modified_base (361)..(361): a, c, t, g, unknown or other
  misc_feature (361)..(361): n is a, c, g, or t
  modified_base (363)..(363): a, c, t, g, unknown or other
  misc_feature (363)..(363): n is a, c, g, or t
  modified_base (366)..(366): a, c, t, g, unknown or other
  misc_feature (366)..(366): n is a, c, g, or t
  modified_base (369)..(369): a, c, t, g, unknown or other
  misc_feature (369)..(369): n is a, c, g, or t
  modified_base (371)..(371): a, c, t, g, unknown or other
  misc_feature (371)..(371): n is a, c, g, or t
  modified_base (373)..(373): a, c, t, g, unknown or other
  misc_feature (373)..(373): n is a, c, g, or t
  modified_base (375)..(377): a, c, t, g, unknown or other
  misc_feature (375)..(377): n is a, c, g, or t
  modified_base (379)..(430): a, c, t, g, unknown or other
  misc_feature (379)..(430): n is a, c, g, or t
tcagagtcgagagacacgaccggtgctcgatttagcatactctacagggacaacgccaagaactcactgtatctgcaaatgaacagcctgagagccgaggacacggccgtatattactgtgcgagagttatcccctcacggtgacaatcgctatttctacgacggtatggacgtctgggggccaaaggggccacggtcgccgtctcctcagcctccaccaaggcccatccggtcttccccctggcnccctgctccaggacncacctcgtgggggcacngcgccctggggctagcccgtggtcaaggtacctactccagtactctactcgtgcggcgggctggacaagggcgctaagtacgngntgnacngncngnnncnnnnnnnnnnnnnnnnnnnnnnnnnnnnnnnnnnnnnnnnnnnnnnnnnnnn

SEQ ID NO: 186232 - DNA, 651 bp, Homo sapiens
  misc_feature: GYAE6OF01BYAUM.41.55.E11.1.454.CMB.1.raw
  modified_base (264)..(264): a, c, t, g, unknown or other
  misc_feature (264)..(264): n is a, c, g, or t
  modified_base (515)..(515): a, c, t, g, unknown or other
  misc_feature (515)..(515): n is a, c, g, or t
tcagtctatactatcacgaccggtgctcgatttagcactcgcacgttgggtttgggggggagaggagcccagcactgggattccgaggtgtttccattcggtgatcagcactgaacacagaggactcaccatggagttttggctgagctgggttctccttgttggtaacttttaaaaggtgtccagtgtgaggtgcggctgatggagtcgtgggaggaggcttacgtccagccgtggggggtcccagacgactctcctgtcgcncgcctcgtgggcctacaccggtcacgcagacctaactacagtggaggttcgggtcccgccgacggccgtaccggaagggggtaacggggctagggaggttcgggtctcgagttctaagtttactacgtgttagtatttcgactatacctacgcagtacgtccgtaggaacgggtcctattaccacctattacccgtccgaagggtaacctaacgttaccgaaggtaaccttacggtttactaccgtttaanaaagtacgaaactaacggtgaaggacgggactaacggacgccggtacgtactatacgtgacgacgagacacgggtcgccgtagtacggtggttattagttcttacggttataccgtcgggtggaacccgtacgggg

SEQ ID NO: 186233 - DNA, 811 bp, Homo sapiens
  misc_feature: GYAE6OF01CTI67.41.55.E11.1.454.CMB.1.raw
  modified_base (220)..(220): a, c, t, g, unknown or other
  misc_feature (220)..(220): n is a, c, g, or t
  modified_base (267)..(267): a, c, t, g, unknown or other
  misc_feature (267)..(267): n is a, c, g, or t
  modified_base (289)..(289): a, c, t, g, unknown or other
  misc_feature (289)..(289): n is a, c, g, or t
  modified_base (306)..(306): a, c, t, g, unknown or other
  misc_feature (306)..(306): n is a, c, g, or t
tcagtctatactatcacgaccggtgctcgatttagcactcgcacgttgggtttggggggggagaggagcccagcactgggattccgaggtgttccattcggtgatcagcactgaacacagaggactcaccatgggagttttggctgagctgggttctccttgttggtaactttttaaaaggtgtccagtgtgaggtgcggctgatgggagtctgggaggnggcttagtccgaggccgtggggggtcccagagactctccgtgtgacngccgtgtcgggcctccaccgtnaacgcacgacaacctanatcggtaggttcgggcccgaccgaggcccgtaccggaagggggaacggggtcgtaggggaggttcgggtctacgtacgttaccttaagtttagttaaccggtgggtttactaacttttacccgaataacttaaacgtacgacgtaacggtaaaccgttccgggtagggtaaacgggtcccctaatttacccaacctaacgtccctaccgggaacgggtaaacctaacgttaacccggaaggttaaaccgttaccgggttttaattaacccgtttaacgaaaaacgttaccgtaaaacccgtaaacccgttagggtaaacgggaccgggaaccggaacccggtaaccggaacccgggttcgttaaccgtttaacgttaccgtaggtaccggagaacgaacggtacggtacgggtcccggtaggtaccgggttaaggtttaggtttagttttacgtttacgggttacgttccggtttacgggtcgggggtaacccgtaaacccgggg

SEQ ID NO: 186234 - DNA, 506 bp, Homo sapiens
  misc_feature: GYAE6OF01D0D2L.42.2.A02.1.454.CMB.1.raw
  modified_base (476)..(476): a, c, t, g, unknown or other
  misc_feature (476)..(476): n is a, c, g, or t
  modified_base (481)..(481): a, c, t, g, unknown or other
  misc_feature (481)..(481): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctggtgcgacaggcccctggacaaggctcgagtggatgggaaatagtctcctagtctcggattaacaaactacgcacagaagtttcagggcagagtcaccattaccgcggacacatccactaacacagtctacattgagttgagtggcctgacatctagaggactcggccgtatattatgtgcgagagagagggctattaacncccgntgactattgggccagggaccctcgg

SEQ ID NO: 186235 - DNA, 533 bp, Homo sapiens
  misc_feature: GYAE6OF01DS4QO.42.2.A02.1.454.CMB.1.raw
  modified_base (494)..(494): a, c, t, g, unknown or other
  misc_feature (494)..(494): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatagggaaatagtctccctagtctcggattaacaaactacgcacagaagttcagggcagagtcaccattaccgcgacacatccaactaacacacgtactacattgagttgagtggcctgacatctgaggactcggccgtatattattgtgcgagagaggaggggtcttaagtttaactcccgtntacggtactaagttggggacccgagggaaccccgtcggg

SEQ ID NO: 186236 - DNA, 514 bp, Homo sapiens
  misc_feature: GYAE6OF01DWZGO.42.2.A02.1.454.CMB.1.raw
  modified_base (480)..(480): a, c, t, g, unknown or other
  misc_feature (480)..(480): n is a, c, g, or t
tcagtgacgtatgtcacgaccggtgctcgatttagactcatctacaggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctccctagtctcggattaacaaactacgcacagaagtttcagggcagagtcacattaccgcgacacatccactaacacaagtctacattgagttgagtggcctgacatctgaggactcggccgtatattattgtgcgagagagaggggactatttaacncccgctagtactattggggaccagggaccctagg

SEQ ID NO: 186237 - DNA, 537 bp, Homo sapiens
  misc_feature: GYAE6OF01CWVDB.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctcctagtctcggattaacaaactacgcacaagaagtttcagggcagagtcacattaccgcggacacatccactaacacagtctacattgagttgagtggcctgacatctgaggactcggaccgtattattattgtgcgagagaggaggggtacttaagtttaacctcccggtctggtaaccttagttcggggcctaaggggtaaccccttcggg

SEQ ID NO: 186238 - DNA, 553 bp, Homo sapiens
  misc_feature: GYAE6OF01D8V9G.42.2.A02.1.454.CMB.1.raw
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctccctgtctgcatctgtaggagacagaatcaccatcacttgccgggcgagtcaggtcagttggcgtatttttagcctggtatcagcaaaaacctggcacagttcctaagctcctcatctttcctgtcttctacttgcatcagggtcccatctcgcttcagcggcggtggctcgtgggacagatttcacttctcaccatcagcagcctgcacgcctagaagtagttggtttaggaaacgttatttacgtagtactaaagttataattaacgttttgtacgtcttaccgtcgtaccggtttccgggaccggggggtacctaagggtcgggaagtacgtaccgaaaacggtaacgttaggtacggtctaggacctaccgtgttaccg

SEQ ID NO: 186239 - DNA, 571 bp, Homo sapiens
  misc_feature: GYAE6OF01BM2TE.42.2.A02.1.454.CMB.1.raw
  modified_base (446)..(446): a, c, t, g, unknown or other
  misc_feature (446)..(446): n is a, c, g, or t
tcagtgacgtatgtcacgaccggtgctcgatttagactcatctacgagggggtagggcttcacgataacgaccaccttcctcctctaaagaagcccctgggagcacagctcgatcaccatggactcggacctcggacggttcctctttgtggtggcagcaggctacgaggtgtccagtcccaggtgcagctggtgcagtcaggggctgaggtgaagagcctgggtcctcggtgaaggtctcctgcaaggcttctggaggcaccttcagtagcaatgctgtcacctgggtgcgacacggcccctggacaaggacgtcggagtggagtgggaaatagtctcctagtctcggattaacaaactacgcacagaagtttcgaggcagagtcacctattaccgcggacacatccaactaacacagtactacattcgagttgagtggcctganactcgtagaggactcggccgttatacttagtgtgcgaggaggagggacgggtattaacgtttaaccgtcccgtagttacggtaaccgttagttacgggggcccttaacggggaccccgttacggg

SEQ ID NO: 186240 - DNA, 488 bp, Homo sapiens
  misc_feature: GYAE6OF01AJT3C.42.2.A02.1.454.CMB.1.raw
  modified_base (484)..(484): a, c, t, g, unknown or other
  misc_feature (484)..(484): n is a, c, g, or t
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctccctgtctgcatctgtaggagacagaatcaccatcacttgccgggcgagtcaggtcattggcgatttttagcctggtatcagcaaaaacctggcacagttcctaagctcctcatctttcctgcttctactttgcaatcagggtcccatctcgcttcagcggcggtggctctgggacagatttcactctcaccatcagcagcctgcagcctgaagatgttggaacgtattactgtcaagtatataactttgtcgtctctctacgtttcggcgggggtaccaagggtggagatcaaacgactggtggctgcaccgnttcg

SEQ ID NO: 186241 - DNA, 572 bp, Homo sapiens
  misc_feature: GYAE6OF01CRT19.42.2.A02.1.454.CMB.1.raw
  modified_base (409)..(409): a, c, t, g, unknown or other
  misc_feature (409)..(409): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttcgtggaggcaccttcagtagcaatgctgtcaccgtgggtgcgacgaggcccctggacaaggactcgagtggatgggaaatgtctcctagtctcggaattaaacaaactacgacacagaagtttcagggcagagtcacatacgcgacacatccactaacacagtctanattgagttgagtggcctgacatctaggaggacctggtacctattacttagttgtggcgaggtaggaaggtaggggtacttaacgtttaaccgtccccggtacttacggtaaccgtttaaggttaccggggggaccctaaagggggtaacccccgtttacgggg

SEQ ID NO: 186242 - DNA, 490 bp, Homo sapiens
  misc_feature: GYAE6OF01DVAOG.42.2.A02.1.454.CMB.1.raw
  modified_base (485)..(485): a, c, t, g, unknown or other
  misc_feature (485)..(485): n is a, c, g, or t
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctccctgtctgcatctgtaggagacagaatcaccatcacttgccggcagtcaggtcattggcgtatttttagcctggtatcagacaaaaacctggcacagttcctaagctctcatctttcctgtcttctactttgcaatcgagggtcccatctcgcttcagcggcggtggctcgtgggacagatttcactctcacatcagcagcctgcagcctgaagatgttagaacgtattactgtacaagtatattaactttgtcgctctctacgttcggacgggggactaagggtgaagtatacgaaacgatggtgactagacncatcg

SEQ ID NO: 186243 - DNA, 541 bp, Homo sapiens
  misc_feature: GYAE6OF01BOD90.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctccctagtctcggattaacaaactacgcacagaagtttcagggtcagagtcaccattaccgcggacacatccactaacacagtctacattgagttgagtggcctgacatctgagactcggccgtatacttattgtgcgagaggaggcgggtattaacgtttaccgtcccgtacgtagtacgttaggttacggggaccgtacgggtacccgttaccggg

SEQ ID NO: 186244 - DNA, 554 bp, Homo sapiens
  misc_feature: GYAE6OF01C8X4J.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctcctagtctcggattaacaaactacgcacagaagtttcagggcagagtcaccattaccgcggacacactccactaacacagtctacattgagttgagtggcctgaccatctgaggtactcggaccgttatattattgtgcgagtaggaggaggggtacttaacgtttaaccgtcccggtcgtacggtaccgtttaagttacgggggaccctacgggggtaaccccttcggg

SEQ ID NO: 186245 - DNA, 626 bp, Homo sapiens
  misc_feature: GYAE6OF01C9IWX.42.2.A02.1.454.CMB.1.raw
tcagtgacgtatgtcacgaccggtgctcgatttagactcatctacagggggagcttcacataacgaccaaccttcctcctctaaagaagcccctgggagcaccagctcatcaccatggactggacctggaggttctcttgtggtggcagcagctacaggtgtccagtcccaggtgcagctcggtgcagtcaggggctgaggtgaagaagcctgggtcctcggtgaaggtctcctgcaaggcttcgtggaggcaaccttcaagtagcaatgctgtcacctgggtgcgacacggcccctaggaacaaggactcgagtggagtagggaaataggtctaccgtagtctacggtattaaacgaaactacgacaacaagtaacgttcagggcagacgtcacagttaccgacggtaccactaagtaccaacgtaaacacaacgtactaacattgagttgaacgttggcccgttagacactcgtaggacggtacgtaccggtacgtaattaactttagttgtacggccgaaggtaggacgggtaagggggtaccttaagttttaaccctccccggtacgttacggtaacgttaacggttcgggggaacccaacgggggtaccccgttaaccggg

SEQ ID NO: 186246 - DNA, 530 bp, Homo sapiens
  misc_feature: GYAE6OF01DLGIW.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcaccgtggtgcgacaggcccctggacaaggactcgagtggatagggaaatagtctacctagtctcggattaacaaactacgcacagtaagttcagggcagagtcacataccgcggacacataccactaacacagtctacatgagttgagtggctgacatctgacggactcggtaccgtatattagttgtgcgagtagaggaggggtattaagttacctccgtctagtacgttagtggggaccgagggtaacccgtacggg

SEQ ID NO: 186247 - DNA, 714 bp, Homo sapiens
  misc_feature: GYAE6OF01B0330.42.2.A02.1.454.CMB.1.raw
  modified_base (245)..(245): a, c, t, g, unknown or other
  misc_feature (245)..(245): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggaggtgaagagcctgggtcctcggtgaaggtctctgcaaggcttcgnggacgccaccttcagtagcaatgctgtcacctgggtgcgacaggcccctggacaaggactcgaggtcggatgggaaatagtctcctagtctacggacttaacgaaactacggcaacgagtaacgtttcgagggtacagacgttaccgaacctaacgttaacccggccgggaacctaccgaacttaccccgaaaccttaaacaaccgtaaggtaccttaaacgtactttacggtaacgtttacgtacggttacgggtacccttacgggaacctaagttaccgttaggtaacgggtaacccgttaccggggacccgtttaagttaacgtttaacgttcggttaggtaccggtaaggtacgggtaagggtacgggggtacctttaacgtttaacccgttccccgtaccgttacggttaacgttacggttaccgggggtaccctaaaccgggggtaacccccgttacccgggg

SEQ ID NO: 186248 - DNA, 732 bp, Homo sapiens
  misc_feature: GYAE6OF01DAW8G.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgacggtgaagaagctgggtcctcggtgaaggtctcctgcaaggcttcgtggacggccaaccttcgaagtacgcaaatgctgtcaccgtgggtgcgacacggccctaggacaaggactacgagtggagtagggaaactggtcctaccgtagtctacggtaacttaaacgaaactacgacaacgaagtaacgttcgaagggccaggacgttcaaccgtagttaccggcggaaccacgtaacttacccaaacgttaaaccgtacgtaacgttaccttaaacgtaacgtttcggtaacgtttggaacggttccggttaccgttacggtaacctacgttaccgtacggtaaccggtaccgttcccggggtaaccgttaagtttaacgtttacgttacgggtacggtacgtaaacgggtaacggacggggtaacggggtaccttttaaacggttttaaccccgccccgggttaccttacgggtaaaccttttacgggttccgggggaaccccgtaaacggggttaacccccgttacccgggg

SEQ ID NO: 186249 - DNA, 594 bp, Homo sapiens
  misc_feature: GYAE6OF01A3JD1.42.2.A02.1.454.CMB.1.raw
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctcctgtctgcatctgtaggagacagaatcaccatcacttgccggcgagtcaggtcattggcgtatttttagcctggtatcagacaaaaacctggcacagttcctaagctcctcacttctttcctgtcttctactttgctaatcgagggtcccatctcgcttcgagcggcggtgctcgtgggacaggtatttcacttcctcactatcagcagcctcgcacgcctagaagtacttggttacggtaacgttattacgttagtactaaagttacgttaattaacgtttgttaccgtacttccgttaccgttacggtttcccggggaacggggggtacccgtaaaggggttacgggtaagtaacggttaacccgaaaacgggttaaccgtggttaccgggtacttacggacctaacccgtagtttacccg

SEQ ID NO: 186250 - DNA, 534 bp, Homo sapiens
  misc_feature: GYAE6OF01BWWQ2.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctcctagtctcggattaacaaactacgcacagaagtttcaggcagagtcaccattaccgcggacacatccactaacacagtactacattagagttgagtgctgacatctgagactcggccgtatattattgtgacgagagaggaggggtattacgttacgtcccgtctacggtacctagtttacgggggccgtaacgggaacccgttacggg

SEQ ID NO: 186251 - DNA, 589 bp, Homo sapiens
  misc_feature: GYAE6OF01CF37X.42.2.A02.1.454.CMB.1.raw
  modified_base (216)..(216): a, c, t, g, unknown or other
  misc_feature (216)..(216): n is a, c, g, or t
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctccctgtctgcatctgtaggagacagaatcaccatcacttgccgggngagtcaggtcagttggcgtatttttagcctggtatcagcaaaaactggacacagtcctaagctcctcatctttcctgtcttctactttgctaatcgacgggtcccatctcgcttcagcggcggtggctcgtgggacagtatttcactctcaccatcagcagcctgccagtccctaggaacgtattggttacggtaaacgttactttaaccgttgtactaaaggttattaagtttaacgttttgtacggtactttccttacgttaccggttttcgggggaccgggggggtaaccgtaaggggtcgggaaggtaacgtaaccgtaaaaccggtaacgttaggtacgggtacctaggacctacccgtagttacccg

SEQ ID NO: 186252 - DNA, 532 bp, Homo sapiens
  misc_feature: GYAE6OF01A4F21.42.2.A02.1.454.CMB.1.raw
  modified_base (471)..(471): a, c, t, g, unknown or other
  misc_feature (471)..(471): n is a, c, g, or t
  modified_base (494)..(494): a, c, t, g, unknown or other
  misc_feature (494)..(494): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctcctagtctcggattaacaaactacgcacaagaagtttcagggcagagtacaccattaccgcgacacatccactaacacagtctacattgagttgagtggctgacatcgtagaggactcggccgttaatattattgtgcgagagaggngggacttaatttaaccgtcccgntagtaaccttagttggggaccacggggtaaccctcggg

SEQ ID NO: 186253 - DNA, 521 bp, Homo sapiens
  misc_feature: GYAE6OF01B5CA6.42.2.A02.1.454.CMB.1.raw
  modified_base (430)..(430): a, c, t, g, unknown or other
  misc_feature (430)..(430): n is a, c, g, or t
  modified_base (492)..(492): a, c, t, g, unknown or other
  misc_feature (492)..(492): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggccccctggacaaggactcggagtggatgggaatagtctcctagtctcggattaacaaactacgcacagaagttcagggcagagtcaccattaccgcggacacatccactaacacagtactacattgagttgagtggcctgacntctgaggactcggccgttatattattgtgcgagaggagaggggtacttagttaactcccgtntcgactagtggggccagggtaccctcggg

SEQ ID NO: 186254 - DNA, 526 bp, Homo sapiens
  misc_feature: GYAE6OF01ACPM7.42.2.A02.1.454.CMB.1.raw
  modified_base (463)..(463): a, c, t, g, unknown or other
  misc_feature (463)..(463): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttcgtggaggcaccttcagtagcaatgctgtcacgtgggtgcgacacggcccctggacaaggactcggagtggatgggaaatagtctccgtagtctcggattaacaaactacgcacagagtttcaggcagagtcaccattaccgcggacacactaccactaacacacgtctacattgattgagtcggctgacatcgtgagcgtcggccgttatattattgtgngagagaggagggtacttagttactcccgatcgtacttaggtcgggccgtagggacccttcggg

SEQ ID NO: 186255 - DNA, 509 bp, Homo sapiens
  misc_feature: GYAE6OF01EOZBE.42.2.A02.1.454.CMB.1.raw
  modified_base (476)..(476): a, c, t, g, unknown or other
  misc_feature (476)..(476): n is a, c, g, or t
  modified_base (481)..(481): a, c, t, g, unknown or other
  misc_feature (481)..(481): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctcctagtctcggattaacaaactacgcacagaagtttcagggcagagtcacattaccgcggacacatccactaacacagtctacattgagttgagtggctgacatctgaggactcggccgtatattattgtgcgagagagagggctagttacncccgntgtactagttgggccagggaccctcggg

SEQ ID NO: 186256 - DNA, 532 bp, Homo sapiens
  misc_feature: GYAE6OF01BD031.42.2.A02.1.454.CMB.1.raw
  modified_base (460)..(460): a, c, t, g, unknown or other
  misc_feature (460)..(460): n is a, c, g, or t
  modified_base (477)..(477): a, c, t, g, unknown or other
  misc_feature (477)..(477): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctccctagtctcggattaacaaactacgcacagaagtttcagggcagagtcaccattaccgcggacacatccactaacacagtctacattgagttgagtggcctgacatctgaggactcggccgttatattattgtgnggagaggaggaggggtntaacgtttaacctcccgactgtacttagttggggcccgaggggacccttacgggg

SEQ ID NO: 186257 - DNA, 539 bp, Homo sapiens
  misc_feature: GYAE6OF01AODUG.42.2.A02.1.454.CMB.1.raw
  modified_base (216)..(216): a, c, t, g, unknown or other
  misc_feature (216)..(216): n is a, c, g, or t
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctccctgtctgcatctgtaggagacagaatcaccatcacttgccgggnagtcaggtcattggcgtatttttagcctggtatcagacaaaaacctggcacagttcctaagctcctcatctttcctgtcttctactttgcaatcgagggtcccatctcgcttcagcggcggtcggctcgtgggacagtatttcgactcctcaccatcagcagcctgccagcccgtagaagagttggttaggtaacgttattacgtgtactaaggttattaattaactttgtcgtctactcgtacgtttcgggaccgggggtaccgtaagggtcggagtacgtaccgaaacgtacgtggtcggtactagcctaccgtgttaccg

SEQ ID NO: 186258 - DNA, 551 bp, Homo sapiens
  misc_feature: GYAE6OF01AZ4BU.42.2.A02.1.454.CMB.1.raw
  modified_base (455)..(455): a, c, t, g, unknown or other
  misc_feature (455)..(455): n is a, c, g, or t
  modified_base (464)..(464): a, c, t, g, unknown or other
  misc_feature (464)..(464): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttcgtggaggcaccttcagtagcaatgctgtcacctgggtgcgacaggcccctggacaaggactcgagtggatgggaatagtctcctagtctcggattaacaaactagacacagaagtttcaggcagagtcaccattaccgacggacacataccactaacacatactacatgtagttgtagtgcctagacatctagaggacgtccggtaccgttnttaaaattnttagtgcggagaggaggaggggtacttacgtttaaccgtcccgtctacgtacttagttaggggccgaacggggtacccgttaccggg

SEQ ID NO: 186259 - DNA, 514 bp, Homo sapiens
  misc_feature: GYAE6OF01A9A2P.42.2.A02.1.454.CMB.1.raw
  modified_base (322)..(322): a, c, t, g, unknown or other
  misc_feature (322)..(322): n is a, c, g, or t
  modified_base (471)..(471): a, c, t, g, unknown or other
  misc_feature (471)..(471): n is a, c, g, or t
  modified_base (480)..(480): a, c, t, g, unknown or other
  misc_feature (480)..(480): n is a, c, g, or t
  modified_base (502)..(502): a, c, t, g, unknown or other
  misc_feature (502)..(502): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaatagtntccctagtctcggattaacaaactacgcacagaagtttcagggcagagtcaccattaccgcggacacatccactaacacagtctacattgagttgagtggcctgacatctgaggactcggccgttatattattgtgcgagagagagggntatttaccnccgtctgtactagttggggccngggaccctcggg

SEQ ID NO: 186260 - DNA, 568 bp, Homo sapiens
  misc_feature: GYAE6OF01EUQY9.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctggaggtgaagaagcctgggtcctcggtgaaggtctcctgcaggcttcgtggagcaccttcagtagcaatgctgtcacctgggtgcgacacggcccctggacaaggctcggagtggatgggaaatgtctcctagtctcggattaacaaactacgacacagaacgtttcgaagggtcagagtcaccattaccgcgacacactccactaacacagtctacattagagtgagtggactgacatctaggacgtacgtcggaccgttatagttattggtagcgtaggaacgagggtacggggtacttacgtttaaccgtccccggtacgtacggtaccgttaggttacgggggaccctaacggggaccccgttacggg

SEQ ID NO: 186261 - DNA, 561 bp, Homo sapiens
  misc_feature: GYAE6OF01AW2DA.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagcctgggtcctcggtgaaggtctcctgcaaggcttcgtggaggcaccttcagtagcaatgctgtcacctgggtgcgacacggcccctggacaaggactcggagtggatgggaaatagtctccgtagtctcggaattaaacaaactacgacacaagtaagtttcgagggcagagtacaccattaccgcgacacataccactaacacagtctacattgagttgagtgctgacatcgagacggactcggaccgttattagttatgtgacgagaggaggaggggtacttaacgtttaaccgcccgtagttacggtacgttacggttacggggacccgtaacggggtacccgttaccggg

SEQ ID NO: 186262 - DNA, 541 bp, Homo sapiens
  misc_feature: GYAE6OF01EBDZU.42.2.A02.1.454.CMB.1.raw
  modified_base (500)..(500): a, c, t, g, unknown or other
  misc_feature (500)..(500): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatggaaatagtctccctagtctcggattaacaaactacgcacagtaagtttcagggcagagtacacctattaccgcgacacatccaactaacacagtctacattgagttgagtggcctgacatccgtgacggtacgtcggtaccgtattacttagttgtgacgtagaggaggagggtacttatttaaccncccgtctaggtacttagtggggacctacgggaccctacggg

SEQ ID NO: 186263 - DNA, 516 bp, Homo sapiens
  misc_feature: GYAE6OF01E40ZE.42.2.A02.1.454.CMB.1.raw
  modified_base (467)..(467): a, c, t, g, unknown or other
  misc_feature (467)..(467): n is a, c, g, or t
  modified_base (473)..(473): a, c, t, g, unknown or other
  misc_feature (473)..(473): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctccctagtctcggattaacaaactacgcacagaagtttcagggcagagtcaccattaccgcggacacatccactaacacagtctacattgagttgagtggcctgacatctgaggactcggccgtatattattgtgcgagagagnggggtntagtttaactcccgctgactagttggggccagggaccctcggg

SEQ ID NO: 186264 - DNA, 508 bp, Homo sapiens
  misc_feature: GYAE6OF01CZ9H2.42.2.A02.1.454.CMB.1.raw
  modified_base (280)..(280): a, c, t, g, unknown or other
  misc_feature (280)..(280): n is a, c, g, or t
  modified_base (482)..(482): a, c, t, g, unknown or other
  misc_feature (482)..(482): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctggggtcctcggtgaaggtctcctgcaaggcttctggaggcaccttcagtagcaatgctgtcactgggtncgacaggcccctggacaaggactcgagtggatgggaaatagtctcctagtctcggaattaaacaaactacgcaacagaagtttcagggcagagtcacattaccgcgacacatcactaacacagtactacattgagttgagtggcctgaccatctgaggactcggccgtatattatgtgcgagagagagggctattactccgntgactagttggggccagggacctcgg

SEQ ID NO: 186265 - DNA, 719 bp, Homo sapiens
  misc_feature: GYAE6OF01CPMI2.42.2.A02.1.454.CMB.1.raw
  modified_base (159)..(159): a, c, t, g, unknown or other
  misc_feature (159)..(159): n is a, c, g, or t
  modified_base (208)..(208): a, c, t, g, unknown or other
  misc_feature (208)..(208): n is a, c, g, or t
tcagtgacgtatgtcacgaccggtgctcgatttagactcatctacagggggaagtctcctctcagtcgaggacacagtcgttggacatggacgggtccctgctcagcctccgtgggacctcctgctgctcgtcggcctcccgagactaccagatggtanacactccgagatcgaaccctgttccttcccttccctccgtgtctgactntcgtggaggacacagtactccacctatcctacgtcgggcccgggatacgtcggtacggtctaggttcggtacgtttaacgtttttacgtccgttaggttattacgaacgtaaaccgtaaaaccgtcggacacgtacgtttacctaacgtccttcctctactttcctttcctcgttcctttcctttacgtttcgtaactaacgttacggtacccgggttcctacgttccgtccgttccttacggtacggccgggtcggttcggcttcggtcggtacgtagttactttccacttccgtaccaacctactacgacgccacgtccgtcgccgacgtccgtagtaacgtgttacggttacgtaacgttattacgtagttacgtaagttaattacgtttacgttcgtactccgttctaccgttacgggtttccggggaccggggtaaccgttagggtacggtagtaacgtaacgaaaccggtagtacggtcggtacgtacgacctacgtcgttaccg

SEQ ID NO: 186266 - DNA, 675 bp, Homo sapiens
  misc_feature: GYAE6OF01CSD2T.42.2.A02.1.454.CMB.1.raw
  modified_base (189)..(189): a, c, t, g, unknown or other
  misc_feature (189)..(189): n is a, c, g, or t
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctcctgtctgcatctgagganacagaatcaccatcacttggccggcagtcaggtcagttggcgtatttttagcctggtatcagacaaaaacctggacacagttacctaagcctctcattctttcctgtcttcttactttgctatcgaacgggtcctatctcgctttcacggcggcggtggccgtcgtcgggactaggtatttccgacttcctacacctacttcaacgctaacgtccctgaccagccctaggtaacgagttacggtttaggaacgtttaagtttaaccgtcggttaacctaaaaggtttacttaaacgtttaaccgtttttacggtaccgttaccgttcctttaccgttaaccggttttaccgggggtaacccggggggggttaacccgtaaacggggttacggggtaacggtaaacgttaacccggaaaaaccggttaaaccggttcgggttaacgggtaccgttaggaaccccgtaacccgttaagtttaccccgg

SEQ ID NO: 186267 - DNA, 513 bp, Homo sapiens
  misc_feature: GYAE6OF01AFCRR.42.2.A02.1.454.CMB.1.raw
  modified_base (469)..(469): a, c, t, g, unknown or other
  misc_feature (469)..(469): n is a, c, g, or t
  modified_base (488)..(488): a, c, t, g, unknown or other
  misc_feature (488)..(488): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctggggtcctcggtgaaggtctcctgcaaggcttctggaggcaccttcagtagcaatgctgtcacctgggtgcgacaggcccctggacaaggactcgagtggatgggaaatgtctccctagtctcggattaacaaactacgcacagaagtttcagggcagagtcaccattaccgcggacacatccactaacacagtctacattgagttgagtggcctgacatctagaggactcggccgtatattattgtgcgagagaggnggggcttagttactcccgntgactagttgggcagggaccctcgg

SEQ ID NO: 186268 - DNA, 536 bp, Homo sapiens
  misc_feature: GYAE6OF01AGHCL.42.2.A02.1.454.CMB.1.raw
  modified_base (432)..(432): a, c, t, g, unknown or other
  misc_feature (432)..(432): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacacggcccctggacaaggactcgagtggagtgggaaatgtctcctagtctcggaattaacaaactacgacacagaagtttcgagggacagagtcacattacgcggacacataccactaacacagtctacattgagttgagtggctgacntctagacggtactcggaccgttatattattgtgcggagagaggagggtacttagtttaccgcccgtatcgtacgttagtaggggccctaggggtacccgtcggg

SEQ ID NO: 186269 - DNA, 570 bp, Homo sapiens
  misc_feature: GYAE6OF01BGR8E.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagcctgggtcctcggtgaaggtctcctgcaagggcttcgtggaggcaccttcagtagcaatgctgtcactgggtgcgacaggcccctggacaaggctcgagtggatgggaatggtctcctagtctcggataacaaacgtacgacacagtaagttcgaggtcagagtcacagtaccgcgacacatccactaacactacgtactaacattgagttagagtcggcctagacagtcgtacgaggacctcggtaccgttatacgttagtggtagacgaggtaacggaggtaacggggtacttacgtttaacgtcccgtacgttacggtaaccgttaggttaccggggacgtacggggtacccgttacggg

SEQ ID NO: 186270 - DNA, 729 bp, Homo sapiens
  misc_feature: GYAE6OF01BNPTW.42.2.A02.1.454.CMB.1.raw
tcagtgacgtatgtcacgaccggtgctcgatttagactcatctacagggggaagtctctctcagtcaggacacagcttggacatgagggtccctgctcagctccgtgggactcctgctgctctggctcccagataccagatgtcacatccagatgacccagtctcccttcctcctgtctgcatcgtagtaggagacagaatcacatcacgttggccggtatagtcaggtctaggttcggtacgttagttttacgccgttggtactacaacgtaacctaaaaccgtcggacgtaacctacggtttacctaaccggtcctccttacctacctttcctttccgtacgttcctttaccttacctttcgaccgtaacgttccgaccgggtacctacgttccgtccgtacgttcggacggtccgggtcggttcggccgttcggtacggacctaagtactttacgaccttacgtacacgtacgtccgacgaccgtcggtaccgtacgaccgtacgtaccgtaggaagtacgttaggtaacgggttaaccgtttaagttaacttaccggttaattaaccggtttattaaacgtttaaccgtttgtacccgttacttccgttaaccggttaccggtttaccgggggaccggggttaaacctaaggggttacgaacgtaacggtaaccgaaacgttaccggtaggttaccgggacttaccggactacccgtagttcccg

SEQ ID NO: 186271 - DNA, 536 bp, Homo sapiens
  misc_feature: GYAE6OF01EX09D.42.2.A02.1.454.CMB.1.raw
  modified_base (433)..(433): a, c, t, g, unknown or other
  misc_feature (433)..(433): n is a, c, g, or t
  modified_base (462)..(462): a, c, t, g, unknown or other
  misc_feature (462)..(462): n is a, c, g, or t
  modified_base (479)..(479): a, c, t, g, unknown or other
  misc_feature (479)..(479): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagccgtgggtcctcggtgaaggtctcctgcaaggcttctggaggcaccttcagtagcaatgctgtcaccgtgggtgcgacaggcccctggacaggactcgagtggagtgggaaatagtctccgtagtctcggaattaacaaactacgacacagtaagttcgaggcagagtcaccataccgcgacacatccaactaacacagtctacattgagttgagtggctagacntcgtagacgactcggccttatattattgngcgaggagaggagggtntaagtttaaccgccgtactcgtaacgttaggtagggcccgaagggtacccctacggg

SEQ ID NO: 186272 - DNA, 529 bp, Homo sapiens
  misc_feature: GYAE6OF01BTW4V.42.2.A02.1.454.CMB.1.raw
  modified_base (435)..(435): a, c, t, g, unknown or other
  misc_feature (435)..(435): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggagtgggaaatagtcctcctagtctcggattaaacaaactacgacacagaagtttcaggcagagtcaccattaccgcgacacactccaactaacacagtctacattgagttgagtggctgacatcngaggctcggctatattatgtgcgagaggaggagggtcttaagttacctccgcgttcgtacttaggtacggggcctaggggtaaccccgttcggg

SEQ ID NO: 186273 - DNA, 739 bp, Homo sapiens
  misc_feature: GYAE6OF01EETZ2.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttcgtggaggcaccttcagtagcaatgctgtcaccgtgggtgcgacgacggcccctggacaaggactcgagtggagtagggaattagtcctacctagtcgtacggaatttaaaccgaaactaccggacaacgtaagtaacgtttcgaaggggtacaaggtaagtaccaacccgtaagttaaccccggacggaaccaccgtaacttacccaaaccttaaaccaacctaacggttacctaactagtttacgtaaggtttacgtaggttacggaccgtttacgactacgttccgttaggaaccggtaccgttccgggtacccgtttaagttaacgttttagtttggtacggtacggtaaacgggtaaggtaacggggtacgggggttacctttaaacggttttaaaccccggtaccccggttaccgttacgggttaaccgtttaacgggtttacccggggggaaccccgttaaaccgggggtaacccccggtttacccgggg

SEQ ID NO: 186274 - DNA, 649 bp, Homo sapiens
  misc_feature: GYAE6OF01BYKSQ.42.2.A02.1.454.CMB.1.raw
tcagtgacgtatgtcacgaccggtgctcgatttagactcatctacagggggagcttcaccataaccgaccacctttccctcctctaaagtaagcccctgggagcacagctcatcaccatggactggacctggaggttcctcgtttgtggtggctaggtcagtctacaggtgtccagtcccaggttgcagctggtgcaggtcgaggggcgtggaggtggaaggaggcctgggtcctcggtgaggtctcctgcaggcttcgtggagcacctcagtgcaatgctgtcaccgtgggtcgcgacgacggcccgtggacgaggctcggagtggatagggaattgtcgtccgtagtctcggtaattaacgaactacgacacgaagtacgtttcgagggcaggtacgtacacctacttaccgcggaacacgactaccactaacactacgtactacattcggtaagttgacggtcggaccttagactagtcgtaggacggtacctacgggtacctttaattacgtttagtttcggtgtacggaggtaagggtacgggtacggggttactttaacggtttaacccgtcccggttaacgttaccgggtaacgttacgggtttaccgggggacccgtaacgggggttacccccgttcgggg

SEQ ID NO: 186275 - DNA, 533 bp, Homo sapiens
  misc_feature: GYAE6OF01EY7W9.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggaccttgaggttcctctttgtggtggcagcagctacaggtgtccagtcccaggtgcagctggtgcagtcaggggctgaggtgaagaagcctgggtcctcggtgaaggtctcctgcaaggcttcgtggagcaccttcagtagcaatgctgtcacctgggtgcgacacggcccctggacaaggctcgagtggatgggaatagtctccgtagtctcggaattaacaactacgcacagaagttcaggcagagtcacataccgcgacacatccaactaacacacgtactactattgagttgagtgctgacatcgtagacggtacgtcggaccgtattattacttgtgcgagaggagaggggtacttacgttactcccgtactcgtacgttacgttggggaccacgggacccgtacggg

SEQ ID NO: 186276 - DNA, 569 bp, Homo sapiens
  misc_feature: GYAE6OF01ALX57.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggctcgagtggatgggaaatgtctccctagtctacgggattaacaaacttacgcacacgtaagtttcagggcaggagtcaccgattaccgcggacacacgttaccactaacacagtcctacattgagttgagtggaccctgaccatcctggagacgtcggaccttatattacttgtgcggaaggaggagggtacgggggtacttaagtttaacccgcccgtcttacggtacgttacggttacggggccttaacggggtaaccccttcgggg

SEQ ID NO: 186277 - DNA, 543 bp, Homo sapiens
  misc_feature: GYAE6OF01BAE6D.42.2.A02.1.454.CMB.1.raw
  modified_base (286)..(286): a, c, t, g, unknown or other
  misc_feature (286)..(286): n is a, c, g, or t
  modified_base (497)..(497): a, c, t, g, unknown or other
  misc_feature (497)..(497): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttcgtggaggcaccttcagtagcaatgctgtcacctgggtgcgacnggcccctggacaaggactcggagtggatgggaaatagtctcctagtctcggattaacaaactacgcacagaagtttcagggtcagagtcaccattaccgcggacacgatccaactaacacagtcctactattgagttgagtggcctgaccatctagaggaccgtcgggccttatattattgtgcggagagaggaggggtctaagtttaccncccgtctacggtacttagttaggggccctaggggaaccccttcggg

SEQ ID NO: 186278 - DNA, 522 bp, Homo sapiens
  misc_feature: GYAE6OF01BL4D7.42.2.A02.1.454.CMB.1.raw
  modified_base (447)..(447): a, c, t, g, unknown or other
  misc_feature (447)..(447): n is a, c, g, or t
  modified_base (466)..(466): a, c, t, g, unknown or other
  misc_feature (466)..(466): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggccccgtggacaaggctcgagtggatgggaatagtctcctagtctcggattaacaaactacgcacagtaagtttcgagggcagagtcaccattaccgcggacacatccactaacacagtctacatgagtgagtggcctgacatctgagctcggccgttatnttattgtgcgagaggaggnggggtatagttaccgtcccgctgtacttaggttagggccgaggggacccgttcggg

SEQ ID NO: 186279 - DNA, 626 bp, Homo sapiens
  misc_feature: GYAE6OF01DQKTE.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctgaggtgaagaagcctggggtcctcggtgaaggtctcctgcaaggcttcgtggaggcaccttcagtagcaatgctgtcaccgtgggtcgcgacacggccccgtaggacgaaggactcgaggtggagtaggaaatacgtctaccgtagtctacggtattaacaaactacgacagagtaagttcagggcagacgtcaccacgttaccgacggaacacaactaccaaactaaacgacaacgttacctactattaggtacgttagagtcggacctagactatcgtggaacggtaccgtcgggaccgttaatttaacgtttgtttaggcggtacggaaaggaggagggtaacggggtactttaaacgtttaacccgcccggtatacggtacgttaacgggttcggggaacccgaaccggggtacccttaccgggg

SEQ ID NO: 186280 - DNA, 618 bp, Homo sapiens
  misc_feature: GYAE6OF01DAKHW.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaggcttctggaggcaccttcagtagcaatgctgtcaccgtgggtgccgacacggccccgtggacgaaggactcggagtggagtagggaaatagtcctcctagtcgtcggattaaacaaactacgacactaagtaacgtttacgagggcaagagtaccaccacgttaccgacggtacacactaccaactaacactaacgtcctaactacttagtacgttgacgtggtaccctagacctatcgttagacggtacgtcggtacctatttagttagttaggtcgtacggaggtaggagggtacggggtactttaacgtttacccgtccccgtagttcgtaaccgtttaggttccgggggacccgtacggggtaaccccttaccgggg

SEQ ID NO: 186281 - DNA, 679 bp, Homo sapiens
  misc_feature: GYAE6OF01ACJJ2.42.2.A02.1.454.CMB.1.raw
  modified_base (262)..(262): a, c, t, g, unknown or other
  misc_feature (262)..(262): n is a, c, g, or t
  modified_base (395)..(395): a, c, t, g, unknown or other
  misc_feature (395)..(395): n is a, c, g, or t
tcagtgacgtatgtcacgaccggtgctcgatttagactcatctacgagggggagcttcacataacgacctaccttcctcctctaaagaagcccctgggagcacagctcatcacctatggacttggacctggagttcctctttgtggtggcagcagctacgaggtgtcgagtccgaggtgcagactggtgcagtcgagggctgagtgaagtagcctcgggtcctcggtagaacggttctccgtgccgtaaggtccgtttacgngggacggtcctaccgtttcgaaggttacgctaaagtcggctgtccacggttgggcgacgacgcggcccctaggacgaaggctcggagtcgagtacggaaatcgtctcctagcttcggaattaacaaactcganacgagtagttcgaggcaaggctacactacgtaccggcgtacacactaacccaacgtaacacgtacgtacctaactacgtttaggtacttggtaacgtcggtacccttagacgttaactcggtaacggtacgggtaaccttaccggggtactttaagttacgtttacgttagggacggtacggaagtaccggggaagggtccgggtacttttaacgtttacccggcccgttagttaccgtaacgttacgggttccggggaacccgtacgggtaacccgttccggg

SEQ ID NO: 186282 - DNA, 586 bp, Homo sapiens
  misc_feature: GYAE6OF01D6OUJ.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctgaggtgaagaagcctgggtcctcggtgaaggtctcctgcaaggcttcgtggaggcaccttcagtagcaatgctgtcaccgtgggtgcgacacggcccctggacaacggactcggagtggatagggaaatagtctccgtagtccgtacggaattaacaaactacgcacagtaagttcgaggcagatcacactaccgcgacacactccaactaacacagtactacagttgtagttgacgtggcctgacagtcgtagacggtacgtcggtaccgttagttactttagtggtagacggaggaacggagggtacgggtacttaacgtttaacccgtacccgtcgttacgtaccgttaggttacggggacccgtaacggggtacccgttaccggg

SEQ ID NO: 186283 - DNA, 615 bp, Homo sapiens
  misc_feature: GYAE6OF01C7F8B.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctgaggtgaagaagcctgggtcctcggtgaaggtctccgtgcaagggcttcgtggaggcaccttcagtagcaatgctgtcaccgtgggtcgcgacgacggccccctggacaaggctcggagtggatagggaatagtctcctagtcgtacgattaacaaactacgacacagtaagttcgagggcaagagtacacctacgttaccgacggacacactaccaactaacacacgtactactagttagtagttgagtcggtacctgaactatcgtaggacggtacgtccggtaccgttattacgtttagttggtacgacggaaggaggagggtacgggggtacttaacgttttaaacccgtcccgtacgttacgtaaccgttacggttccgggggtacccggaacggggtaaccccgttacgggg

SEQ ID NO: 186284 - DNA, 529 bp, Homo sapiens
  misc_feature: GYAE6OF01DS0QJ.42.2.A02.1.454.CMB.1.raw
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctccctgtctgcatctgtaggagacagaatcaccatcacttgccgggcagtcaggtcattggcgattttttagcctggtatcagcaaaaacctggcacagttcctaagctcctcatctttcctgcttctactttgcaatcagggtcccatctcgcttcagcggcggtggctcgtgggacagatttcactctcaccatcagcagcctgcagcctgaagatgttaggaacttattactgtactaagtattaattaacttttgtcgtcttctctaccgttttcgggccggggggtaaccaaggggttgggaagtacgtaccaaaacggtaacgttcggtaggacttggacctaccgagttaccg

SEQ ID NO: 186285 - DNA, 619 bp, Homo sapiens
  misc_feature: GYAE6OF01A32A3.42.2.A02.1.454.CMB.1.raw
  modified_base (451)..(451): a, c, t, g, unknown or other
  misc_feature (451)..(451): n is a, c, g, or t
tcagtgacgtatgtcacgaccggtgctcgatttagactcatctacagggggaagtctctctcagtcaggacacagcttggacatgagggtccctgctcagcccctggactcctgctgctctggctcccagataccagatgtgacatccagatgacccagtctccttcctccctgtctgcatctgtaggagacagaatcacatcactgccggcgagtcaggtcattggcgtatttttagcctggtatcagacaaaaacctggcacagttacctaagcctccttcatccttttacctcgtcctttcttacttttcgctaaactccgtacggggtcccctattccgtacgtcttcacgcggcggtgggccttcgtgggacctaggtactttcgaccttcgtaccaccattccagctacgcctgcagcccgtagaagtatagttacggtaacgtnttactgttacaagttaatacttaaacgtttgtaccgtgttacctcgtaaccgttcggggacccggggggtaactaaggggtcggtaaacggtaagttaaccggaaaaccggtaacgttagggtaccgggtactacgtacccgtaacccttaggttcccgtttaaccgg

SEQ ID NO: 186286 - DNA, 771 bp, Homo sapiens
  misc_feature: GYAE6OF01DYOV8.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggaggtagaaggaacgccgtggggtcctcgggtaggaacggttctccgtgacgtaaggtcttcgtgggacgcctaccgttcgagtagacaagtcgtcgtcgtaccgaccgtgggtcgcgacgacggccccgtaggacgaacggacgtcggacggtggagtagggtaaatacgtcctaccgtagtacgtacggtaacttaaacaaacgtacgacgaacgtacggtaacgtttacgaacgggtactaacggtacgtaccgaaccgttaacgttacccggaacggtaccgtaacgtaacctacccgaaacttaaaccgaactacgttaacctaacgtagtttacggtaggttacggtacggttacggacctaggtaactacgttcggtaacgggtacggtaacccgttacgggtaaccgtttaagttacgtttacggttacggtacggacgggtaaggaacggtaacgggtacgggttaactttaaccggtttaaacccgtcccggttaagttacccggttaacggtttacgggtacccggggtaacccggtaaaccggggtaccccggttaccggg

SEQ ID NO: 186287 - DNA, 580 bp, Homo sapiens
  misc_feature: GYAE6OF01BMGL1.42.2.A02.1.454.CMB.1.raw
  modified_base (477)..(477): a, c, t, g, unknown or other
  misc_feature (477)..(477): n is a, c, g, or t
tcagtgacgtatgtcacgaccggtgctcgatttagactcatctacagggggagcttcacataacgaccaccttccgtcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaagggccttctggaggccaccgttcagtagcaatgctgtcaccgtgggtgcgacaggccccgtggacgaaggactcggaggtggatgggaatgtctcctagtctcgattaacgaacgtacgcacgagtaagtttcaggcagagtcaccattaccgcggacacactccaacgtaacactacgtactacattgagttgagtcgctgacatctagacggacgtccggccgttatacttagttgngtacggagaaggaggtacgggggtacttaaggtttaaccctccccggtacgttacgtacgttacggtttacgggggaccctacggggtaaccccgttccgggg

SEQ ID NO: 186288 - DNA, 592 bp, Homo sapiens
  misc_feature: GYAE6OF01CJGW6.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcagggctgaggtgaagaagcctgggtcctcggtgaaggtctcctgcaaggcttcgtggaggcaccttcagtagcaatgctgtcaccgtgggtgcgacacggcccctaggacgaacggctcggagtggagtagggaaatagtcctcctagtctacgattaacaaactacgcaacagaagttcgagggcagacgtcaacgattaccgcgaacacatacccaactaacacacgtactactatagtagttagacggtcggtacctagactagtctaggacggaccgtcggaccgttaattacgttagttggtgacggaggaggaaggtacggggtattaacggtttaacctcccggtacttacgtaacgttaggttacggggacccgtaacggggtacccgttacggg

SEQ ID NO: 186289 - DNA, 512 bp, Homo sapiens
  misc_feature: GYAE6OF01B3563.42.2.A02.1.454.CMB.1.raw
  modified_base (453)..(453): a, c, t, g, unknown or other
  misc_feature (453)..(453): n is a, c, g, or t
  modified_base (476)..(476): a, c, t, g, unknown or other
  misc_feature (476)..(476): n is a, c, g, or t
  modified_base (482)..(482): a, c, t, g, unknown or other
  misc_feature (482)..(482): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatgtctcctagtctcggattaacaaactacgcacagaagtttcagggcagagtcacattaccgcggacacatccactaacacagtactacattgagttgagtggctgacatctgagactcggctatattattgtgngagagaggagggatagtttaccncccgtntcgacttagttgggccagggtaccctcggg

SEQ ID NO: 186290 - DNA, 543 bp, Homo sapiens
  misc_feature: GYAE6OF01BSPIR.42.2.A02.1.454.CMB.1.raw
  modified_base (442)..(442): a, c, t, g, unknown or other
  misc_feature (442)..(442): n is a, c, g, or t
  modified_base (482)..(482): a, c, t, g, unknown or other
  misc_feature (482)..(482): n is a, c, g, or t
  modified_base (497)..(497): a, c, t, g, unknown or other
  misc_feature (497)..(497): n is a, c, g, or t
  modified_base (507)..(507): a, c, t, g, unknown or other
  misc_feature (507)..(507): n is a, c, g, or t
  modified_base (511)..(511): a, c, t, g, unknown or other
  misc_feature (511)..(511): n is a, c, g, or t
tcagtgacgtatgtcacgaccggtgctcgatttagactcatctacagggggaggcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagcctgggtcctcggtgaaggtcctcctgcaaggcttctggaggcaccgttcagtagcaatgactgtcacctgggtcgcgacgaggcccctggacaaggactcggagtggagtgggaaatgtctcctagtctcggaattaacaaactacgacacaagtaagttcgagggacagagtcacctattaccgacggtacacataccactaacacacgtactacattgagttgagtcgtcngactatctgaggtaccgtcggtccttattattagttgtgngagaggaggagggtntacgtttacnccgntacgtactagttcggggcctagggccctacgg

SEQ ID NO: 186291 - DNA, 529 bp, Homo sapiens
  misc_feature: GYAE6OF01CQLAD.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctcctagtctctgattaaacaaactacgcacagaagtttcagggcagagtcaccattaccgcggacacatccaactaacacagtctacattagagttgagtggcctgacatctagagactcggctatattattgtgcgtagagaggaggggtacttagtttaaccgtcccgtctacgtacttagttcggggccgagggtaaccccgg

SEQ ID NO: 186292 - DNA, 693 bp, Homo sapiens
  misc_feature: GYAE6OF01CN87P.42.2.A02.1.454.CMB.1.raw
  modified_base (299)..(299): a, c, t, g, unknown or other
  misc_feature (299)..(299): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggagttcctctttgtggtggcagcagctacaggtgtccagtcccaggtgcagctggtgcagtcgaggggctggaggtgaagagccgtgggtcctcgggtagaacggttctccgtggacgtaagggtccttcgtgggacggcctaccttcgagtagcaaatgctgcacgtgggtncgacgacggccctaggacgaaggactcgaggtgagtaggaaactgtcctaccgtagtctacggtaaattaaaccgaaactacgacaacgtaaagtaacgtttcgaagggtacaaggtacgtaccgaaccgtaacgttaccggacgtaacacgtaactacccaaactaaacacgtaacgtacctaacgtaatttaggagtttaggaaggttccgtaccgttagaacctagttccgtaagggtacgtaacccggtacgggtacccgttaattttaacgttagttacgggtacgtaccggaggtaacgggtagggtaacggggttacttaacgttaacccgtcccgtagtacggtacgttacggtaccggggaccgaacggggttacccgtaccggg

SEQ ID NO: 186293 - DNA, 583 bp, Homo sapiens
  misc_feature: GYAE6OF01AGCH7.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagcctgggtcctcggtgaaggtctcctgcaaggcttcgtggaggcaccttcagtagcaatgctgtcaccgtgggtgcgacacggcccctggacaaggactcggagtggagtgggaaatgtctccgtagtcgtcggaattaacaaactacgcacagaagtttcgagggtacagacgtcaccgtacgttaccgcggaaccacgactaccactaaccacagtactactattgagtgagtggcctgactatcgtagtacggacgtccggcgttaattattacttgtacgacgacggaggagggtacggggtcttaacgtttaccgtacccgtgttacgtacgttacggttaggggacccgtaacggggtacccgttaccggg

SEQ ID NO: 186294 - DNA, 521 bp, Homo sapiens
  misc_feature: GYAE6OF01ECFE0.42.2.A02.1.454.CMB.1.raw
  modified_base (466)..(466): a, c, t, g, unknown or other
  misc_feature (466)..(466): n is a, c, g, or t
  modified_base (487)..(487): a, c, t, g, unknown or other
  misc_feature (487)..(487): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggaggtgaagaagcctgggtcctcggtgaaggtctcctgcaaggcttctggaggcaccttcagtagcaatgctgtcaccgtgggtgcgacaggcccctggacaaggactcgagtggatagggaaatgtctccgtagtctcggattaacaaactacgcacagaagttcgagggcagacgtcacattaccgcgacacatccactaacacagtctacattgagttgagtgcctgacatcagaggctcggctatattatgtgcgagaggaggngggtattacgttaactcccgntcgtacgttagtcggggccagggtacccgtacgg

SEQ ID NO: 186295 - DNA, 585 bp, Homo sapiens
  misc_feature: GYAE6OF01B7EUP.42.2.A02.1.454.CMB.1.raw
  modified_base (509)..(509): a, c, t, g, unknown or other
  misc_feature (509)..(509): n is a, c, g, or t
  modified_base (543)..(543): a, c, t, g, unknown or other
  misc_feature (543)..(543): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggaggtgaagaagccgtgggtcctcggtgaaggtctcctgcaaggcttcgtggaggcaccttcagtagcaagtgctgtcaccgtgggtgcgacgacggccccgtaggacaagggacctcggaggtcggagtagggaatagtcctacctagtctacggtataacaaactacgacacagaacgtttcgagggcagagtcacacttaccggacgaccacactaccaactaacacacgtactactagttgtaagtcgtagtcggcctagactagtacgtaggacggtacgtcggtaccgttattagttatggtcgngagaggaggacgggtacttaagttaccgtccgtntacgtacgttacgttacgggaccgtacggtacccgtaccggg

SEQ ID NO: 186296 - DNA, 673 bp, Homo sapiens
  misc_feature: GYAE6OF01B4N36.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctgaggtgaagagccgtgggtcctcggtgaaggtctccgtggcaaggcgttcgtggacggctaccttcagtagacaatgctgtccgacgtgggtcgcggacgacggccccgtaggacgaacggtacgtcggagtaggacgtagggaaattacgtctaccgtagtctacggtaataacgaactacgcaactagtaacgttcgagggacaggtacgtaccgaacctaagttacccggacgaaccgtacactaacccgaacttaaacgaccgtaacgttacctaacgtacgttgtaacggttaggtacgttcggaccctaggacctacgtcgttacggacggtaaccgtcgggttaccgttaagttaagtttacgtaggttaccggacggtaggtaaggtacggggtacggggttacttaacggtttaccgccgtacgtagtacgttaggttccggggaccgtaacgggtaccgttaccggg

SEQ ID NO: 186297 - DNA, 709 bp, Homo sapiens
  misc_feature: GYAE6OF01EQVT2.42.2.A02.1.454.CMB.1.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (252)..(252): a, c, t, g, unknown or other
  misc_feature (252)..(252): n is a, c, g, or t
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctccctgtctgcatctgtagganacagaatcaccatcacttgccgggnagtcaggtcattggcgtatttttagcctggtatcanacaaaaccgtggacactacgttacctaagccttcctctacttccttttcctcgtcctttcttactttgactaacgtcgacgggttcccattcgtccgtcttcgacggcggtcggtcggcgttcgtacgggactagtaacttttccaccttctaccaacctactacacgctacgccgtcgaccgacgtacccgtagtaaacgtgtttacggttaagggtaaccgttttaacgtttacgttacgttaacgtaaaggtttaactttaacgttttaaaccgtttttcggtacccgttaccgtttacccgtttacccgttaacgggttttaccgggggacccgggggggtaaaccttaacgggggttacgggtaacggttaacggttaaacccggtaaaaccggttaacgttacgggttaccgggaccgttaacggtaccctaacccgtacgtttacccggg

SEQ ID NO: 186298 - DNA, 556 bp, Homo sapiens
  misc_feature: GYAE6OF01CQKX1.42.2.A02.1.454.CMB.1.raw
  modified_base (359)..(359): a, c, t, g, unknown or other
  misc_feature (359)..(359): n is a, c, g, or t
  modified_base (507)..(507): a, c, t, g, unknown or other
  misc_feature (507)..(507): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctcttgtggtggcagcagctacaggtgtccagtcccaggtgcagctggtgcagtcgaggggctggaggtgaagaagccgtgggtcctcggtgaaggtctcctgcaaggcttctggaggcacctttcagtagcaatgctgtcaccgtgggtgcgacacggcccctggacaaggactcgagtggatagggaaatgtctccgtagtctacggattaacaactacgacanagtagttcaagggcagagtcacattaccgacgacacatccaacaacactagactacattgagttgagtggctgactatcgtggaggacctcggccgttaatattgttagtgacggagagacgggtaggggtacttaacggtttaaccncccgtacgtacgtacgttacggtggggacccacggggtaaccctccggg

SEQ ID NO: 186299 - DNA, 733 bp, Homo sapiens
  misc_feature: GYAE6OF01CZNBB.42.2.A02.1.454.CMB.1.raw
tcagtgacgtatgtcacgaccggtgctcgatttagactcatctacagggggagcttcacataacgaccaccttcctcctctaaagaacgcccctgggagcacagctcatcaccatggactggacctggaggttcctctttggtggtggcagcagctacaggtgtccacgtcccaggtgcagctggtgcgagtcgaggggctggaggtagaagacgccggtgggtccgtcggtaggaacggttcctccgtgacgtaacggtccttacggtgggacggtcctaccttacgaaggtacgactaagtcgccgttcgtaccgtacggtggggtcgaccggaaccgacccgggcccgtaagggaaacaacggtacgtacggtaggtagggaagtaagggtaaacttcggttacctaccgtaggttaccgtacggtaaacttaaaacgaaacgtacgacgtaacgtaaggttaacgttacgacgggtacacggtaacgtaccaacctacgttaccgacgaccaacactaccaactaacactaacgtactaacgtagttcggaggttagacggttcgaccgttagaccttacgtcggtaacggaccggtaccgttaccggtaaccgtttaattaacgtttaggtacgtaggacgaaaggtaggaagggtacgggttactaacgtttaccgcccgttagtacgtaacggttacggtagggaacccgtacgggtaaccctcgg

SEQ ID NO: 186300 - DNA, 751 bp, Homo sapiens
  misc_feature: GYAE6OF01D9XV3.42.2.A02.1.454.CMB.1.raw
  modified_base (249)..(249): a, c, t, g, unknown or other
  misc_feature (249)..(249): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggaggtgaagagccgtgggtcctcggtgaaggtctccgtgcaaggtcttcgnggaggcctaccttcgagttagacaatcggacttcgtccgaccgttggggtcgcggtaaccgacgggtcccccgtagggaaccgaacgggtaccgtaccggaggttacgggaaggttaacggggtaaaattacggttaccccttaccccggttaaggttacccggtaaccgggtaactttaaaacccgaaaaccgttaaccggacctaaccgtaaggtaaacggttttccgaacggggtacgaacggtaacgttacccaaaccgttaaccgtttaacccgggaccggaacaaccctactacccaactaaaccaactacggttacctaactagtttaggtagttacgagggtaccgtaccgtagacctactacgtaggaacgtccgttcggtaccgttaagtttacttagttgtacgacgtaggaggtacgggtacgggtacttacggttaccgtacccgtgtacgtaccgttaggtccgggtaccgtacgggacccgttcggg

SEQ ID NO: 186301 - DNA, 695 bp, Homo sapiens
  misc_feature: GYAE6OF01D619L.42.2.A02.1.454.CMB.1.raw
  modified_base (243)..(243): a, c, t, g, unknown or other
  misc_feature (243)..(243): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcgagctggtgcagtcagggctgaggtgaagagcctgggtcctcggtgaagtctctgcgaaggcttcgnggacgcaccttcagtacgcaatgctgtcgaccgtggtgcgtacgacggcccctaggacaaggacgtacgagtggagtagggaaactcgtctaccgtagtcgtacggtaacttaacaaactacgacaactagtaacgttcgagggcagtagtacaactacgttacgacggaacctaacgactaccaacgtaaacaacgtagttacctaacgtaacttaggtaacgtttacgacggttcggtaccgtacgtaactacgttacgtacggaacggtacgttacccgggtaacgtttaacgttaagtttacgttcgggtacgtaccggtagtaacgggtaaggggtacgggtaccgtttaaacgtttaacccggtccccggtacgttaaccggttaaccggttacgggttacccgggggtaccccgtaaaccggggttaaccccgtttaacccgggg

SEQ ID NO: 186302 - DNA, 678 bp, Homo sapiens
  misc_feature: GYAE6OF01C35UY.42.2.A02.1.454.CMB.1.raw
  modified_base (191)..(191): a, c, t, g, unknown or other
  misc_feature (191)..(191): n is a, c, g, or t
tcagtgacgtatgtcacgaccggtgctcgatttagactcatctacagggggaagtctctctcagtcaggacacagcttggacatgagggtccctgctcagctccgtgggactcctgctgctctggctcccagataccagatgtgacatccagatgacccagtctccttcctccctgtctgcatctgagganacagaatcacatcacttgcgggcagtcaggtcagttggctatttttagcctaggtatcagacaaaacctggacacagttcctaagccttcctctattctttcctgtcttcttactttgacaatcgacgggtccatctcgcttcaggcggcggtcggctcgtggacagtactttcactcacacctactcgagcagcctagacgtacgacctaggtaacgtagttacggttacgggtaaacctttaagttaccttagggtaacctaaggttaatttaaacgtttaaccgttttcgtacgttacccgtttaccgttacccggttaacccgggtttttaccggggggaccccgggggggggtaaacccgttaaaggggggttaacggggtaaaccgttaacgggttaaaaccccggtaaaacggggttaaccggtttcgggttaacgggtaccctttaggggaacccctaacccggtacgttttaacccgg

SEQ ID NO: 186303 - DNA, 704 bp, Homo sapiens
  misc_feature: GYAE6OF01AIA47.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctggaggtgaagagccgtgggtctcggtgaaggtctctgcaggcttcgtggaggcaccttcagtagcaatgctgtcaccgtgggtcgcgacgacggcccctaggacaacggctcggaggtggagtagggaaatcgtcctccgtagtcgtacggtaactaaacgaaactacgacaactaggtaacgtttcgaagggacagtacgtaccaccgtacttacccggcgaacaactactacccaacgtaaaccaactacgtaccttaacgtagtttacggaaggttcgaagttccgggtacccgtaagaacccgtagttccgtaacgggtaacgggtacccggttaccgggttaccgttaagtttaacgtttacggtttggtacgggtacgggtaacgggaagggtaacggggtacgggggttaactttaaccggttttaccccggtacccggtagttaaccggtacggtttacgggtacgggggaccccgtaacggggtacccccggttacggg

SEQ ID NO: 186304 - DNA, 529 bp, Homo sapiens
  misc_feature: GYAE6OF01CDULC.42.2.A02.1.454.CMB.1.raw
  modified_base (476)..(476): a, c, t, g, unknown or other
  misc_feature (476)..(476): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacacggcccctggacaaggactcggagtggagtgggaatagtctcctagtctcggattaacaaactacgacacagaagtttcagggcagagtcacattaccgcggacacgataccactaacacatctacatgagttgagtggcctgacatcgtagaggctcggacgttatattatgtgacgagagagacgggtntagtttacctcccggtctagtactagttaggggcctaggggacccgttacggg

SEQ ID NO: 186305 - DNA, 773 bp, Homo sapiens
  misc_feature: GYAE6OF01ERR6M.42.2.A02.1.454.CMB.1.raw
tcagtgacgtatgtcacgaccggtgctcgatttagactcatctacagggggagcttcacataacgaccaccttcctcctctaaagaacgcccctgggagcacagctcatcaccatggactggacctggaggttcctctttgtggtggcagcagctacaggtgtccagtcccaggtgcagctggtgcagtcgagggctggaggtgaagagccgtgggtcctcggtgaaggtctcctgcaggcttcgtggaggccaccttcgagtagcaatgctgtccaccgtgggtgcgtacgacggccccgtggaacgaacgggacgtcggaggtagggagtagggaaattacgtaccttacccgttagtccgtacggtaacttaaaccgaaacgtacgacaacgtaaggtaacgtttacgagggtacgaggacgtaccaaccgtacgttacccggacggaaccaaccgaactacccgaacctaaaccaaccgaacgttactaaccgtaacgtttacggtaaggtttacggtacggttaccgggtacccgttacggaacctacgttaccgtagggaaccgggtaccggttacccggtacccggtttaaagtttacgttttaagtttcgggttaggtaccggtaagggtaaacgggtagggggtaaccggggttacttttaaaccggttttaaacccggtacccccgggttacgtaccgggttaaccgtttaacgggttaccgggggtaacccggttaaaccggggtaaccccgtttaccgggg

SEQ ID NO: 186306 - DNA, 775 bp, Homo sapiens
  misc_feature: GYAE6OF01C85UI.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggaggtgaagaagcctgggtcctcggtgaaggtctccgtgcaagggtcttacgtgggacgctaccttcagtagctaatcgctgtcaccgtgggtcgcgacgacggcccgtaggacgaaggctacggaggtggagtagggaaatgtcctaccgtagtcgtacggtaattaaaccgaaactacgacctaacgtaaggtaaacgtttcgaacgggtactaacggtaacgttaccgaaccgtaagttacccggacggtaacactaaccgtacctaacctaaacgtacaacgtactaactagttaggagtttggagttccggtacctaggaactacgttacgtagggtaacgggtaccgtttccgggaaacccgtttagtttaacgtttacgggttacggttaacgggtacggtaaacgggttagggtaaaccggggggttaacgggggttaacttttaaacccggttttaaaccccgggtaccccggttaaccgggtttaccggtttaaaacccgggtttaggggttaccccggggggtaaccccgtaaaaccgggggtttacccccggtttaaacccgggg

SEQ ID NO: 186307 - DNA, 647 bp, Homo sapiens
  misc_feature: GYAE6OF01AP09B.42.2.A02.1.454.CMB.1.raw
  modified_base (591)..(591): a, c, t, g, unknown or other
  misc_feature (591)..(591): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaggcttcgtggaggcaccttcagtagcaatgctgtcaccgtgggtgcgacgacggcccgtggacaaggcgtcggagtggatagggaatgtcctaccgtagtcgtacggtaacttaacgaactacgacacgaagtaagttcgagggtacagtacgtcaccgtacttaccggacgtaacactacgtaccaactaacactacgtacctaacgtattcgaggttacgacggtacggccctaggactagtccgtacggtaacggtaccgttaccgggtaccgttaagttacgtttagtacggtacggaccggtaaggtaaggacgggtaggggtacctttaacgtttacccgaccccggtnttaacggtacttaacgggttcggggaaccccgtaacggggtaccccgttaccgggg

SEQ ID NO: 186308 - DNA, 637 bp, Homo sapiens
  misc_feature: GYAE6OF01D0QA6.42.2.A02.1.454.CMB.1.raw
  modified_base (146)..(146): a, c, t, g, unknown or other
  misc_feature (146)..(146): n is a, c, g, or t
tcagtgacgtatgtcacgaccggtgctcgatttagactcatctacagggggagcggttcacataacgaccaccttcctcctctaaaggaagcccctgggagcacacgcgtcatcaccatggactggacctggacgttcctctttgnggtggcagcagctacaggtgtccagtcccaggtgcagcctggtgcagtcgagggctgaggtgaagagccgtgggtcctcggtgaaggtctccgtgcaaggtcttcgtggacgtctaccttcgagtagctaatcgcctcgtcaccgtgggtcgacgacacggtcccgtaggacaaggctcgagtggagtaggtaaagtcgtctccgtagtctacggtaataaccaaacgtcgacacgagtaacgttcgacgggcagacgtaccacgtacgttaccggacgacacgactaccaactaaacgacgtacgttactaactagttagtagttcgacggttcgacgtagacgtactcgtaagacggtacttccggtaccgtttagtacgttagtggacgtcggaagtacggaggtacgggtacttaaaccggtttacccgcccggtacgttacgtaccgtttagggtacccgggtaccgtaaccgggtccccgttcgg

SEQ ID NO: 186309 - DNA, 638 bp, Homo sapiens
  misc_feature: GYAE6OF01CT9XD.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggaggtgaagaagcctggggtcctcggtgaaggtctcctgcaaggtcttcgtggacggcaccttcagtagacaatgctgtcaccgtgggtgccgacgacggccccgtaggacaaggactacggaggtaggacgtagggaaatgtcctccgtagtctcggtattaaacgaaactacgactacagtaacgttcgagggcaagacgtacaaccgtacttacccggcggaaccactaactacccgaactaaactacagtacctaactagtttagagtttcgaagtcggacctagactagtcgtaggacggtaccgtcggaccgttattaacttagttacggtcgacggtaggaggagggtacgggtacctttaaacgtttaccgtccccgtacgttggtaaccgttagggtttaccggggaccgtacggggtaacccttaccggg

SEQ ID NO: 186310 - DNA, 665 bp, Homo sapiens
  misc_feature: GYAE6OF01BD14E.42.2.A02.1.454.CMB.1.raw
  modified_base (227)..(227): a, c, t, g, unknown or other
  misc_feature (227)..(227): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagcttgggtcctggtgaggtcncctgcaggcttcgtggagctaccttcgagtagcaatgctgtcacgtggtcgcgacgacggccctaggacaggctcggagtggatagggaaatcgtcgtacctagtctacggtaacttaacgaaacgtacgacaacgtaaggtaacgtttcgaacgggtacaacggtacgtaccgaaacgtacgttaccgggacgtaccgaacacgttacccaacgtaaaccgacgtaacgtcctaatacgtacgtaggttacgtaggttacggccgttagaacctacgtcgtacggacggaccgttaccgggaccgttagttaacgtttagttacggtcggtacggtaaggtacggtaagggtaccggggtactttaaccggtttaccgtacccggtacgttacgtacgttacggttacggggaccgttaacgggtcccgttaccggg

SEQ ID NO: 186311 - DNA, 520 bp, Homo sapiens
  misc_feature: GYAE6OF01A2UEW.42.2.A02.1.454.CMB.1.raw
  modified_base (411)..(411): a, c, t, g, unknown or other
  misc_feature (411)..(411): n is a, c, g, or t
  modified_base (460)..(460): a, c, t, g, unknown or other
  misc_feature (460)..(460): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcagggctgagtgagaagcctgggtcctcggtgaaggtctcctgcaaggcttctggaggcaccttcagtagcaatgctgtcacctggtgcgacaggcccctggacaaggctcgagtggagtggaaatagtctcctagtctcggacttaacgaaactacgcacaagaacgtttcagggcaagacgtacaccattaccgcgacacagtccactaacacagtctacncttagattgagtcgctagacatctagagactcgaccgtatatcttgtgngagaggagcgggtatacgtttacctcgacgtcgtactagtggggcagggaaccgttcggg

SEQ ID NO: 186312 - DNA, 606 bp, Homo sapiens
  misc_feature: GYAE6OF01A62S9.42.2.A02.1.454.CMB.1.raw
  modified_base (401)..(401): a, c, t, g, unknown or other
  misc_feature (401)..(401): n is a, c, g, or t
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctccctgtctgcatctgtaggagacagaatcaccatcacttgccgggcgagtcaggtcattggcgtatttttagccttggtatcagcaaaaacctggcacagtcctaagctcctcatctttctgtccttctactttgctaatcgtacgggtcccatctcgtcttcagcggcggtggctcgtgggactaggtatttccactctcacctatcagtcagcctgcacgcctagaagnttacggttaggaacgttattaccgtagtactaagttattaattaaacgttttggtacgttccttaccgtaccgttaccggttttccgggggaccggggggtaacccgttaaagggggttcgggtaacggtaacggttacccgaaaaacgggtaaccgttacgggtttacgggaccgttacgaccgtaaacccgtaggtttacccg

SEQ ID NO: 186313 - DNA, 684 bp, Homo sapiens
  misc_feature: GYAE6OF01BOSBQ.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctaggaggtacgaagaacggccgttggggtccctcggggtagaacgggtcctccgtgaccgtaaggtccttcgtgggacgtcctaccttcgaggttacgactaatgctgtcaccgtgggtcgccgacgtacggacccctgggaacgaacggtccgtacggaggtgggacgtagggaaacgtcgtcctaccgtacggtctacgggtaacttaaaccgtaaactaccgacaacgtaacgtaaacgtttacgagggtacaaggacgtaccaaccgtagttacccggacgaccaacgactacccgaaactaacgaccagtactaacgtattagtagttagaggtacggtcctagactactcgtaggtacggacgtccggtacgttatttagttagttcgtagacggtaggaacggtaggtacgggtacgttaattacccgcccgttagtacgtacgttacgggtacggcccggtaacgggtacccgttaccggg

SEQ ID NO: 186314 - DNA, 672 bp, Homo sapiens
  misc_feature: GYAE6OF01B6UVC.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggagttctctttgtggtggcagcagctacaggtgtccagtcccaggtgcagctggtgctaggtcgaggggctggaggtgaagaagccgtggtcctcggtagaaggtctccgtgacaaggtcttcgtaggacggtactaccgttacgaaggtacgactaagtcgtctcgtcgtaccggtgggtcgacgacgacggtccccgtaggaacgaacggacgtacggagtaggaagtacgggaaactacgtaccgtaccgtacgtacgttacggtaacttaaacaaacgtacgacaacgtaacggtaagtttacgaagggtactaaggtacgtaacctacctaacgttacccgacggaactaacgactacctaaactaacactacgttaactactacgttagtagttagacgtcggaccttagactatcgtacggacggtaacgtcggaccgttaattacgttagtacgtgacggacgaggacgggtaggtacttaacgttaccgccgtatacgtacgttaggttaccggggactaacgggtacccgtacggg

SEQ ID NO: 186315 - DNA, 702 bp, Homo sapiens
  misc_feature: GYAE6OF01EYTA4.42.2.A02.1.454.CMB.1.raw
  modified_base (642)..(642): a, c, t, g, unknown or other
  misc_feature (642)..(642): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctggaggtgaagaagcctgggtcctcggtgaaggtctcctgcaaggcttcgtggacggcaccttcagtagcaatgctgtcaccgtggggtgccgacgacggtccccgtagggaaccaagggacgtacggaggtcggaagtagggaaagttacggtcctaccccgtagttccgtacggtaaactttaaaccgaaactacggaccaacgtaagtaacgtttacgacggggtacaaggacgtccaaccgtaacgttaacccggacggaaccctaaccacctaaccccgtaaacttaaacccaacgtaacggttacctaactagttaggtaacgtttggaacgttcggaccttacggactacgtcgtaggacggtccgtacgggtaccttaagttagtttagttgtcggtacgacggtaggacgggtagggttactttaacggtttaacccncccggttactacgggtaacgttacggttaccggggaccgtaaaccggggtccctaccggg

SEQ ID NO: 186316 - DNA, 690 bp, Homo sapiens
  misc_feature: GYAE6OF01EMD51.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctgaggtgaagagcgtgggtctcggtgaaggtctcctgcgaaggcttcgtgggaggcctaccttcgagtagcaatgctgtcaccgtgggtcgcgacgacggccccgtggaacgaaggactcggagtaggagtagggaaatagtctccctagtccgtacggaacttaaaccaaacgtacgacgtaacgtaacgtaaagtttcgaagggtcaaggagtaccaacctacgttaccggacggaaccacgactaccaaactaaccaactacggttaacctaactagttacggtagttacgtacggttcggaccgtacgtactaacgttcggtaacggacgggtaaccgttaccgggtacccgtttaagttacttttagttacggttacggtaccggtaaggaaacggtagggacggggttaacttaacgtttaacccgtcccgtacgtacggttaccgtacggttacgggggaccctaacgggggtaccccttaccgggg

SEQ ID NO: 186317 - DNA, 694 bp, Homo sapiens
  misc_feature: GYAE6OF01D1YAP.42.2.A02.1.454.CMB.1.raw
  modified_base (286)..(286): a, c, t, g, unknown or other
  misc_feature (286)..(286): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggaggtgaagaagccgtgggtcctcggtgaaggtctccgtgcaaggtcttcgtggaggcaccttcgagtagcaatgctgtcactgggtncggacacggccctggacaacggcgtcggaggtcggagtagggaaatcgtctccgtagtcgtacggtaattaaaccgaaactaccgacaacgtaagtaagtttcgaaggggtcaggacgtaccaacgtacgttacccggacggaccaactaaccgtacctaacctaaactacgacgttacctaaacgtattagtaagtttggacggttccggccttagaacctacgttcgtagggaacggtaccgtacccgggtacgttaacgttaacgtttagttcggttaggaccgggtaggaagggtaaggtacggggttacctttaacgtttaacccggtcccggtacgttaacgttaccggttaacggttacccggggggtacccgtaaaccggggggtaccccttaccggggg

SEQ ID NO: 186318 - DNA, 522 bp, Homo sapiens
  misc_feature: GYAE6OF01A5IMY.42.2.A02.1.454.CMB.1.raw
  modified_base (434)..(434): a, c, t, g, unknown or other
  misc_feature (434)..(434): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaatagtctcctagtctcggattaacaaactacgcacagaagtttcagggcagagtcaccattaccgcggacacatcccgactaacacacgtctaacattgagttgagtggctgacatcngaggactcggccgttatattatgtgcgagagaggagggtactagtttaacctcccgtctagtacttagtgggcctagggacccgtcgg

SEQ ID NO: 186319 - DNA, 542 bp, Homo sapiens
  misc_feature: GYAE6OF01B9823.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcgggtgaaggtctcctgcaaggcttcgtggaggcaccttcagtagcaatgctgtcaccgtgggtgcgacaggcccctggacaaggactcgagtggatgggaaatgtctcctagtctcggataacaaactacgcacagtaagttcagggcagagtcactattaccgcgacacgataccactaacacagtactacattgagttgagtcggctgacatcgtgacggactcggccgtaattattagttgtgacgagagaggtaggggtacttaagtttaaccgcccgtatcggtacttaggttacggggcccaaggggtaccctcggg

SEQ ID NO: 186320 - DNA, 651 bp, Homo sapiens
  misc_feature: GYAE6OF01BT0UK.42.2.A02.1.454.CMB.1.raw
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctccctgtctgctatcgtgtaggagacagaatcaccatctacttcggccgggcgagtcgaggtctagttggacgttagttttttacgccgttaggtatcaacgactaaaaaccgtggacactacgttacctagtcctacctcactttcctttccttgtcctttacttacgtttcgaactaacgtccgtacggggtaccctacgtccgtcgtacgttcgacgggtcgggtcggtcggtcgtcggtacgggactagtctttaccacttcctaccacctactcgacgtcacgtccgtacgacaccggctaaggaagtagttacggttagtaacgttattacgtacgtaactaattacttacttaacgttcgttacgtcttccgtacgttcccggttacgggggaccggggtaaccgtagggtcggtaagtaacgtaaccgaaacggttaccggtcggtacgtccgtacgactaccgttgttcccgg

SEQ ID NO: 186321 - DNA, 628 bp, Homo sapiens
  misc_feature: GYAE6OF01BUSGC.42.2.A02.1.454.CMB.1.raw
tcagtgacgtatgtcacgaccggtgctcgatttagactcatctacgagggggagcttcacataacgaccaccttcctcctctaaagaagccccgtgggagcacagctcatcaccatggactggacctggaggttcctctttgtggtggcagcagctacaggtgtccagtcccaggtgcagctggtgcagtcgaggggctgaggtgaagaagccgtggggtctcggtgaaggtctcctgcaaggtcttacgtggacgcaccttcagtagcaatgcgtgtacgaccgtgggtgaccggacgacggccccgtaggaacgaaggccgtggagtagggagtagggaaatacggtccttacccgtagtccgtacggtaattaaaccaaacgtacgacaacaaggtaacgtttcgagggcaaggagtaccacctacgttaccggacgaacaccactaccaactaaccacacgtactacattagaggttgagttcggctaggacagtccgtagacggtacgtaccggcgttagtactttagtggtgtacgtaggaaggtaggaggggttattaactttccgtcccgaccgttagacggttacggttacggggacccgacgggttaccccgtacggg

SEQ ID NO: 186322 - DNA, 751 bp, Homo sapiens
  misc_feature: GYAE6OF01CPES8.42.2.A02.1.454.CMB.1.raw
  modified_base (250)..(250): a, c, t, g, unknown or other
  misc_feature (250)..(250): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtgcagcagctacaggtgtccagtcccaggtgcggctggtgcagtcgaggggctggaggtgaagaagccgtgggtcctcgggtgaaggtctcctgacaaggtcttcgnggagcacttcagtagcaatgctgtcaccgtgggtcgcgacgacggtccccgtaggaccgaaggccgtcggaggtggaagtagggaaattacggtcctccgtagtcctacggtaacttaaacgaaactacgacaacgaggtaagttacgaagggtacaggtacgtaccaaccgtaacgttaccggcggaacaacactacccaacgtaaacactacgttactaaacgtagttagtaaggtttacgacggtcggtacccttaggaaccttaagttccgtaaggtaaccgggtaaccgtttacccggggtaaccgtttaagtttaacgttttaagttcgggttacgaaccgggtaaggtacgggtaacggggtaaccggggtaacgtttttaaacccgtttaaaacccggttccccggtaacgtttaccggtaaaccggtttaacgggtttacccgggggaacccgtaaaccgggggttaaacccccgttcgggggttaaacccc

SEQ ID NO: 186323 - DNA, 912 bp, Homo sapiens
  misc_feature: GYAE6OF01EBU2G.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctgaggtgaagaagcgtgggtcctcggtgaaggtcctcctgcaaggcttctggagccaccttcgagtagcaatgtctgtcgacctgggtcgcgacgcggccccgtacggacgaacggacgtaccgaggtcgggagtagggtaaaagtagttccttaccccgttagttaccgtacggtaactttaaaaccgtaaaacgtaacccgacaaccgtaaggtaaacggttttacgaacggggtacgaaggtaacgtaccgtaaccgtaaccgtttaacccggaccgggtaacctaaccgaaccttacccctaaaaccgttaaaccctaaaccgtaaaccgttactaaaccccgttaagtttaacggtaacggttttacgggtaacgggttacggttacccccggttaaggtacccgttaaacgttaccgttaacggggtaaaccgggtacccgggtttacccgggttaacccggtttaaagttttaaccgtttttaacgggtttacggtttaccgggtaaccggggttaaacggtaaaccggggtaaacgggggtaaacggggggtttacctttaaaacccgggttttttaaacccccgttaccccgggtttacccggtttaaaccggggtttaaacccggttaaccggggtttttacccgggggggaaaccccgggttaaacccgggggttaaaccccccgggttttaaaccccccgggggg

SEQ ID NO: 186324 - DNA, 614 bp, Homo sapiens
  misc_feature: GYAE6OF01E4RFF.42.2.A02.1.454.CMB.1.raw
  modified_base (258)..(258): a, c, t, g, unknown or other
  misc_feature (258)..(258): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggaggtgaagaagcctgggtcctcggtgaaggtctcctgcaaggcttcgtggaggcacctnagtagcaatgctgtcacgtgggtgcgacgcggccccgtggacgaacggactcggaggtggaagtagggaaatagtcctccgtagtccgtacggtaattaaaccaaactacgactaacgaagtaagtttacgagggacagtagaccaaccgtacgttaacccggcggaaccactactacccaactaacacagtacctaatagttagtagttagagtcggacctgactatcgaggacggtaccgtcggtccttaattacgttagttggtgacgtaaggaggacggggtagggtacttaacgtttaccgcccgtatacggtactacggttcgggggacccgtacggggacccgttcggg

SEQ ID NO: 186325 - DNA, 840 bp, Homo sapiens
  misc_feature: GYAE6OF01DY1D4.42.2.A02.1.454.CMB.1.raw
  modified_base (162)..(162): a, c, t, g, unknown or other
  misc_feature (162)..(162): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttggtggtggcagcagctacaggtntccagtcccaggtgcagctggtgcagtcgagggctggaggtgaagagctgggtcctcggtagaaggtctccgtgacgaaggtctcgtggaggcctaccttcagtagctaatgctgtccacgttggggtcacgaccgacggtccccgtaggaacgaaacggaccgtaccgaagggttaggagttacggggaaattacggtccctaccgttacggttccgtaacgggtaaacttaaaaccgtaaaaccgtaccgaccgtaaacgtaacggtaaacggttttaccggaacggggtacctaagggtaaacgttacccgtaaaccctaacgggttttaaccccgggacgggaaaccctacgtaaacccgttacctaaaccgtaaaacccgtaaccaacgggttaacctaacgttaacggtttaggtaccggttaggaacggttcggacccgttagaacgtaacgtccgtaacgggtaacggtaccgtacccgggttaccgttaagttttaacgttacggttaggttacgggaccggtaaagggtaagggaacggggttaacggggtttaacctttaaacggtttttaaacccccggccccgtttaacgttaacgggtaacccggtttacgggtaccgggggttaacccgtaaaccggggggtaccccgttttaaaccccgggg

SEQ ID NO: 186326 - DNA, 671 bp, Homo sapiens
  misc_feature: GYAE6OF01EM2G1.42.2.A02.1.454.CMB.1.raw
tcagtgacgtatgtcacgaccggtgctcgattttagactcatctacagggggagcttcacataacgaccaccttcctcctctaaagaagcccctgggagcacagctcatcaccatggactggacctggagttcctctttgtggtggcagcagctacaggtgtccagtcccaggtgcagctggtgcagtcgaggggctgaggtagaagacgccgtgggtcctcggtgaaggtcctcctgacaggcttcgtggagctaccttcagttagacagtgacgttcgtctaccgtggggtcaccggtacgaccggccccgtagggaaccgtaaggccgtacggaggtcggaagttagggaaacttgttcctaccgtagtccaggtaacttaaacaaacgtacgcaacgtaagtaacgttcgaggtacgagtacgacaccgtacgttaccgacgactaactacgtacccaaaccgtaacaacgtacgttactaacgttagtttacggtagttcgtagtcggtaccttacgacgtacgtcgtaggaaccggtccgttaccggtacctttagttaacgttagtttggtggtacgtaggacggtaagggtacggttatttaaccgttaccgtcccggtcgtacgtacgttacggtaccgggcgtaaaccgggtcgttcccgg

SEQ ID NO: 186327 - DNA, 684 bp, Homo sapiens
  misc_feature: GYAE6OF01EVPSK.42.2.A02.1.454.CMB.1.raw
  modified_base (137)..(137): a, c, t, g, unknown or other
  misc_feature (137)..(137): n is a, c, g, or t
  modified_base (605)..(605): a, c, t, g, unknown or other
  misc_feature (605)..(605): n is a, c, g, or t
tcagtgacgtatgtcacgaccggtgctcgatttagactcatctacagggggagcttcacataacgacccaccttcctcctactaaagaacgcccctgggagcacagctcatcaccatggactgacctggagttcctntttggtggtggcagcagctacgaggtgtcccagtcccgaggtgcagtcgtggtcgcgagtcgaggggctggaggtagaagacgccgtgggtcctagggtagtacgtctccgtgacgaaggtcgttacgtgggacgtccaccgttcgaagtacgactaagtcgtcttcgtcctaccggtgggtacgccgacggtacgggccccgtaggaacgaacggtaccgtacggaggttagggagtaggggtaaacttcggtaccctaccgtagtaccgtacggtaaacttaaacctaaacgtaccgactaaccggtaagtaacgtttacgaacggggactaggtacgtacaccttacgtaccggacgactaccatacccaactaacacagtactaaccgtagttagtagttacgtagtcggtactaggtacagttacgcggtacgtacgtcgggtacgttacttagttgttacgnggtacgaggtaggagggtacgttacgttacgtaccgtcccgtgtacgttacgtcggtacgggcgtaccggacgttccgg

SEQ ID NO: 186328 - DNA, 732 bp, Homo sapiens
  misc_feature: GYAE6OF01BTBXS.42.2.A02.1.454.CMB.1.raw
  modified_base (558)..(558): a, c, t, g, unknown or other
  misc_feature (558)..(558): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctggaggtgaagagccgtgggtcctgggtgaacggtctcctgacgaaggcttcgtgggacggcctaccttacgagtagcaatgcgtgtcgaccgtgggtcgccgaccgacggccccgtaggaaccgaaggaccgtacggaggttggaagtagggaaacttacggtccttacccgtagtcgtacggtaaacttaaacgaaacgtaccgactaacgtaacgtaaacggtttacgaacgggtacaacggtaacgtaccgaaaccgtaacgttaacccggaccggaacctacacttaccccaacttaaacccacgtaaccttactaactacgttagtaaggttcgtaaggtcgggtccctagtaaccngttacctagggacgtaccgttcgggtacctttagttacgtttagtggttacgacggtaggtaaggacgggtaacggggttaccttaaacggttttacccgccccggtagtttaacggtaccgtttacgggttaacccgggggcccgttaaaccggggtaccccgtttacccggg

SEQ ID NO: 186329 - DNA, 804 bp, Homo sapiens
  misc_feature: GYAE6OF01BBIYB.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagcgtggtgcagtcgaggggctggaggtagaagacgccgtgggtccgtcggtgaacggtcctccgtgcgaaggtcttcgtgggacggcctaccttcgaagtagactaagtcgtcgttcgtccgtaccggtggggtcgccggaaccggaccgggtccccggtagggaaccgtaacgggtacccgtagggaaggttagggaagtaggggtaaacttacggttcccgttaccgttaggttcccgtaacggttaaaccttaaaccgtaaaccgtaccggaacgaaacgtaacggttaaacggtttaccggaagggtaccgtaacggtaacgtaaccccgtaaccgttaaccggttacccgggaaccggtaacctaacctaaccgttaacccgtaaaacgtaaaccctaaccgtaacgttacctaactaagtttggtaacggttacgtacggtcggacctagtaaccgtactggtaccggtacggtaccgttaccggtacgttaattacgtttaggtcggtaggaccggtaggtaagggtaacggggtacgggtttacctttaacgttacccggccggtaacgtaggtacggttcgggtaccggggaccggtaacccgggtacggttaccggg

SEQ ID NO: 186330 - DNA, 518 bp, Homo sapiens
  misc_feature: GYAE6OF01EWCXF.42.2.A02.1.454.CMB.1.raw
  modified_base (463)..(463): a, c, t, g, unknown or other
  misc_feature (463)..(463): n is a, c, g, or t
  modified_base (479)..(479): a, c, t, g, unknown or other
  misc_feature (479)..(479): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacacggcccctggacaaggactcgagtggatagggaaatagtctcctagtctcggaataacaaactacgcaacagtaagtttcagggacagacgtcaccattaccgcggaacacataccaactaacacagtctacattgagttgagtggcctgacatctgagactcgacttatacttatgngcgagagaggagggtntaattacncccgntacgactagtgggccagggaccctgg

SEQ ID NO: 186331 - DNA, 726 bp, Homo sapiens
  misc_feature: GYAE6OF01DTED1.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggaggtgaagaagcctgggtcctcggtgaaggtcctccgtgccaaggcttcgtggacggctaacccttcaagtacgcaagtcgctggtcaccgtgggtgccgacgacggtcccctgggaacgaaggctacggagtggataggaaatgtcctccgtagtcgtacggaacttaacgaaactacgacgaactaaggtaagtttcgaagggtcgaagtacgtacaaccgtaagttacccggacgaacaccgaactaccaacgtaaacacgaacgttctaacctagtttagagtttaggaacggttcgggtacctagaccgtagttaccgtaggtaacggtacccggttaccgggtaacccgtttaagttaactttacggtttggtacggtacggaaacggggtaaacgggtagggtaaccggggttaacccgttttaacggtttaaaccccgtccccgggttacgttaacgttaccggttaacgggtttacccgggggtaaacccggtaacccgggttaacccgttcccgggg

SEQ ID NO: 186332 - DNA, 622 bp, Homo sapiens
  misc_feature: GYAE6OF01CDD61.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttcgtggaggcaccttcagtagcaatgctgtcacctgggtgcgacacggccccgtggacgaaggacctcgaggtggagtagggaaatgtctcctagtctcggattaacaaactacgacacagtaagtttcgagggcaagagtacaccgtattaccggacggaaccacgactacccaactaaaccactacgtactaacctattaggtagttagaggttggacccttggaactagtcgtaggagggtaccgtcgggtaccgttaattacgttagttcggtaggtacgaaggtaaggagggtacggggtactttaacgtttaacccgtcccggacttacggtacttagggttaccggggaccgtaacggggtaccccgttacggg

SEQ ID NO: 186333 - DNA, 596 bp, Homo sapiens
  misc_feature: GYAE6OF01DLBFH.42.2.A02.1.454.CMB.1.raw
  modified_base (442)..(442): a, c, t, g, unknown or other
  misc_feature (442)..(442): n is a, c, g, or t
  modified_base (467)..(467): a, c, t, g, unknown or other
  misc_feature (467)..(467): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggagttcctctttgtggtggcagcagctacaggtgtccagtcccaggtgcagctggttcagtcgaggggctgaggtgaagagcctgggtcctcggtgaaggtctccgtgacaaggcttcgtggaggccaccttcagtagcaatgctgtcaccgtgggtgcgacacggcccctggacaaggactcggagtggagtgggaaattggtacctccctagtctacggtaattaaccaaactaccgacaacgaagtaacgtttacgagggacagagtccaacagttaccgcggaacacatacccaactaaacactagtactanattgagttagacgtggcctgacatnagaggacctcggtcgttaattattagttgtgacgaggaggaggacggggtacttaagtttaccgtcccggacttacggtaacgttacggtacgggggccctaaacggggtaccccgttgggtacccccg

SEQ ID NO: 186334 - DNA, 636 bp, Homo sapiens
  misc_feature: GYAE6OF01C7H8U.42.2.A02.1.454.CMB.1.raw
  modified_base (598)..(598): a, c, t, g, unknown or other
  misc_feature (598)..(598): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttctctttgtggtggcagcagctacaggtgtccagtcccaggtgcagctggtgcagtcgaggggctggaggtagaagagccgtgggtcctggtgaaggtctccgtgcgaaggtcttgtggacggcctaccttcgaagtagactaatgctcgtacgaccgtggtcgcgacgaccggccccgtaggacgaaggacgtacggaggtaggagtagggtaatacgtcctaccgtagtcgtacggtaacttaaacaaacgtacgactaacgtaacgtaacgttcgaggactagacgtactaccctacgtaccggacgaaccacgtaactacccaaactaacacgtactactaacgtagttaggtagttagacggtcgtacctagtacctactcgtagacggtacgtccggtacgttacttagttagtggtcggagaggtaggtagggtaacggtcttaaccgttaccgcccgtntacgtacgttacggttcgggaccgacgggttccgtcgg

SEQ ID NO: 186335 - DNA, 876 bp, Homo sapiens
  misc_feature: GYAE6OF01DTWVO.42.2.A02.1.454.CMB.1.raw
  modified_base (249)..(249): a, c, t, g, unknown or other
  misc_feature (249)..(249): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggagttcctctttgtggtgcagcagctacaggtgtccagtcccaggtgcagctggtgcagtcgaggggctggaggtagaagaagccgtgggtcctcggtgaacggtctcctgcaaggtcttcgnggcggctacttcagtacgacaatgctgtccgaccgtgggtcgccgacgaccggccccgtagggaaccgtaaggtccgtaacgggtacggttagggaacgttaagggggaaaactttacggttaccccgttaaccccggttacggttccggttaacgggttaaactttaaaacccaaaaccgttaaccggaccgtaacgtaacggttaaacggttttacggaacggggactaaggtaacgtaccctaaacccgtaacgttaacccgggaccggtaaaccctaaccctaactaccccgtaaaccttaaacccgaacttaacggttacctaacgttagtttaggttaacgggtttacggtaacggttcgggtaccctacgtaaccgtacggtttaaccgtacggggtaacggtacccggttaccgggttaacccgtttaagtttaacggtttacgtttacgggtacggtacgggtaaacgggaagggtaaccgggggttaacggggttacgttttaaacccggttttaaccccggtaccccggttacggttaaccgggttaacggttttaaccggggtaccggggggttaacccccggtaaccgggggtttaaaccccggttccccgggg

SEQ ID NO: 186336 - DNA, 699 bp, Homo sapiens
  misc_feature: GYAE6OF01D3QOL.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttcgtggaggcaccttcagtagcaatgctgtcaccgtggtgcgacacggcccctaggacgaaggactcggaggtggagtagggaaatagtcctccgtagtctacggtaattaacaaactacgaccaacaaggtaacgtttcgaacgggcaaggacgttaccaacccgtaagtttaaccggaccggaactaaccaacgttacccaaaccttaaacccactaacgttactaaccgtatttagtaggtttagacggttacggtcctacgaacctaagttccgtagggacggtaccgttaccgggtacccggtttaattaacttttagtttacgggtcgtaacgggtagtaaagggaaggggtaacgggggttccttaaagttttaaaccccggtccccgtcggttaaccgtaaccgttaacggttcgggggaacccgtaacggggtaaccccgttaccgggg

SEQ ID NO: 186337 - DNA, 741 bp, Homo sapiens
  misc_feature: GYAE6OF01CUG8X.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctggaggtgaagaagcctgggtcctcggtgaaggtctccgtgcaaggcttcgtggaggctacttcagtagcaatgctgtcaccgtgggtgcgacgacggcccctaggacgaaggactcggaggtggagtagggaaatagtctaccgtagtcgtacggaattaaacaaacgtacgacaactaaaggtaagtttacgaaggggtacaaggtaacgtaccaacctaagttaacccggacggaacctaacctaactacccaaactaaaccaaccgtaacgtaacctaactaagtttacggtaggtttacggaggttacgggtccgttacgaactacgttacgtagggtacggtaacccggttccggaaccgtttaacgtttaactttaggtttacggtacggtaccggtaacgggtaaggggtaacgggtaacgggggttacctttaaacggtttaaacccttaccccgggtacgtttaacgggtaaccggtttaacgggttaccgggggtaacccggtaacccgggggtaaaccccggtttaacccgggg

SEQ ID NO: 186338 - DNA, 600 bp, Homo sapiens
  misc_feature: GYAE6OF01EO434.42.2.A02.1.454.CMB.1.raw
  modified_base (288)..(288): a, c, t, g, unknown or other
  misc_feature (288)..(288): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggaggtgaagaagcctgggtcctcggtgaaggtctcctgcaaggcttctggagcaccttcagtagcaatgctgtcaccgtgggtcgcgacncggccctggacgaaggctcgagtggatagggaatgtctcctagtcgtacggaattaacaaactacgacaacgagtaacgtttcgagggacagagtacaccgtattaccgacggacacactaccaactaacacacgtactacagttagagttgagtcggcctagactatcgtaggacggtacgtcggtacgttattagttagttggtgtacggaggaaggtacggtacggggtatttaacgtttaacccgccccggttagtacggtaacgttacgggttacggggacccggtaacgggtaacccgttcccggg

SEQ ID NO: 186339 - DNA, 815 bp, Homo sapiens
  misc_feature: GYAE6OF01CWRIN.42.2.A02.1.454.CMB.1.raw
tcagtgacgtatgtcacgaccggtgctcgatttagactcatctacgagggggagcttcacataacgaccaccttcctcctctaaagaagccccctgggagcacagctcatcaccatggactggacctggaggttcctctttgtggtggcagcagctacgaggtgtccagtcccgaggtgcagcgtggtgcagtcgagggtctggaggtagaagaacgtccgtgggttccgtggtacgtaacggtctaccgtggaccgtaaggtccttcggtggacggtacctaccgttcgaagttacgactaaagtcgtacgtcgtacccgtacggtcggggtacgaccggaccggaccggtaccccgacgggtaaccgaacgggtaccgtaccgggtaggtcgggaagtacggggtaaactacgttacccgttacccgtacggttacgtaacggttaacttaaaccgaaaccgtaacgaccgtaaacgaaggttaacgttacgacggtactaaggtactacccgtaacgtaacggttacccggaccgtaaccaaccgtaacctacccgtaaaacgtaaccctaaccgtaacgttaaccgtaacgttaacgtttaaggtaccggtttagtacggtaccggtaccgtaagaccgttacgttaccggtaggtaaccggtaccgttaccggtaaccgtttaagttacgtttacgtaggtaggtaccggtaggtaaggtacgggtacgggtaactttacggtaaacccgtccgtacggttacgtaaggtaccggttaccgggtaccggaaccggttaacccggttccgg

SEQ ID NO: 186340 - DNA, 754 bp, Homo sapiens
  misc_feature: GYAE6OF01CAD9S.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctggaggtgaagagccgtgggtcctcggtgaacggtctcctgcgaaggtcttcgtggacggctaccgttcgaagtacgcaatcgcgtgtcgtaccgtgggtcgcggacgacggtccccgtaggaccgaaggacctacggaggtggagtagggtaaactcggttacctacccgttaggtcgtacggtaacttaaacgaaacgtacgacgtaacgtaacgtaagttacgagggacaaggtacgtacctaaccgtaacgttacccggacgtaaccgtactaacgtacccgaaacttaaaccgactaaggttacctaagtacgttaggtaacgtttaggacgttacggtacccttacggaactacgtcggtacggtaaccgggtacccgttcgggtaacctttaagttacggttttacgttagggtcggtaacggaagggtaagggtaacggggtacggggttaccttttaaacggtttaaccccggcccgggttagttacgggttaaccggtttaacgggttcccgggggaaacccgttacggggtaaacccccgttacgggg

SEQ ID NO: 186341 - DNA, 674 bp, Homo sapiens
  misc_feature: GYAE6OF01BCX06.42.2.A02.1.454.CMB.1.raw
  modified_base (249)..(249): a, c, t, g, unknown or other
  misc_feature (249)..(249): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctggaggtgaagagccgtgggtcctcgggtgaaggtcctcctgcgaggtcttcgnggacggctaccttcgagtagcaagtgctgtcacgtgggtcgcgacgacggcccgtggacacggtactcggacgtggagtaggtaatcgtcctaccgtagtctacggtaacttaaaccgaaacgtaccgactaacgtaagtaacgtttacggacgggactaaggtacgtacctaaccgtacgttaacccggccggtaacaccgtactacccaactaaacacgtacgtactacgtagttcggtaacggttgaggtcgcttagactagtcgtaggacggtcccgtacggtacgttaattagttacgttcggtaggtacgtaggaacggtaagggtcggttacgttaaacgtttcccggacccggtcgttaacgtacggtttaggggttacccgggaacccggttaaccggggtacccgttacccgggg

SEQ ID NO: 186342 - DNA, 531 bp, Homo sapiens
  misc_feature: GYAE6OF01BPCIC.42.2.A02.1.454.CMB.1.raw
  modified_base (416)..(416): a, c, t, g, unknown or other
  misc_feature (416)..(416): n is a, c, g, or t
  modified_base (465)..(465): a, c, t, g, unknown or other
  misc_feature (465)..(465): n is a, c, g, or t
  modified_base (495)..(495): a, c, t, g, unknown or other
  misc_feature (495)..(495): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagcctgggtcctcggtgaaggtctcctgcaaggcttctggaggcaccttcagtagcaatgctgtcacctgggtgcgacaggcccctggacaaggactcggagtggatgggaaatgtctccctagtctcggattaacaaactacgacacagaagtttcgaagggcagacgtcaccgacttaaccgcggacacatccactaacacagtctacnttgagtgagtgcgtgacatctgaggactcggcgtatattattgtgacgngagtaggagggtacttagttaactcccggntacggtacttagtacggggccagggtacccgtcggg

SEQ ID NO: 186343 - DNA, 571 bp, Homo sapiens
  misc_feature: GYAE6OF01A6XCK.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctggaggtgaagagcctgggtcctcggtgaaggtctcctgcaaggcttcgtggaggcaccttcagtagcaatgctgtcaccgtgggtgcgacgacggccccgtggacgaaggcctcggaggtggagtagggaaatacgtcctacccgtagtccgtacggaattaaacaaactacgacacagtaacgtttcgagggcagagtcactattaccgcgacacactaccactaacactagtactacattagagttgagtggcctgacatctagacggactcggacgttatacttagtgtgcgagaggaggtcgggtacttacgttaacctcccgtacgtacgtaacgttaggttcgggaccgtacgggtaacccgttccggg

SEQ ID NO: 186344 - DNA, 598 bp, Homo sapiens
  misc_feature: GYAE6OF01EVZWV.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctgaggtgaagagccgtggtcctcggtgaaggtctcctgcaaggcttctggagcaccttcagtagcaatgctagtctaccgtgggtgccgtacgaggcccctgggacgaaggactcgaggtggagtgggaaatgtctcctagtctcggtaattaacaaacgtcacacagaacgttcagggtcagacggtacaccgagttaccgacggaccaacgactccaactaacacctacgtactaacctagttagtagttagacgtgggcctagacgtagtccgtaggacgtccgtacggtccgttaatacgttagttcgtgaccggtagagacggtacggggtattacggtttaaccgtcccgcgtacgtacgttacggttagggcccgtacgggtaacccgtaccggg

SEQ ID NO: 186345 - DNA, 669 bp, Homo sapiens
  misc_feature: GYAE6OF01CTIMS.42.2.A02.1.454.CMB.1.raw
  modified_base (244)..(244): a, c, t, g, unknown or other
  misc_feature (244)..(244): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagcctgggtcctcggtgaaggtctcgtgctaaggcttcnggaggctaccttcagtagcaatgctgtcactgggtgcgacacggccctaggaccaaggactcggagtggagtagggaatacgtctccgtacgtcgtacggaatttaacaaacttcggactaacgaacgtaagtttaccgaggggtccaaggtacgttacaaccgtacttaccggacgaactacacgttaccaacttaacactaacgtctaacgtagttacggtaacggttagaacggtttcggaccgttaggaccgtaacgttacgtaggtaacgggtaaccgttccgggaccgttaaggttactttacgtggttacgtaccggaggacggtaggacggggttaccttaagtttaaaccctccccgggtattacggtaaccgttacggtttacggggacccgtaacggggtaaccccgttcgggg

SEQ ID NO: 186346 - DNA, 677 bp, Homo sapiens
  misc_feature: GYAE6OF01E4B1I.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggaggtgaagaagccgtgggtcctcgggtgaaggtcctccgtgcgaaggcttcgtggagccaccttcagtagacaatgctcgtccacgtgggtgccgaccgacggcccccgtaggaaccgaacggacctcggaaggtgggaagtagggtaactacgtacctaccgtacgtccgtacggtaacttaaaccaaacgtacgtaccaacgtaaggttaacgtttacggagggacgtagtacgtaccaacctaacgttacccgccggaaccaacgacctccctaaactaactaaccgacttactaactagttagaggttgtacggtcggtcctagactacgtcgtacggacggtacccgtcggttacgttaattagtttagttggcgaggtaagagggtagggtacgggtaccttaacgtttacccgttcccggcttaggtaacccgttagggttccgggaaccggtacggggtacccgtaccgg

SEQ ID NO: 186347 - DNA, 654 bp, Homo sapiens
  misc_feature: GYAE6OF01AYDR8.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttttggtggcagcagctacaggtgtccagtcccaggtgcagctggtgcagtcgagggctggaggtgaagacgccgtgggtcctcgggtgaacggtcctccgtgaccgtaaggtccttcgtgggacggtcctaccgttcaggtacgctaagtcgctcgtccaccgtgggtcgcggacacggccccgtaggacacggactcggagtggagtagggaaatgtcctaccgtagtcgtacggtaattaaacaacgtacgcaacgagtaacgttcgaggcagacgtacaccgtagtaccgcgacacactaccactaacactacgtactacgtagtaggtacgttggacgtcggcgtagactacgtcgacggtacgtaccgtcggtacgttagttacgttagttggtacggtacgagggacggtagggtacgggttcctttaacggttacccgtcccggtacgttacggtacgtttaacgggtcgggggtaaccctaaccgggggttcccgttcgggtacccgg

SEQ ID NO: 186348 - DNA, 731 bp, Homo sapiens
  misc_feature: GYAE6OF01AB8GG.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgagagctgggtcctcggtgaggtctcctgccgtaaggcttcgtggacggtcctaccttcgaggttaggctaatggcctgtcctaccgtggggtcgaccgtaccgacgggtcccccgttagggaccgaaacgggaccttaccgggaggtacgggtaagttacggggaaaattacgggttacccttacccgtaaggttcctaaccggggtaaactttaaaccgaaaccttaccggaccctaaacgtaacggttaaacggttttacgacggggtactacgggtaacgtcctaaccgtacgttacccggcggtaacaccgtactacccgtaacttaaaccgacgtaacgtcctaacgtacgtttagtaacgttagtacggttcggtacccgtaggaacctatccgtaggacggtaccttacgggtacccttagttaacttacgtgttaggcgtaggagagggtagggtacttaacgttaccgtccgtagttacggtacttagggtaccggggctaaccggggtacccttacggg

SEQ ID NO: 186349 - DNA, 735 bp, Homo sapiens
  misc_feature: GYAE6OF01CH11D.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggaggtgaagaagccgtgggtcctcggtgaaggtctcctgcaaggtctcgtggacggcaccttcagtagcaatgctgtcacgtgggtgcgacgacggccccgtaggacaaggacgtcgaggtggagtagggaatacgtctccgtagtctacggtaacttaaacaaacgtacgacaacgtaggtaacgttacgaggggcaacggtacgtaccaaccgtaacgtttaacccgggaccggtaacctaaccgtaacctacccctaaacctaaaacccgtaaccgtaacgtaaccgttaacttaacgttacggtaacggtttaggaacggttcgggtaccctaggaacctacgtcgtaggtaaccggtacccggtcgggtacccgtttaattacgtttaagttcggtagtaccgggaaggtaagggtacggggtacggggttaacgtttaacgttttaccccggaccccggttacgttacggttaaccggttaaggggttccgggggaaacccggttaccggggtaaccccggttacccgggg

SEQ ID NO: 186350 - DNA, 743 bp, Homo sapiens
  misc_feature: GYAE6OF01A2IQ8.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggaggtagaagaagccgtgggtcctcggtgaaggtctcctgcgaaggtcttcgtggaggcctaccttcgaggtacgactaagtcgcgttcgtacctaccggtggggtcgacgaccgacgggaccccgtaggaccgaacggaccgtacggaggtaggtaaggttagggaaattacggtcccttacccgttagtccttaccggtaaacttaaaccgaaacgttaccgacgtaacgtaaggttaacgtttaccggaaggggtacaacggtacgttacccaacccgttaacggttaccccggacggaacccaaccgtaaccttaacccgaaaccttaaaccaaccgtaacgttacgtaacctaagtttacggtagttagtaacggtccgactacgactagttcgtagcggtaccgttccggtacgtttaagttacgttagttcggtacggacgtagggaagtacgggtacgggttattaaccgtttaacccgcccggttagtaccgttacgttagggtacggggaacccgtacggggttcccgtaccggg

SEQ ID NO: 186351 - DNA, 667 bp, Homo sapiens
  misc_feature: GYAE6OF01C6KKR.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctggaggtgaagaagccgtgggtccgtcggtgaaggtcctccgtgcgaacggtcttcgtggagctaccttcagtagcaatgctgtcaccgtggtgcgacgcggccccgtggaacgaaggacgtacgaggtaggagtaagggtaaatacgtcctacccgtagtcgtacggtaacttaaacaaactacgacaacgaagtaagttcgaggcagacgtacacctacttaccgacgaacacgtactaccaactaacactacgtactactatagtagttaggagttcggtctacgtactagtacgtaggaaccggtaccgtaccgggtaccgtttatttaacgtttaggttaggtacggtaaggacggtaaggaacggggtacgggttacctttaaacgtttaaaccccgttccccgtacgtacggttaacgttacgggttacggggaacccgtaacccggggtaacccgttaccgggg

SEQ ID NO: 186352 - DNA, 783 bp, Homo sapiens
  misc_feature: GYAE6OF01E3SYP.42.2.A02.1.454.CMB.1.raw
  modified_base (249)..(249): a, c, t, g, unknown or other
  misc_feature (249)..(249): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctgaggtgaagagccgtgggtcctcggtagaaggtctcctgactaaggtcttcgnggacggtcctaccttcgagtacgacctaagtcgccttgtacctaccggttggggtcgaccgaccgacgggtccccgtaggaaccgaacgggtaccgtacggaggttagggaagttaaggggtaaaacttaccggtaccgttaccccgttaaggttaccgttaacggggtaaactttaaaaccgaaaccgtaccggtaccaacgtaacggttaacggttttacggaaggggtacctaaagggtaccggtaccctaaacccgtaacgttaaccccggacgggaccctaactaccgtaccctaaacctaacctaacgtacgtactaaccgtagttaggtagtttacgaggttcgccttagacctattcgtaggacggtaccgtacggttaccgttatttaacgttacgtacggtggacggtaagggaacggtacggggtaccggggtttactttaaaccgtttacccggtacccgtacggttacgtacggttacgggttaccggggaccgggtaaaccgggtacccgtttaccgggg

SEQ ID NO: 186353 - DNA, 540 bp, Homo sapiens
  misc_feature: GYAE6OF01A8B3E.42.2.A02.1.454.CMB.1.raw
  modified_base (504)..(504): a, c, t, g, unknown or other
  misc_feature (504)..(504): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcaactacaggtgtccagtcccaggtgcagctggtgcagtcgaggggctgaggtgaagaagcctgggtcctcggtgaaggtctcctgcaaggcttcgtggaggcaccttcagtagcaatgctgtcaccgtgggtgcgacacggcccctggacaaggactcgagtggagtgggaaatagtctccctagtctcggattaaacaaactacgacacagaagtttcgaggcagagtcacatacgcgacacgactccaactaacacagtactactattgagtttgagtggcctagacatcgagaggactcggaccgttatacgttatgtgcgtagagagggagggtctagtttaactcccgntgacgttagttcgggaccacgggaaccgtggtaccg

SEQ ID NO: 186354 - DNA, 745 bp, Homo sapiens
  misc_feature: GYAE6OF01AU7RP.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagcctgggtcctcggtgagtctcctgacaggtcttcgtggaggcacttcgagtagcaagtgctgtacacgtgggtcgccgtacgacggtccccgtagggaccgaacgggtacctcggacggtagggaacgtaaggggaaaacttacggttacccgttaccttacgggttaccgttacggggtaaactttaaaacctaaaccgtacggtaccaacgtaaggttaacgttacgaacgggcaaggtacgtaccaccgtacgtacccggacggactaccacgtaccaactaaccgactacgtactaaccgtaagttcggtaagttacggacggtccggtactacgaactacgttccgagggtaccggtacgttccgggtaccgtttaagttacgtttacgttacggtcgtaccggaaaggttacgggtaaacgggtacggggttacctttaaaccggtttttaacccgcccggtaactttaccgggtaccgtttaacgggttaccgggggaacccgttacccgggggttaacccttacccgggg

SEQ ID NO: 186355 - DNA, 671 bp, Homo sapiens
  misc_feature: GYAE6OF01EEC6A.42.2.A02.1.454.CMB.1.raw
  modified_base (532)..(532): a, c, t, g, unknown or other
  misc_feature (532)..(532): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggaggtgaagaagccgtgggtcctcggtgaggtctctgacaggcttcgtggacggctaccttcgagtacgactaagtgtctcgtcgaccgtggtcgccgacgaccggtccccgtaggaaccgaaggtaccgtacggtaggtacggaagtagggtaaacgttacgtccgttacccgttagtacgtacggtaacttaaaccaaaccgtaccgacgaacgtaacgtaaggttacgaacgggtacgaagtacgtaccgaccgtaaccgttaccggacggaacaccgtaactaccctaaacctaacacgtacgttaactacttaagttacgtagttacgnggtccgtctagacctagtcgtaggacggtccgtacggtcgttaattagttagtggtgtagaggaggtacggaggttacttaacgttacccgccgtatacgtacggttacggtcgggtaccctaacggggtcctacccgg

SEQ ID NO: 186356 - DNA, 777 bp, Homo sapiens
  misc_feature: GYAE6OF01AF0UT.42.2.A02.1.454.CMB.1.raw
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttggtggtggcagcagctacgaggtgtccagtcccaggtgcagctggtgcagtcgagggctggaggtagagagccgtgggtcctcggtgaagtcncgtgcgagcttcgnggacgcctacgtcgagtacgacagtcgtctcgtaccgaccggtggggtcgaccgaccgtaccggtccccggtaggaaccgaacggtacgtcgggtaggtagggtagtaacgggtaacttacggtcccttaccgtacgtaccgtacggtaacttaaaaccgtaaacgtacgtaccgaacgtaaggtaacgtttacggaacgggtaccgtaaggtaaccggtaccaaaccgttacggtaacccgtacggaactaccgtaaccacctaacctaaccaacgtcgtaactacgtagttacgaaggtttcgaacggttcgacgtacgaacccgttagtccggtaacgtacggtacccgttacgggttaccgttttaacttagtttacgggttacgtacgggtacggtaaacggtaagggttacggggtaccggtttaaacttttaacccggtttaacccggccccggtaacgttacgggtaacccgtttagggtaccccgggggtaaccgtaacccggggtacccggtttacccggg

SEQ ID NO: 186357 - DNA, 672 bp, Homo sapiens
  misc_feature: GYAE6OF01EIM5F.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagcctgggtcctcggtgaaggtctcctgcaaggcttcgtggacggcaccttcagtagcaatgctgtcaccgtggtgcgacgacggccccgtaggaacgaacggacgtacgtaggtggaacgtagggaaagttagttaccgtacccgtagtcgtacggtaacttaaacaaacgtacgacacgtaagtaacgtttacgagggtacaaggacgtacgaaccgtacgttacccggacggtaaccgacctaacgtaccctaacctaaaccacaacgtactactagttagtagttggtacgtcggtccgtagactacgtcgtacgtacggtacgtcggtaccgttaagttagttagttggtgtacgacggtaagtaggggtacggtacgtttaacgtttaacccgtacccgtcgttaacgtaccgttacgggttaccggggacccggttaaccggggtaacccgttacccggg

SEQ ID NO: 186358 - DNA, 708 bp, Homo sapiens
  misc_feature: GYAE6OF01AJ902.42.2.A02.1.454.CMB.1.raw
  modified_base (193)..(193): a, c, t, g, unknown or other
  misc_feature (193)..(193): n is a, c, g, or t
  modified_base (222)..(222): a, c, t, g, unknown or other
  misc_feature (222)..(222): n is a, c, g, or t
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatcgacccagtcctccttcctccctgtctgcatctgtagganacagaactcaccatcacgttcggccgggnagtcaggtcagttggtacgttagtttttcgccgttaggtatcgaacgtaccaaaaccgtggaccacgtacgttacctaacgtcctcctactactttcctttcctcgttcctttaccgttactttcgacctaacgtccgtaccgggttccctacttccgttccgtccgttaccgacggtccgggtcgggtcggtaccgttacggtcgggacgtacggttactttaccaccttcctacctacctacgtaccgacgccgtacccggtccgtacgaccggtacgtaccgtaggtaaagtcgttaagggttacggtaacttagttacgtacgtagtaaacgtttattaacgtttacgtttacgtccttccgttccgttacggttaccggggttacggggtaccgggggtaaccgtaaggggtacggtaagaaccgtaaccggtaaccggtacgttacggtacggtaccgacgtacccgtactcgttcccgg

SEQ ID NO: 186359 - DNA, 640 bp, Homo sapiens
  misc_feature: GYAE6OF01EAM8P.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctgaggtgaagagcgtgggtccgtcggtgaaggtctccgtgcgaggcttcgtggaggcctaccttcagtagacaagtgctgtcaccgtgggtcgcgacgacggtccccgtaggaacgaacggcgtacggaggtagggagtagggaaatacgtcctaccgtagttaccgtacggtaacttaaaccaaacgtacgacaacgtaagtaagttacgagggacagacgtacactacgtaccgcgacacactaccaactaacacactctaactagtagagttgagtcggtctgactatcgtgacgtccgtacggtaccgttaattacgttagttggtaggtacgaaggtaagggtagggtaacggggttacttaaccggtttaacccgcccggtacgttacgtaacggttacgggttacgggacccgggtaaccgggtacccggttaccggg

SEQ ID NO: 186360 - DNA, 893 bp, Homo sapiens
  misc_feature: GYAE6OF01EIXZX.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctgaggtgaagagccgtgggtcctcggtgaaggtctcctgacaaggtcttcgtggaggtccaccttcgaggtagcaatgtctgtccaccgtggggtgaccgaccgaccgggaccccgtaggaaccggaacggtacctacgggtaagggtggaacggttaggggtaaaaacttacgttacccgttaccccgttaacggttaccgttaaccggggtaaaactttaaaacccgaaaaaccgttacccggaacccgtaaaccgtaaaacgggtttaaacggttttaccggaaacgggggtacccgtaaagggtaaccggttaacccaaaccccgttaaacggtttaaccccggggaacccgggtaaaccctaaacccgttaaccgtaacccccctaaaaccgttaaaaccctaaccgtaaaccgtttaaccgttaaacctaagtttaacgggtaacgtttagggaacgtttccgggtaccgttaacgaaccgttaacgttacggtacggaaaccgggtaaccggttacccggttaacccgtttaagttaacgtttaggttcggtaaggtccgggtaaaagggaacgggtaacggggtaacgggttaccttttaaaccggtttaacccgtaccccggtagttacggtaacgtttaacggggttccgggggaacccgtaaaccgggggtaaccccgttacccggg

SEQ ID NO: 186361 - DNA, 776 bp, Homo sapiens
  misc_feature: GYAE6OF01CYR0J.42.2.A02.1.454.CMB.1.raw
tcagtgacgtatgtcacgaccggtgctcgatttagactcatctacgagggggagcttcacataacgaccaccttcctcctctaaagaagcccctgggagcacagctcatcaccatggactggacctggaggttctctttgtggtggcagcagctacgaggtctccagtcccgaggtgcagcgtggtgcgagtcgagggctggaggtagaagaacgccgtgggtcctgggtagtaacgtcgtcctgacgaggtcttcgtgggacggtcctaccgttagagtacggacaaagtgtacgttcggtaccgtacggttcgggtcgaccggtaaccggtaccggtaccccgtaaggaccgtaaacgggtaccgtacggtaggtagggtaaggtaagggtaaactaccggttaccgtacccggttacgtacgttaacggttaaacttaaaacgaaacgtaccgaacgtaaccgtaaagttaacggttacggacgggtacagtaacgtacaccgtacgtaccgacgactaacgactaccaacgtaacacgtactaactacgtagtacgtagtacgtaggtcgtaccgtagaccttagtacggtaacggacggttaaccggtccgttaaccgtaagtttaaccgttaggtacggtggtaacggacggtaagggtaagggtaccggggttaactttaaccgtttaccccgggaccgttacggtaaccggttaacgggttacggttacccggggacccgggttaaccgggtaacccggtttacccgg

SEQ ID NO: 186362 - DNA, 904 bp, Homo sapiens
  misc_feature: GYAE6OF01AVH4V.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctgaggtgaagaagccgtggtcctggtgaacggtctcctgcgaaggtcttcgtggacggcctaccgttcgaaggttacgacctaagtcgaccttcggtacccgtaccggtggggtccgtaccggaaccggtaccgggtacccccgtagggaaccgtaaacgggaccgttaccgggaaggttacgggtaacggttaacgggggtaaaacttacggttcccgttaaccccggttaaggttacccgttaacggggtaaactttaaaaccggaaaccgttaaccggaccttaaaacggtaaggttaaaccgttttaccggaacggggtacctaacgggtaaccggttaccaacccggttacgtttaaccccggggaccggtaaacctaaccgtaaccgttaccccgtaaacccgttaaacccgaaccgtaacgggttaacctaaccgttagtttacggtaaggtttacggacgggttaccggtccgtaacggtaccgtaagttccggtaggtaaccgggtaccgttccgggtaaccgtttaacgtttaacgtttacggttacggttacgaccgggtaaggtaaaggggtacgggtaacggggtttacctttaaccggtttaacccggtcccccggtacgtttacgggtaaacccggttttacgggtacccgggggtaacccgttaaaccggggttaccccggtttaacccgggg

SEQ ID NO: 186363 - DNA, 683 bp, Homo sapiens
  misc_feature: GYAE6OF01DAXKC.42.2.A02.1.454.CMB.1.raw
  modified_base (174)..(174): a, c, t, g, unknown or other
  misc_feature (174)..(174): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggagttcctctttgtggtggcagcagctacaggtgtccagtcccaggtncagctggtgcagtcgaggggctggaggtgaagagccgtgggtcctggtagagtcctctgcaaggtcttcgtggaggtcctaccctttcgaaggttacgactaagtcgtactcgtaccacccggttggggtacgaccggacgaaccggacccccgttaagaaccggtaacggaccgtacggaggtaggagtaagggtaaactacgtcctaccgtagtcgtaggtactaaaccaactacgacacgtaagtacgttagaggnacgngtacacacgtaccgcgacactacacaactacacgtacgtactactagtcgtaggtcgtagcgtcctgactacttagtggacggttcgtaccggtaccgttatttaggttacgttggtaccggacggtaagggtacggtaaagggtaccgggttaacttttaacggttttaacccgacccggtacgttacgtaacgggtttacgggtccgggaaacccggttaaaccggggttcccgttaacccggg

SEQ ID NO: 186364 - DNA, 552 bp, Homo sapiens
  misc_feature: GYAE6OF01EL843.42.2.A02.1.454.CMB.1.raw
  modified_base (371)..(371): a, c, t, g, unknown or other
  misc_feature (371)..(371): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagccgtgggtcctcggtgaaggtctcctgcaaggcttgtggagcacttcagtagcaatgctgtcaccgtgggtgcgacacggccccgtggacgaaggactacggagtacggagtgggaaatagtctcctagtctcgaattaacaaactacgacacagtaagttacnggtacagatcacatacgcggacacgataccactaacacactactacattgtagttgagtcgtccgtagactagtctcgacggactcggaccgttatattagttggtgcgagagaggtacgggtattacgttacgcccgtgtacgtacgttacggttacgggccgtacgggtacccgtacgg

SEQ ID NO: 186365 - DNA, 730 bp, Homo sapiens
  misc_feature: GYAE6OF01EZCI5.42.2.A02.1.454.CMB.1.raw
tcagtgacgtatgtcacgaccggtgctcgatttagactcatctacaggtggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttcgtggaggcaccttcagtagcaatgctgtcaccgtggtgcgacacggcccctggacaaggctacggacggtggagtgggaaattcgtctccctagtcgtacggaattaaacgaaactacgacaacgtagtaacgtttcgagggacaaggtacgtacaccgtaagttacccgacggtaccaccgtaactacccgaacctaaaccaccgtaacgttaccctaactagtttacggtacgtttacggaacggttcggtacccgttagtaaccgtacgtaccgtaggtacgggtaaccgttccgggtacccggtttaacgtttaacgtttacgtttagggttaccgggtaaccggtaacgggtaaagggtaacgggtaaggggggtaaccttttaaacggttttaaaccccggttccccgttaacggtttacgggttaacccgtttaagggttttccgggggtaacccgtaaccgggggttaaaccccccggg

SEQ ID NO: 186366 - DNA, 875 bp, Homo sapiens
  misc_feature: GYAE6OF01CO8UU.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggaggtgaagagccgtgggtcctcggtgaaggtctccgtgacgaaggtcttcgtggacggctaccttcgagtagctaagtgctgtcaccgtgggtcgcgacgacggccccgtaggaccgaacggacgtaccggtaggttagggaacggttaaggggtaaacgttacggttacccgttaacccgttaacggttaccgttaaccggggtaaacttttaaaacccgaaaaccgtttaaccggaaccgtaaaccgtaaacggttaaacggttttaccggaaacgggggtaccgtaaacgggtaacggttaacccgtaaaccccggttaaacggttttaaccccggggaacccgggttaaacccggaaacccgttaaaccttaacccccgtaaaacccgttaaaaccctaaaccgtaaaccggtttaacccttaaccggttaacgtttaacggggtaacggttttaacggaacgggtttaccgggttaacccgtaacggtaaaccgtacggtttaaccgtacgggtaaaccgggtaacccgttaccgggttaacccgtttaaagtttaacgttttacggttaagtcgggtaaccggtaaggacggtaagggtaacgggtactttaaacgttacccgtccgtacgtacgtacgttacggtcgggacctacgggtaccgtaccgg

SEQ ID NO: 186367 - DNA, 826 bp, Homo sapiens
  misc_feature: GYAE6OF01ELFTE.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgccagcgtggtgcagtcgaggggctggagggtagaagaacggccgtgggtccgtcggtagaacggttcctccgtgccgtaagggtccgttcgtgggacggcctaccgttacgagtaacggctaaggtgtaccgttcgtaccgaccggttggggtacgacccggtacccgaccggggtacccccgttagggaaacccggtaaacggggtacccgtaccgggaaagggttaggggtaaggttaacggggaaaacgtttacgggttaccccgttaaccccgttaacggttcccgttaacgggttaaacctttaaaaccggaaaccgttaaccggaaccgtaaaccgtaggttaaacggtttacgaacggggtaccgaacggtaacggttacccaaccgtaaccggttaacccgacggtaacctaaccggtaactaccctaaaccgaacgtactaacgtactaacgtacgttagtagttaggacgtacggtcgtacgtactactcggtaagacggtaccgttacggtaccgttaattacgttacgttcgggtagtaccgggtaggaggtaagggtgggttaccttaacggttttacccgcccgtagtaccgtacggttacggtaccggggacggtacccgggtacccggtaccggg

SEQ ID NO: 186368 - DNA, 745 bp, Homo sapiens
  misc_feature: GYAE6OF01BEU7G.42.2.A02.1.454.CMB.1.raw
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (686)..(686): a, c, t, g, unknown or other
  misc_feature (686)..(686): n is a, c, g, or t
  modified_base (734)..(734): a, c, t, g, unknown or other
  misc_feature (734)..(734): n is a, c, g, or t
tcagtgacgtatgtcacgaccggtgctcgatttagactcatctacagggggaagtctctctcagtcaggacacagcttggacatgagggtccctgctcagctcctgggacctcctgctgctcgtcggctcccagactaccagtatgtagacatccagatgacccagtcctccttcctccgtgtctgctatcgtgtagganacagaacncaccatcacgtcggcccggtagtatcgaggtactaggttacggtcgtttaagtttttacgccgttaggttacttaccgaacgaaaccgtaaaaaccgtggacctaacgttaccgttaccgaactccttacctactacgtttcctttccgtcttacctttaccttacgtttacgaccgttaacgtccggtaacccgggttacctacgttccgttccgtcttaccggcggtccgggtcggtcggtccgtacggttacggtaacgtaagttccttaccctacttacccgtactaaccgtactaccaggtccacccgtcgtacgaccgacggtaccgtaaggtacgtaacgtttacggtaacgtaaacgtttcgttaacgtacgttaactaaagtttacgttaaacgttttaccgtttaccgacttccgttacggtccggtttaaacggggttcccggggaacggggtaacgtacggggtanaacgggttaactaaacccggtaaagtcggtacgtacggctaccgtacnctaacgttccg

SEQ ID NO: 186369 - DNA, 691 bp, Homo sapiens
  misc_feature: GYAE6OF01EA14F.42.2.A02.1.454.CMB.1.raw
  modified_base (162)..(162): a, c, t, g, unknown or other
  misc_feature (162)..(162): n is a, c, g, or t
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (435)..(435): a, c, t, g, unknown or other
  misc_feature (435)..(435): n is a, c, g, or t
  modified_base (456)..(456): a, c, t, g, unknown or other
  misc_feature (456)..(456): n is a, c, g, or t
tcagtgacgtatgtcacgaccggtgctcgatttagactcatctacgagggggaagtctctctcagtcaggacacagcttggacatgacgggtccctgctcagctccgtgggactctgctgctcgtcggctccagactaccagatgtgacatcagatcgaccngtcctccttcctcctgtctgctatcgtaggagganacgaanactcactatctacggtcggcggatacgtcgtaggtactaggttcggtacttagttttacgccgttaggtatacgaacggaaacctaaaaccgtcggtacactaccgttaccgtaactcctccttatacttctttcctgtcttacttacgttacgtactaacgtcgaccggtcctacgtcgtacgtctacggacggtcggtcggtcgtcgtacggtaggtactagtcgttacnctcgttaccactactcgaacncgacctaccgtgaccgtacgtaccgtagtaacgttaggtagttaacgtaaacgttagttcgtaacgttactaaacgtttacttaacgttacgtttccgttcctacgttaccggttaaccggttacgggggttaccgggggaacgggttaacggaacggttcgggtaaagtaacggaaaaccgttacgggtacggtacgggtacgtaccgtaccgtacgtaccttaaggtttcccg

SEQ ID NO: 186370 - DNA, 633 bp, Homo sapiens
  misc_feature: GYAE6OF01DLHEF.42.2.A02.1.454.CMB.1.raw
  modified_base (253)..(253): a, c, t, g, unknown or other
  misc_feature (253)..(253): n is a, c, g, or t
  modified_base (270)..(270): a, c, t, g, unknown or other
  misc_feature (270)..(270): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttccttctttgtggtggcagcagctacaggtgtccagtcccaggtgcagctggtgcagtcgaggggctggaggtgaagaacgccgtcgggtcctggtggaacggtctccgtgcaggtcttcgnggcgcaccttcagtagnaagtgctcgtccgtaccgtgggtcgccggtacgacggccccgtaggacgtaacgcgtcggaggtggagaggtaatagtcctcctagtcgtacgtaattaaacaactacgcactagtagtcgaggtacagtacgtacaccgtacgtaccgacgaacactaactccaacctactaacacgtacaactagtgtagttagacggtcggtcttagactagtcgtaggaacggtcgtcggtaccgttaattagtttagttacggtggtacgtaagggacgggtaagggtacggttacgtttaactttaacccgtccccggtaagttacgtacggttacggtccggggtaaccgaccgggtaccgtacgg

SEQ ID NO: 186371 - DNA, 897 bp, Homo sapiens
  misc_feature: GYAE6OF01BBLWC.42.2.A02.1.454.CMB.1.raw
  modified_base (191)..(191): a, c, t, g, unknown or other
  misc_feature (191)..(191): n is a, c, g, or t
tcagtgacgtatgtcacgaccggtgctcgatttagactcatctacagggggaggcttcacataacgaccaccttccctcctcctaaaggaagtcccctgggagtcactagctcactcgaccataggactggacctggacgttctcgttggtggtgcagcaggctactggtgtccgagttaccgaggtcgcngcgtggtgaccagtcgaggggtctggaggggtacaagtaacgcccgttcggggtccggtcggtagaacggttcctccgtggcctagtcggtccttccgtaagggccggtactacccgttacgtaacggtactaccgtaacgttggtaccgtacgttccgtaaccggttcgggtccggtacccggacggtacccggggttacccccgggtaggggtaaacccgggaaacgggtaccggtaccgggttaaccggtacggggttaagttaacggggtaaaacttaccggtttacccgttaacccggttacggtaaccggttaaccggtaaaccggtttaaaaccttaaaaacgttaaccgtaacccggtaaccgttaaaacggtaaccggttttacgggaaacgggggtacccggtaaacggttaaccggttaccgaaaccgtaacccgggttacccggaaccgggttaaacccaaccgtaacgttaacccgaaacccgtaaccgaaacctaaggttaacctaccgttaagttagtaacggtttacgaacggtccgaacgttaacgacgtactacggtaacggtaacggtacgttaccgacgttacgtaattgttagtacggtgtaagtagggtcgtacgggttactacggtttacccgtcgcggttacgtaaccggttgggacccggtaacggtcccggttaaccggg

SEQ ID NO: 186372 - DNA, 834 bp, Homo sapiens
  misc_feature: GYAE6OF01BNDZR.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacgaggtgtccagtcccaggtgcagtctgggtgcagtcggaggggtctggaggtgaagaacgtccgtagggttcccgtggtagtaacggtcctccgtgacgaaggtccgttcgtgggacgtcctaccttgacggtacgactaagtcgtacgtcggtacctacggttcgggtacggaccggtaccggaccggccccggtacggtaaccgaacggtaccgtacggtaggtacggtagtaacgggtaagttacgtacccgttaccgtacgtaccgttaacggtaaacttaaaaccgtaaacgtaccgtaacgaaccgtaaggttaaacgtttacggaacgggtacgtaaggtaccgtaacgtacccgtaacggtaccccgtaacgaaccgtaactaaccgtaaccctaactaaacccgactacggttactaaccgtagtttacgtaggtttacggtacggttccggtaccgtaacgttaaccgtacggtttacgaaccggggttaacggaccggttaccccgggttaagtttacgttaacgtttacggttacggtaccggtagggtaacgggtaaggggtaacgggtaacgggtttaacgtttaaccggtttaaccggtacccgttacggtacgttacgttaccgggtacgggaacccggtaccgggtaccccgttaccgggg

SEQ ID NO: 186373 - DNA, 770 bp, Homo sapiens
  misc_feature: GYAE6OF01C7R81.42.2.A02.1.454.CMB.1.raw
  modified_base (142)..(142): a, c, t, g, unknown or other
  misc_feature (142)..(142): n is a, c, g, or t
  modified_base (178)..(178): a, c, t, g, unknown or other
  misc_feature (178)..(178): n is a, c, g, or t
  modified_base (261)..(261): a, c, t, g, unknown or other
  misc_feature (261)..(261): n is a, c, g, or t
  modified_base (264)..(264): a, c, t, g, unknown or other
  misc_feature (264)..(264): n is a, c, g, or t
  modified_base (353)..(353): a, c, t, g, unknown or other
  misc_feature (353)..(353): n is a, c, g, or t
tcagtgacgtatgtcacgaccggtgctcgatttagactcatctacagggggagcttcacataacgaccaccttcctcctactaaagaacgcccctgggagcacagctcatcaccatggactggacctggacgttcctcttgnggtgcagcagctacaggtcgtccagtccgaggtgcngctggtagcgagtcgagggctggaggtagaagacgtcgtcgggtccgtaggtagaacggtcctcgtcgacgtaaggccttagnggngtacctaacctcgagtacgtataacgtgtctacgtccacggtgggtagccgacgtaccggcccgtaaggaaccgtaacgggcctacggnggttaggaggtaacgggtaattacggttccgtaccctaggtccgtaaccgtaacttaaaccgaaaccgttacgaccgtaaacgtacgttaaacggttcgaacgggcaaggtaacgtacccgaaacccgttaacgttaccgggaaccgaccgaccgtaacctacccgtaaacctaaacgtaccgtaacgttaacctacctaagttacgttaacggttacggtacggttacggtaaccgtacgaacccgtaacgttaccgtagggtaccgtaacggtcccggtaacgtttacgttaagtttacgttcggttaggaccggtaggtacggtaacggtacgggttaacttaacggttaccgtcccgtacgtacggtaccgtttaagggtccggaaccggtaaccgggtcccggttaacccgg

SEQ ID NO: 186374 - DNA, 749 bp, Homo sapiens
  misc_feature: GYAE6OF01D1R51.42.2.A02.1.454.CMB.1.raw
  modified_base (175)..(175): a, c, t, g, unknown or other
  misc_feature (175)..(175): n is a, c, g, or t
  modified_base (254)..(254): a, c, t, g, unknown or other
  misc_feature (254)..(254): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtncagctggtgcagtcgaggggctggaggtgaagaagccgtgggtcctcgggtgaacggtcctccgtgcgaaggtcttcgnggacggcctaccttcgagtacgacaatcgctgtcgtacgtgggtcgcggacgacggtccccgtaggaccgaaggtacctcggaggtggagtagggtaaattcgtaccgtaccgtagtactacggtaacttaaacgaaactacgactaacgagtaacgttcgaggacaggtacgtaccaaccgtacgttaaccggacgtacaacctacgtaccctaaactaaacgacctacggttaccttaaaccgtagtttacggtaacggtttcggtaacgggttaccggtacccgttaggaaaccttaggttaccggtagggtaaccggtaccgttaccggtaacccggtttaatttaaccggtttagttacgggtaggtacggtaagggtaacgggtaagggtaacgggtttacccgtttaaccggtttaacccggcccgttagtaccggttacggttacgggttaccgggacccggtaaccgggtaaccccgttacccggg

SEQ ID NO: 186375 - DNA, 780 bp, Homo sapiens
  misc_feature: GYAE6OF01ER15Q.42.2.A02.1.454.CMB.1.raw
tcagtgacgtatgtcacgaccggtgctcgatttagactcatctacagggggagcttcacataacgaccaccttcctcctctaaagaagcccctggggagcacagctcatcaccatggactggacctggaggttcctctttgtggtggcagcagctacaggtgtccagtcccaggtgcagctggtgcagtcgagggctggaggtgaagagccgtgggtcctgggtgaggtctccgtgacaggtcttcgtggacgcaccttcgagtacgcaatgctgtcacgtgggtcgcgacgaccggcccgtaggaaccgaagggaccgtacggaggtaggagtagggtaaacttacgtacccgttacccgtacggttccgtacggtaaactttaaaccgaaaccgtacggacaacctaaggtaacggtttacggacggggtacaacggtacgttacccgaacccgtaggtttaacccgggacggtaaccctaacgtaaccgttaccccaaaccggttaaccaaccgtaacgttacttaaaccgtagttttaacggtacggttacgggtaacgttccgggttcctaacgtaccgtagttccgtaagggtaccggtaccgttaccgggtacgtttaaacgttactttaaggttcggtcggtaacggtacgggtaaagggtacgggtacgggggttaccctttaaacggtttacccgaccccgggttataccgggttaacggttacgggttaccgggggacccgtaacccgggggtacccgtttacccgggg

SEQ ID NO: 186376 - DNA, 681 bp, Homo sapiens
  misc_feature: GYAE6OF01BJDN4.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctgggacggttccttcgtttggtgggtggcagcagctacgaggtgtccagtcccagggtgcagctggtgcagtcgagggctgaggtgaagagtccgtgggtctcgggtgagtctcgtgacgaggtcttcgtgggagcctaccttcgagtagcaagtgctcgtcgtacgtggggtcgaccggtacgaccgggccccgtagggacgaacggacgtaggacggtaggaaggtagggtaacttacggtccttaccgtagtaccgtacggtaactaaactaaccgtaacgacgaacgaaggtaacgtttcggaagggacgacggtacaccgactacgtaccggacgaacacactaccgaactaaccgactactacctatacgttacgtagtcgagttcgcttagactagtcgacgggtacgtccggttacgtacgttaattagtttacgtagttcgggagtaacggaggtaaccgggtagggttaaccttaaccgtttaccgaccggtactaaggttaccggttagggtacccggggtaacgtacccgggtacggttacccgg

SEQ ID NO: 186377 - DNA, 692 bp, Homo sapiens
  misc_feature: GYAE6OF01B796I.42.2.A02.1.454.CMB.1.raw
  modified_base (141)..(141): a, c, t, g, unknown or other
  misc_feature (141)..(141): n is a, c, g, or t
  modified_base (175)..(175): a, c, t, g, unknown or other
  misc_feature (175)..(175): n is a, c, g, or t
  modified_base (184)..(184): a, c, t, g, unknown or other
  misc_feature (184)..(184): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgnggtggcagcagctacaggtgtccagtcccaggtncagctggtncagtccgaggggctggaggtagaagagccgtgggtcctcgggtagtaacggtctccgtggacaagggtcttcgtagggacggactaccttcaaggtagactaagtgtcttgtccgaaccgttgggtacgacggaacgaccgggtaccccgtagggaacgaacgggtacctacggacggtaggagtaagggaaatacggtcctaccgtagtcgtacggaattaaacaaactacgacaacgtaagtaagtttaccgaggtacgaaggacgtaccgaacctaacgttaccgacggtaacactaaccgtaccaactaaacgacaagttactaactagtagtaggttagacgtaggtcctagactagtcgtacggaacggtacgttccggaacgtttattaagttacttagtaggacggtaggaggtagggtacggttacttaacgtttaaccgcccgtattaacggtacgttaagggttaccgggaaccgtaaccgggtacccgttaccggg

SEQ ID NO: 186378 - DNA, 718 bp, Homo sapiens
  misc_feature: GYAE6OF01EMW56.42.2.A02.1.454.CMB.1.raw
  modified_base (162)..(162): a, c, t, g, unknown or other
  misc_feature (162)..(162): n is a, c, g, or t
tcagtgacgtatgtcacgaccggtgctcgatttagactcatctacagggggagcttcacataacgaccaccttcctcctctaaagaacgcccctgggagcacagctcatcaccatggactggacctggacgttcctctttgtggtggcagcagctacaggtntccagtcccaggtcgacagcgtggtgcaggtcgagggctggaggtagaagagccgttggggtcctgggtagaacggttcctcgtggactaaggtcttcgtagggacgtacctaccttacgagtacgacaagtgtctcgtaccgacggtgggtcgaccggacgaccggtaccccggtaggaaaccgtaacggtacccgtacgggtaaccggtagggtaacggttaacgggtaaacgttaccggttacccgttaccggtacggttaccgtaaccgggttaaaacttaaacccggaaaccgttaccgaacgtaaccgtaaggttaacgttacggacggacgtaacggtacggtaacctaacccgtacgttaccgaccggaacctaactacctaccaactaaccgactacgtacctatacgttagtagtagacgtacgtacgagactagtcgtaggacgtacgtccgtacgttatgttacgtgtcgacgaggagtacggtaggtacttaacgttaccgcgtacgtacgtacgtacggtacgggcctaacgggccctcggg

SEQ ID NO: 186379 - DNA, 585 bp, Homo sapiens
  misc_feature: GYAE6OF01DWYX8.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctgaggtagaagaagcctgggtcctcggtgaaggtctccgtgcaaggtcttcgtggacgctaccttcgagtacgcaatgctcgtcaccgtggtcgcgaccgacggccccgtaggacgaaggacgtcggagtggagtagggtaaatagtcctaccgtacgtcgtacggtaacttaacgaaacctacgactagagtaagttcgaggacacgacgtacaacgtacgtaccggacgacactactaccaactaacacacgtacatagttgtagtgagtcgactagactgtcgacgagtccgtcgtacttattattagtgtcgacgagtaggaggtcggtattactttaccgaccgtgtacgtacttacgggttaggaccggtcggacccgtacgg

SEQ ID NO: 186380 - DNA, 669 bp, Homo sapiens
  misc_feature: GYAE6OF01CLTK6.42.2.A02.1.454.CMB.1.raw
  modified_base (185)..(185): a, c, t, g, unknown or other
  misc_feature (185)..(185): n is a, c, g, or t
  modified_base (625)..(625): a, c, t, g, unknown or other
  misc_feature (625)..(625): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggagttcctctttggtggtggcagcagctacaggtgtccagtcccaggtgcagtctggtncgagtcgagggctggaggtgaagaacgtccgtggggtccgtacggtaggaaggttcctcccgtggacgaaggtcttacgtggacggctaccgttcgagtagctaagtcgactgtaccaccggtgggtcgcgaccgacggccccgtaggacgaacggacgtacggaggtagggagtagggtaaactcgttaccttacccgtagttccgtacggtaaacttaaaccgaaacgtacgactaacgtaagttaacggttacgacggggactaaggacgtacctaaccgtaacgttacccgacggaacctacgaacctaccgaaactaacacgtactacatagttagtagtagtgtccgctacgaactcgtcgaggaccggtacgtcggtacttattacgttagtggtagtacggtaggaggtacgggaggttacttacgttaccnccgtcgtagtacgttacggtccgggaccgtacggtccgtaccgg

SEQ ID NO: 186381 - DNA, 703 bp, Homo sapiens
  misc_feature: GYAE6OF01B34QM.42.2.A02.1.454.CMB.1.raw
  modified_base (194)..(194): a, c, t, g, unknown or other
  misc_feature (194)..(194): n is a, c, g, or t
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtcctccttcctcctgtctgctatctaggtagganacagaaactcaccatcacgttggccggcagtcgaggtcagttgtcgttatttttacgctaggtatcagaacaaaactggacactagttacctaagctctctacttccttcctgtccttctactttgactaactcgacgggtcccagtcctcgacttcgacggccggtcggtcgacgtcgttacgggactagttacttcactctaccaccgtatacgacggtacacgaccgttggaacacggtaccctaaggtaaccgtaaggttacggtttaacgggtaaaccgtttacttaacggttacgttaaacggtaaaacgtttacgtttaaacgtttaaaccggttttcggtacccgtttaccgtaccctttacggttaacccggggtttaccgggggtaaccgggggggtaaacctaaaggggggttacgaaagggtaaaccgtaaaccgttaaaaccgggaaggtttacgggtacgggtacctacggaccttaaccggtacgtttacccgg

SEQ ID NO: 186382 - DNA, 750 bp, Homo sapiens
  misc_feature: GYAE6OF01BW2GQ.42.2.A02.1.454.CMB.1.raw
  modified_base (220)..(220): a, c, t, g, unknown or other
  misc_feature (220)..(220): n is a, c, g, or t
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatcgacccagtctcccttcctcctgtctgcatctgtaggagacagaactcaaccatcacttggccgggngagtcaggtcattggcgttatttttagccttggtactacacgtactaaaaaccgtggacctaactacggttaccctaaacggtccttaccctctaactttccgtttaccttacgtccttttacgttaccttttcggacctaagttccgtaacggggtcccctacgttccttcgtacctttcggaacggtcgggaccggttgggtccttcggtacggggactaacggtaactttccgtaacttccgtaccctaccgtaactccgaacgtaccgtaaggccctacggtaccacggtaccgtacgtaaagtacgttcggtttaacggaaacgttttacgtttaacgtacggttacgtaaaggttaactttaacgtttaaccgttttcgttacccgtcttacgttaacccttacgggtttccggggaaccggggggtaaacccgaaggggttagtaaaccggtacgttaaaaccggtaaaaccggtaaaccgttaggtaccgtcgtacggtaccctaaacgtccgtttaaaccg

SEQ ID NO: 186383 - DNA, 753 bp, Homo sapiens
  misc_feature: GYAE6OF01DM2CL.42.2.A02.1.454.CMB.1.raw
  modified_base (263)..(263): a, c, t, g, unknown or other
  misc_feature (263)..(263): n is a, c, g, or t
tcagtgacgtatgtcacgaccggtgctcgatttagactcatctacagggggagcttcacataacgaccaccttcctcctctaaagaacgcccctgggagcacagctcatcaccatggactggacctggagttcctctttgtggtggcagcagctacgaggtcgtccagtcccaggtgcagctggtgcagtcgaggggctggaggtagaagaacgtccgtgggtccgtgggtagaacggtcctccgtgacgtaacggtcttcgnggacgacctaccttgaacggtacgactaagtcgctcgtacgaccgtgggtcgccggacgtaccggaccccgtaggaaccgaacggtcctacggaggtaggacggtaaggtaagtacgttccctaccgtgtacgtacggtaacttaaaccaaacgtacgacgtaacgtaaacggtaacgttacggaacggtacgtaacggtacgtacctaaccgtaacggttaccgggaccggtaaaccctaaccgtaaccttaaccccaaacgttaaaccccagttaaaccgttacttaaccgttacgttaggtaaccgttaggacgttaccggtactacgtacgtactacgtaggaccgtacggtaccggtacttaattaagttgtacgacggaccggtaaagaggtacgggtaacgggtactttaacccggttcgaccccgttagtaccggtaacgttacggggttaccgggacccgtaacggggtcccttacccggg

SEQ ID NO: 186384 - DNA, 803 bp, Homo sapiens
  misc_feature: GYAE6OF01CNHW9.42.2.A02.1.454.CMB.1.raw
  modified_base (249)..(249): a, c, t, g, unknown or other
  misc_feature (249)..(249): n is a, c, g, or t
  modified_base (272)..(272): a, c, t, g, unknown or other
  misc_feature (272)..(272): n is a, c, g, or t
tcagtgacgtatgtcacgaccggtgctcgatttagactcatctacagggggagcttcacataacgaccaccttcctcctctaaagaacgcccctgggagcaacagctcatcaccatggactggacctggaggttcctcttgtggtggcagcagctacaggtgtccagtcccaggtgcagctggtgcagtcgaggggctggaggtgaagacgccgtgggtccgtggtgaacgtctcctgacaggcttcgnggaggtctaccgttcaagtacgntaatgcgtgtcacgtgggtgccgacacggccctaggacaggactcgagtggatagggaaataggtcctacgtacgtctacggaacttaacgaaactaccggacaacgtaacgtaaaggtttcgaacgggtacaacgtacggtacctaaccgtaacgtttacccggacccggtaaccaccgtaaccgttacccgaaaccgttaaaccctaaccgtacgttaacccgtaaccgtaacgtttaggtaacgggtttaacgacggttacgggtccccgttagtaacccgtagttcggtaaggtaaccgggtaaccggttacccggggtacccggtttaaacgttaacggttttacgttaacgggtcgggttaacgggaaacggtaacgggtaaggggtaaaccgggggttacttttaaaacccggttttaaaccccggtcccccggtaacgttttaccggggtaaacccgtttaacggggtttaaccccgggggaacccgttaccggggggtaaaccccccgtttaaccccggggg

SEQ ID NO: 186385 - DNA, 869 bp, Homo sapiens
  misc_feature: GYAE6OF01DTCW4.42.2.A02.1.454.CMB.1.raw
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagactcgaacccagttccttcccttcctcccgttgtctgctatcgttaggtagggagaaccgaagaactaccaaccaattcctacgtttcggccccgggggtacgaggttcgacgggttctaggtttcgggtacgttacgtttttttacgccgttaggttacttacaacggaacaaaaaccgtcggactaaccgtaacgtttaccgtaaaggtcccttccttcttaccgtttcctttcccgttcgttcttttccttaacgtttcgactaacgtccgtaccggggtcctactttccgtcgttaccttacgacggtcggggttacggtcgtccggttcggtcgggtaacgtaacgttacgtttaaacccgtccttaccgtacctaacccgtataccgaacgtcccgacgttcccgtcgtacccgtacggtaccgttaacggtaacggttacggtagggtttttaacgggttaacgtttaaccttttacgggttaacggttttaacggttaaactttaaacggttttaactttaaccggtttttacggtttacccgttaccttttaccgggttaccgttttaccgggggttaccgggggtaaaccgggggtttaaaccggtaaggggggttaaaccggtaacggtaacggttaaacttaaaccggggttaacgtttggggtacccgttggtaacccggtcccggtaaaccttgtttaacccgg

SEQ ID NO: 186386 - DNA, 737 bp, Homo sapiens
  misc_feature: GYAE6OF01CRL52.42.2.A02.1.454.CMB.1.raw
  modified_base (145)..(145): a, c, t, g, unknown or other
  misc_feature (145)..(145): n is a, c, g, or t
tcagtgacgtatgtcacgaccggtgctcgatttagactcatctacagggggagcttcacataacgaccacctttcctcctctaaagaacgcccctggggaagcacagctcatcaccatggactggacctggtagttccttcttgnggtgcagcagctacagtgtccagtccaggtgcagctggtgcagtcaggggctgaggtcgaagaagtcctgggtcctcggtagaaggtctacctgcaaagggcttcgaggtagctaaccttcgagtagtacaatgctagtcctaaccggttggtagcgacgtacggaccccgtaggaacctaaggtactacggtacgtagggattagggaaaacttaggtacctaccgtacgttcgtacgtaactaaacaaactcgacaactagtaaacttcgaggactaaggactacgaactaacgttacgacgtaacacgaacttaccaaacgtaaaccacgtaacgtaactaactacgttaggtaagttcgtaacggtcggtacgtacgactacgttacgtacgtaacggtaccggtaccgggtccgtttaaacttaacgttttacgttacggttaacggacgtaaacggtacggtaaagggtaacggggttaactttaaaccggttttaaacccgtacccgggtttacgtaaaccgggtaactttaaacgggttacccggggaaaccggtaacccggggtaaccccgtttaaaccgggg

SEQ ID NO: 186387 - DNA, 750 bp, Homo sapiens
  misc_feature: GYAE6OF01CKVF2.42.2.A02.1.454.CMB.1.raw
  modified_base (159)..(159): a, c, t, g, unknown or other
  misc_feature (159)..(159): n is a, c, g, or t
  modified_base (264)..(264): a, c, t, g, unknown or other
  misc_feature (264)..(264): n is a, c, g, or t
tcagtgacgtatgtcacgaccggtgctcgatttagactcatctacagggggagcttcacataacgaccaccttcctcctctaaagaacgcccctgggagcacagctcatcaccatggactggacctggaggttcctctttggtggtggcagcagctacnggtgtccagtcccagtgcagctggtgcaggtcgaggggctggaggtgaaagacgtccgtggggtcctcgggtagaacggttctccgtagactaagggtccttcgnggacggcctaccgttcgagtagactaagtgtctcgtccgaccgtggggtcgaccgacgccggaccccgtggaacgaacggacgtcggaggtaggagtagggtaaatcggtcctaccgtagtaccgtaacggtaacttaaaccgaaacgtacgacaacgtaaggtaacgttcggaggacaggtacgtaccaacgtaacgtaccgacgaaccacactaaccaacctaaaccacgaacgttacctaaagttacgttaggtacggttacggagtccggtacctaggtaacctagttaccggtaggtaacggtacccgttacgggtaccgttaatttaagtttacgttcggtacggtacggtaaagggacggtaaacgggtacgggggtaccttttaaccggtttaaaccccgtacccggtacgttaacggtaaaccggtttagggtccccgggggaaaccgttaaccggggttaaccccggttacccggg

SEQ ID NO: 186388 - DNA, 692 bp, Homo sapiens
  misc_feature: GYAE6OF01A77IH.42.2.A02.1.454.CMB.1.raw
  modified_base (212)..(212): a, c, t, g, unknown or other
  misc_feature (212)..(212): n is a, c, g, or t
  modified_base (257)..(257): a, c, t, g, unknown or other
  misc_feature (257)..(257): n is a, c, g, or t
  modified_base (482)..(482): a, c, t, g, unknown or other
  misc_feature (482)..(482): n is a, c, g, or t
  modified_base (681)..(681): a, c, t, g, unknown or other
  misc_feature (681)..(681): n is a, c, g, or t
tcagtgacgtatgtcacgaccggtgctcgatttagactcatctacagggggaagtctctctcagtcaggacacagcttggacatgagggtccctgctcagctccgtgggacctcctgctgctcgtggcctcccagataccagatgtagacactccagatcgaccctagtccttcccttcctccctgtcctgactattcgtaggtaacggganaacgtaagtaactaccaaccctattccgtacgttcgggaccgggngtacgtcgaggtctagttggtacgtttagtttttacgccgttaggtactacgaacgtaaacctaaaacgtcgactacgtacgttaccacgtcctcctactactttcctttactcgtttccttacttacgttcgaacctagtaccggtaccggtcctacgtcctcgtctcgacggtcgggtcggtcgtctacggtaggactacgtacttccacgtactccactacncgatcacccgtcacgacacgtactaggtaagtacgttacggttagtactttactagtacgaattacttacttacgttacgttcgtctaccgttacgttacggtaccgggttacgggggaccggtaacggtaaggggtcgtaaacggtaacgttaaaccgaaacgggttcgttacgggtactaccggtacctaaccgttntacccgttcgg

SEQ ID NO: 186389 - DNA, 852 bp, Homo sapiens
  misc_feature: GYAE6OF01AQS36.42.2.A02.1.454.CMB.1.raw
  modified_base (256)..(256): a, c, t, g, unknown or other
  misc_feature (256)..(256): n is a, c, g, or t
tcagtgacgtatgtcacgaccggtgctcgatttagactcatctacaggggagcttcacataacgaccaccttcctcctctaaagaagcccctgggagcacagctcatcaccatggactggacctggagttcctctttgtggtgcagcagctacgaggtgtccgagtcccgaggtgacagctggtgcaggtcgagggctggaggtagaagacgtccgtggtcctggtagtacggtctaccgtgacgaaggtcttcgngggacggtcctaccgttcgagtacgacgtaagtgactgtccgtacggtgggtcgaccgaccgacggtccccggtaggaaccgaacgggtacgtacggtacggtaggtaggtaagggaaacttaccgtccttacccgttagtaccgtacggtaaaccttaaaaccaaaccgttacgaaccgtaacgtaacggttaacgttacggaacgggtaccgtaacggtaccggtaaccgtaaacccgttacggtaaccccggtacggaacctaacccgtaaccgtaacccgaacccgttaaaacccgaacgtaacctaaccgttaacaagggtttaaccgtaggtttaacgcggtttacccggtaccgttacgaaccttagtacccggttaacggacccgggtaaccgttacccggttaacgttaacgtttacgtttaacgttgggtaccggtaacggtaacgggttaaaacgggaacggggttaccgggttaactttaaaccggttttaacccccggtacccggttaccggttaaccgttaacgggttaccggggtttaaccgggaaccccggggttaaccgggttaaccccgttacccggg

SEQ ID NO: 186390 - DNA, 898 bp, Homo sapiens
  misc_feature: GYAE6OF01BDFHG.42.2.A02.1.454.CMB.1.raw
  modified_base (156)..(156): a, c, t, g, unknown or other
  misc_feature (156)..(156): n is a, c, g, or t
tcagtgacgtatgtcacgaccggtgctcgatttagactcatctacagggggagcttcgacataacgaccaccttcctcctctaaagaagcccctgggagcacagctcatcaccatggactggacctggaggttcctcttgtgtggcagcagctacnggtaaagtccagtcccaggtcgtcagctggtgctgtcaggggctaggaggtgaacgtaacgccgttgggtcccgtacggtacgtaacgggttcctccgttaggacgtaacgggtcctttacgtacgggtaacgggtcctaacccgttcgtaaggtaacggtcctaaagtcgtaacgttcggtacgtaccggttggggtacgaccggaaccgtacgggtaccccccgtagggtaacctaacgggtaccgttaccggtaggttacgggaaccgttaaggggtaaaaccttaacggttacccggttaccccgttaacgggttaccccgtaccgggttaaaccgtttaaaaccgtaaaaccgttaacccgggtacctaaacccggtaaacgttaaacgggttttacccgaacgggggtcctaaacggggtacgttaacccgaaaccccgttacggttaaccccggtacggtaacccgtaaccgtacctacccgtaaccgtaaccctaacgtacgttaccgtaccgtacgttaggtaacgttgtacggtcggtacctacggaccgtacgttacgcggtaaccggtaccgttaccggtacgtttaaccgttaagtaccggttacgtacgggtaacggtacggtaacggtaacgggtacggttaccgttaacgtttaccggtacccgttaccgtacgttaccgttacgggttaccgggtacccgtaaccgggggttcccttaacccggg

SEQ ID NO: 186391 - DNA, 625 bp, Homo sapiens
  misc_feature: GYAE6OF01D0KBL.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctggaggtgaagagctgggtcctcggtgaggtctcctgcaaggcttcgtggaggcaccttcagtagcaatgctgtcaccgtggggtgccgacacgggtcccccgtagggacaagggacctcggaggtgggacgtagggaaattcggtcctccctaggtcctacggtaattaaacaaacttacgcaacacgtaagtttcgagggactaggagtaccactacgttaccgcggtaccacactaccaactaacactaacgtctaactagttgtagttggagttcggtccctgacctatccgtaggacggtaccgtcgggacctttaatactttattggtgacgtaggtaggaggtacggggtacttaagtttacccgtcccgtacttaggtaacgttacggttaggggacccgtaacggggtacccgttaccggg

SEQ ID NO: 186392 - DNA, 728 bp, Homo sapiens
  misc_feature: GYAE6OF01EG2YQ.42.2.A02.1.454.CMB.1.raw
tcagtgacgtatgtcacgaccggtgctcgatttagactcatctacagggggaagtctctctcagtcaggacacagcttggacatgagggtccctgctcagctctggactcctgctgctcgtggctcccagactaccagatgtgacatccgagatcgacctagttccttcccttccctcccttgtctgctattcgtggtaaggacgtacgaagtaactccaacctacttaccgacggttcggcccggggtacgaagtccggtaaggttctaggtttaggttacgtttacgttttttacggccgttaggttactacgtaacgaacctaaaaccgtcggacctacgtaccgtttaccaacgtccttccttacttacctttccgtttccgtcgtttcctttacgttacgttacgactacgttaccggtacggtcctacgtcctcgtacgttacgcggtggtcggtagtcgtcgacggtactagtcttactcttcaccgtactagtacacgtcctacgcgtagctacgacgtagtaacgtgtttacgtacgtaacttagttacgtacgttaacggtaactttaaggtttactttaaccggtttcgttacgttacccttacgggttaacccgttacgggggtttaccgggggaccgggtaaacgttggggaaacgttaaggtacgtaaaacggaccgttagtacggtcggtacaaccgtcctaacgtcgttacg

SEQ ID NO: 186393 - DNA, 803 bp, Homo sapiens
  misc_feature: GYAE6OF01A916C.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctgggagttcctctttgtggtggcagcagctacaggtcgtccacgtcccaggtgacagctggtcgcagtcgagggctaggagtaggaagacgccgtagggtccgtgggtgtaacgggtcctccgtacggacgtacggtcgtttacggtagggacggtcctacccgttagtaggtacgacctaagtcgtaccgtcggtaccgtaccggtcggggtacgaccggacccggaccgggtccccggaggaaccgtaacgggtaccgtacggagggtaggtacgggtaaacggtaacgttacggttccggttacccgtacggttaccggtaccggttaaaacgttaaacctaaaccgtaccggaactaacgttaaacggtaacgtttaacgggaaggtaccgacgttaaccgtacccgtaaacccgttaccggttaacccggaccgaaccgtaaccgtacctaacccgtaacttaaaccgacgttacgtaacctaatacgttagtaggttcgtacgggtccgtacgtaccgaactaggtcgtacggaaccggtcgttaccggttaatttagtacttagttacgggtcgaaacgggtaggaagggttacgggtacgttaccgttacgttacccgcggtacgtacggttacgtccgggacgggtaccggaaccgggttcccgtaccgg

SEQ ID NO: 186394 - DNA, 801 bp, Homo sapiens
  misc_feature: GYAE6OF01ERFHY.42.2.A02.1.454.CMB.1.raw
tcagtgacgtatgtcacgaccggtgctcgatttagactcatctacagggggagcttcacataacgaccaccttcctcctctaaagaacgcccctgggagcacagctcatcaccatggactggacctgggacggttccttcgtttggtggtggcagcagcctacgaggtcgtccagtcccaggtcgcaggtcgtggtgcgacggtcggaggggtctgggaagggtagaacggacgtccgtcggggtcctggggtagaacgttcctccgtaggacgacggtcttcgtgggagtccaccgtttgacggtacgctaagtcgccgttcgtccgaccggtgggtccgacggtaccgccgggtaccccggtggtaaaccggacgggtaccgtcggaggtaggtacggtaggtaaacttaccgtccgttaaccgttaggttacccggtacgtaaacttaaaccgaaaccgttacgaacctaacggtaacggttaaccggtttacggaacggtacgaacgtaccggtaccaacccggttacgtaacccggaccggaacctaccgtaactacccgaactaaaccgtaacgtacgtacctacgtacgttagtacggttacgtacggtacggtccgtagacctagtaccgtaggtacggaccgttaggtaccgttagttacgtttacgtaggttccgaaggtacggtaacgggtagggtaccgggtttaccgttaacgtttacccgtccggtacgttaccgggttaacgttacggggtaccgggtaccgggtacccgggtaaccggttcccgg

SEQ ID NO: 186395 - DNA, 877 bp, Homo sapiens
  misc_feature: GYAE6OF01BCQ3R.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctcttgtggtgcagcagctacaggtcgtccacgtcccaggtgcagcgtggtgcagtcgagggctgaggtgaagacgcgtgggtcctggtgaaggtctctcgacgaaggtccgttacgtggacgccgtaccttcaggtacgataagtcgtactcgtcgtacgtggtcgaccgacgacggtcccgtaggaccgaacggacgtcgaggtacggtaagtagggtaacttacgtccgttaccgtacgttaccgacggttaaactaaacctaacgtaaccgacgtaaacgtaacggtaacgtttaccggaagggtaccgtaacggttaaaccgtacctaacccgttaacccggtttacccggaaccgttaaccgaaaccgtaccgttaaccccctaaacctaaacccgtaaccgttaaccgttaacccgttaaacgtaacgttttacgggttcgttaacggttaacgggttccggtaccgtttaccgtaaacgttacgttccgttaacggggtacccggtacccggttacccggggttaacccttttaaggtttaaccggttttaaggtttccggttaacgggtaacccggtaaaggggtaacccggggtaacgggttacgggttaaacccggtttttaaccgtttaaaccccggttcccccggttaagttccgggtttaaaccccgggtttaggggttacccggggaaccccggtttaacccggggggttaacccccgttaaccggggg

SEQ ID NO: 186396 - DNA, 734 bp, Homo sapiens
  misc_feature: GYAE6OF01BJLCP.42.2.A02.1.454.CMB.1.raw
  modified_base (202)..(202): a, c, t, g, unknown or other
  misc_feature (202)..(202): n is a, c, g, or t
  modified_base (729)..(729): a, c, t, g, unknown or other
  misc_feature (729)..(729): n is a, c, g, or t
tcagtgacgtatgtcacgaccggtgctcgatttagactcatctacaggggggaagtctctctcagtcaggacacagcttggacatggagggtccctgctcagctccgtgggactcctgctgctcgtggctccagactaccagatgtcgacatccagatcgaccctgtctccttcctcctgtctgactagtcgtaggtagganacagtaactcactatcgacgttcggccgggatacgtcgacggtctaggttcggtacgtttagtttttacgcgttaggtactaccgaacgtaaaccgtaaaaccgtcggtaactaacgtacggtttacccaagttcccttaccgttacttaccttttccgttttaccgtcgttttacctttaccgtttaccgtttacggaaccttaacggttacccgggtaccgggtaacccttacgttcccgtaccgttccgttacgggacgggtcgggtccggggttacgccggtttacgggtacggggtacttaggttacctttaccggcctttaccgactaaacccgtcgtaccgtaacggccgtaacgtccgtcggaacgacgtacgtaagtacggtgttaggtacgtacgtattacgtatactaaggtacttatagttcgtctacgttactacggtcggttacgggcgggtaacgagggtacgtaagaccgttaaagacgggttagtcggtacgtacaacggtcctacgttntaccg

SEQ ID NO: 186397 - DNA, 756 bp, Homo sapiens
  misc_feature: GYAE6OF01A9GCH.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctgaggtgaagaagccgtgggtcctcggtgaaggtctccgtgcgaaggcttcgtggaggcaccttcagtagacagtcgctgtaccaccgtgggtcgccgacgacggtccccgtagggaacgaacggcctcggaggtcggaagtagggaaattcgtccgttacccgtagtccgtacggtaacttaaaccgaaacgttaccgactaaccgaaggttaaacggtttaccgaacggggtaccaacggtaacggtacccaaacccgtaacgtttaccccggacggaacccaaccgtaacctaccctaaacctaaacccgaacgtaacgttaaccttaactagtttacggtaagttggtaacggtcggtaccgttagaacctaagttccggtacggtaacgggtaccgttacgggtacccgttaatttaacgtttaccgttaggtacggtacggtaagggaagggtacgggtacggggttaacttaacggtttaaccccgtcccggtacttacggtaccggttaacggtacccgggggtccgtaaccggggtacccggttacccggg

SEQ ID NO: 186398 - DNA, 912 bp, Homo sapiens
  misc_feature: GYAE6OF01EFMNV.42.2.A02.1.454.CMB.1.raw
  modified_base (167)..(167): a, c, t, g, unknown or other
  misc_feature (167)..(167): n is a, c, g, or t
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
tcagtgacgtatgtcacgaccggtgctcgatttagactcatctacgagggggagcttcacataacgaccaccttcctcctactaaagaacgccccgtgggagcacgagctcatcaccgatggacgtggaccgtgggacgtttcctgtttgtggtggcagcagctagnggtgtccacgtcccgaggttcgacacgcgtgggtcncgaggttcggngggggtactgggtaaggtacgggaaacgaacggtccggttacggggtccgttacgggtaggtaaacggttccttcgacgggccgaaggttccttgggagggacggtcctaacggtttacgaagtaacggactaaccgttgtaccgttacgtaccgtaaccgggttagggtccggaaccgggttaacccgtaaccgggggacccccggttaacggggaaaaccggttaaaccggggacccgttaggggtaaccgggttaaggggtaagggttaaacccgggttaaaggttaaccgttcccccgttaaacgttaaggtccccggttaaagtaaaaccgttaaaccggtaaaacccgttaccggaacgtaaacggtagggtttaaaccggttaacgacgggggtaacgttacggaacgtaacccttaaccgggtaacttaacccgggaacctaacggtacctaaccgttaaccaaacgtttaaccgtaacggaactttaccgtaactaagtttacgggttaagtcggttacggaacgtacgtcgtaaagcgttaggaccggaacgttcgggaaccggttaattaacgttgtagtcgtagtaacggagtaacggtaggggtacccgttaagtttaaccgtacgtaccggtagttacctaacgggtcggttaaaccggggcccggtaaacgtccgggtaaccc

SEQ ID NO: 186399 - DNA, 618 bp, Homo sapiens
  misc_feature: GYAE6OF01AKJJI.42.2.A02.1.454.CMB.1.raw
  modified_base (291)..(291): a, c, t, g, unknown or other
  misc_feature (291)..(291): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctgaggtgaagaacgccgtgggtcctcggtgaaggtctcctgcaaggcttcgtggacggcaccttcagtagcaatgctgtcacctgggtcgcgacncggcccctggacgaaggctcgagtggagtagggaatgtcctaccgtagtccgtcggtaacttaaacaaactacgacaacgagtaacgtttcgagggtacaaggtacgtaccaccgtacttacccggcgaccactactacccaactaacactacgtctacattcggtagttgagtcggtacctgactactcgaggacggtacgtccggtacgttattacttagttgtggcgtaggaggacgggtacggggtacttaaccgtttaccgtccccgtagttacgtaccgttacgggttacggggcccgtaacggggtaccccgttaccggg

SEQ ID NO: 186400 - DNA, 708 bp, Homo sapiens
  misc_feature: GYAE6OF01D4Y9I.42.2.A02.1.454.CMB.1.raw
  modified_base (665)..(665): a, c, t, g, unknown or other
  misc_feature (665)..(665): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttccttctttgtggtggcagcagctacaggtgtccagtcccaggtgcagctggtgcagtcgagggtctggaggtagaagacgtccgtgggtcctcggtagaacggtctccgtagccaaggtcttcgtcggaggcctaccgttcgagtacgactaatcgtactcgtccgaccggttgggtcgaccggaaccgaccggccccggtaggaaccgaacggtacgtacggaggtagggacgttaagggtaaactcgttccgttacccgttagtaccgttacgtaacttaaaccaaacgtacgacgtaacgaacgttaacggtttacgaacgggtacaagtacgtaaccgtaacctaaccgttaccggaccgaacacctaacgttacccaaaccgttaaacacgtaacgtacctaagtacgttggtaacgttgaacggttcgacgttcggaattcgtacgttacgggacgtaccgttcgggtaaccttagttacgtttagtacgtacgtaggacgtaggaggtaggtacttaacgttaccncccgtagtacgtacgtacggtcgggacctaacgggtctaccgg

SEQ ID NO: 186401 - DNA, 718 bp, Homo sapiens
  misc_feature: GYAE6OF01C3K2W.42.2.A02.1.454.CMB.1.raw
  modified_base (184)..(184): a, c, t, g, unknown or other
  misc_feature (184)..(184): n is a, c, g, or t
  modified_base (244)..(244): a, c, t, g, unknown or other
  misc_feature (244)..(244): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtncagtcagggctgaggtgaagagccgtgggtcctcggtgaaggtctcctgcaaggcttcgnggacgcaccttcagtagcaatgctgtcaccgtgggtagcgacgacggccccgtaggacgaacggacgtacggaggtgggaagtagggtaaaatacggttcctacccgtacgttcgtaccggtaacttaaaaccgtaaaacgtaaccgacaaccgtaagtaaacggtttaccgaacggggtcgaaggtaacggtacctaacccgtaactttaacccggaccggtaacctaccgtaaaccttacccgaaacctaaacctaaccgtaacgttaacctaacttacgtttaggtacgtttacggaacggttccgggtacctacggactaacgttcgtaacggacggtacttccgggtacgttaattacgtttagtcgtagacggaaggaggaaggtaccggggtactttaacgttaaccctcccggtagtacgtaccggttaggttaccgggacccgtaggggtaacccgttacccggg

SEQ ID NO: 186402 - DNA, 793 bp, Homo sapiens
  misc_feature: GYAE6OF01CIRBH.42.2.A02.1.454.CMB.1.raw
tcagtgacgtatgtcacgaccggtgctcgatttagactcatctacagggggaagtctctctcagtcaggacacagcttggacatgagggtccctgctcagctcctgggactcctgctgctctggctcccagataccagtatggtgacatccagatcgaccctagtccttcccttcctccctgtctcgcatcgtagtaggagacagaactcaacatccgacgttcggcccggagtagtcgaggtctagttggtacgttagtttttagccgttaggttactcgaacgaacctaaaaccgtggtacctaacgttacgttacctaacgtccttacctcttaccgttctttacccgtcgttacctttcgttacgtttcgtacgtaacgtaccggtacggtaccctacgttcccgttacgtccgtacggacggtccgggtcggtcggtacgtcggtacgggtactaagttccgttactaccgttccgtaaccgtaccctaagtaccacggtaccgccgtacgtacgaccgtaccgaccgttaagaaacggttagtttacgggttaacggttaaccgtttaaacgttacgttaacggttaacgttaaacggttacgttttaaaccgtttacgtttccggttaccgttacctttaccgttaaccgggttccgggtttaccggggggtaaccggggtaaacgggttacgggtaccgggtaaagttaaccgtaaaccgggtaaacgggttaaccggttcgggttaccgtacggttaccgaccgttaccgttaacgtttccccg

SEQ ID NO: 186403 - DNA, 828 bp, Homo sapiens
  misc_feature: GYAE6OF01C42RP.42.2.A02.1.454.CMB.1.raw
  modified_base (197)..(197): a, c, t, g, unknown or other
  misc_feature (197)..(197): n is a, c, g, or t
tcagtgacgtatgtcacgaccggtgctcgatttagactcatctacagggggagcttcacataacgaccaccttcctcctctaaagaacgccccgtgggagcacagctcatcaccatggactggacctggtaggttccttcgtttggtggtggcagcagctacgaggttcgtaccacgtcccgaggtgacagcttggngcgaggtcgacggggctggaggtggaaacgaaggtccgtggggtccccgttacgggtacggtaacggtccgttccgtcggacgtaacggtcgtttcggtacggggacgaccttacccttacgaggttacgacctaagtcggtccttacggtaccgtaccggttaggggccgaccgaacggtaccgggtcccccggagggaacgtaacggaccggtcggacgggtacggtaagtaacggggtaaacttacggttaccgttaccggttacggtacctaacggtaaactttaaaccgaaacgtaccgtactaacggtaacgttaacggttacggtaacgggactaggtaacgtaccgtaaccgtaacgtccggaaccgtaccacctaaccttaaccgaaaccttaaacgccttaacgtaaccgtacgtagtttacgtaggtttcggacgttccggtacacgaaccttgtaacgcgttaacggcgttaccggtactttacgttattacgtcggtcgtacggtaaggtagggaacgggttccggtacttttaaaccggtttcccgaccgtggtttaaaccggtacggttaaccgggttcggggtaaaccccgaacgggggttacccgttacccggg

SEQ ID NO: 186404 - DNA, 711 bp, Homo sapiens
  misc_feature: GYAE6OF01DST4D.42.2.A02.1.454.CMB.1.raw
  modified_base (191)..(191): a, c, t, g, unknown or other
  misc_feature (191)..(191): n is a, c, g, or t
  modified_base (217)..(217): a, c, t, g, unknown or other
  misc_feature (217)..(217): n is a, c, g, or t
tcagtgacgtatgtcacgaccggtgctcgatttagactcatctacagggggaagtctctctcagtcaggacacagcttggacatgagggtccctgctcagctcctggactcctgctgctctggctcccagataccagatgtgacatccagatcgacccagtcctccttcctccctgtctgcatctgagganacagactcactatcacttcggccggngagtcgaggttctagttggacgttattttttacgccgttggttaactacgaacgtaacctaaaaaccgtggtaccaacgtacggtttaccctaaacgtcccttacctccttacttccttttccctgttcctttacctttaccttttagacctaaacgttccgaccgggttccctacgttcctccgtcctttacggaccggtcgggtcgggtcggtccgttccggtaggggtaactacgttacgtttcctaacgttcctacctaaccacgttccaacggcctaacgtccgtcggacctaccggccgtaaggtaagtacggttggttaacggttaaacttacgtttaactagttaacgtaaagtttaacgttaacgttttaacgttcgttaccgtccttacgtaccgttacggtttccggggaccggggtacgtaaagggtcggaagtactaaccggaaacgtacggtgtacggactacgtaccctcgtagttccg

SEQ ID NO: 186405 - DNA, 643 bp, Homo sapiens
  misc_feature: GYAE6OF01BN91A.42.2.A02.1.454.CMB.1.raw
  modified_base (243)..(243): a, c, t, g, unknown or other
  misc_feature (243)..(243): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctgaggtgaagaagcctgggtcctcggtgaaggtctctgcaggcttcgnggaggctaccttcagtagcaatgctgtcacgtgggtgaccgacacgggccctggaacgaggacgtcgagtggatagggaaatagtcctccgtagtcgtacggtaacttaaacgaaactacggacaactaggtaacgtttcggagggtacaggtaacgtacacctaagtacccgacggacacgactaccgactaacaacagtacacgtatgtagtagtcgtcgggctagactagtcgtacggtacggtaccgtcggtaccggttaattaacgttacgttagggtacgtacggaggtaagggacggtaggggtacctttaacggtttaaccgtaccccggtacgtttaacggtacgtttaacgggacggggtcccggtaaaccgggtacccggttacccggg

SEQ ID NO: 186406 - DNA, 869 bp, Homo sapiens
  misc_feature: GYAE6OF01DGUKH.42.2.A02.1.454.CMB.1.raw
  modified_base (556)..(556): a, c, t, g, unknown or other
  misc_feature (556)..(556): n is a, c, g, or t
tcagtgacgtatgtcacgaccggtgctcgatttagactcatctacagggggagcttcacataacgacccaccttcctcctctaaagaacgcccctgggagcacagctcatcaccatggactggacctggaggttcctctttggtggtggcagcagctacgaggtgtccagtcccaggtgcagcgtggtgcgtagtcggagggctaggaggtacgaagacggtccgtcgggtcccgtgggtagtaacggttcctcgtcgaccgtaagggttccttacggtgggaccggtacccttacctttaggaacgttacgactaagtcggtcgtacgttccgtaccggttgggacgacccggtacgggacccggtcccgagggaaccggtaacggtaccgtagggagggtcggtaaggttaacggtaaacgttcgtcccttaccgtaggtaccgtaacggtaaacttaaaaccgtaccgaacgaaccgtacgtaacggtttaacgtccgggaggactacggacgtaacctaacccgtaccgttacccggacgaaccacctaacncctaacctaacacgtacgtacctacgtaagtttcggtaggtcgtacgtccggtaactacgtacgacgttaccgtagggtaaccgtacccggtacggttaaccgtttaatttaacccgtttagggtttacggtacgggaccggttaaacggggtaggtaaacgggttcgggttacccgggttttaaaacccgttttaacccggtttaaacccccggtaccccgtttaacggtttaaccccggtttaacggttaccccggggggtttacccggggtaccccgggggtaaaaccccgggttttaaaccccgggggg

SEQ ID NO: 186407 - DNA, 933 bp, Homo sapiens
  misc_feature: GYAE6OF01BQVLK.42.2.A02.1.454.CMB.1.raw
  modified_base (842)..(842): a, c, t, g, unknown or other
  misc_feature (842)..(842): n is a, c, g, or t
tcagtgacgtatgtcacgaccggtgctcgatttagactcatctacgaggggggagcttcacataacgaccaccttcctcctactaaaaggaacgccccgtggggacgcacacgctcactccgaccagtcggacgtcgggaccgtcgggtacggtttccgttcgtttgggtcgggtacggcgaacggccaacggtaccgttaacggtacggggttccgttacccgaacggttcccggaagggtcgacgtacggtccgttggggcgtaccggtaggtaccgggagggggtcgttagggaacgggttaggaaacggtaccggtccgggttccggggcgttacgggtacggtaacgttcctcggtacggaacggtacgggttccttagggacggacgttaccgtacgtttacggaacgtaaccgtagaacggttcgtaccgtacggtacccggtacgggttcggggtaacgcccggggaaccggtccccgggtaaccggttaacggacgtaacggtccggtcgtaagggtaggtaacggtacgggttaacttccggtacccttacggtacggttaccgaagggtttaaaccaaaaccgtaacgaccgggtaaccttaaggtcggttaaaccgggtgggaaccgggtactacggtaacgtaaccccggttaactaaccgggacgtaaccgaccgtaaccgtaaccgtacccgtaaacctaacctaacgggttacgttaaccgtagttaacggttcgtaaacgggtcgtaaccggtcgtacgtaacgtagtaccgtaggtaacgggtcctaacggtcggttactagttagttcgacggtggtaaccgnggtaaggtcggtaacgttcgtaaccgttacggtcggtaaacttcgggttaaacggcgggtaaccgggtccgtaccgggtcgttaacccggg

SEQ ID NO: 186408 - DNA, 571 bp, Homo sapiens
  misc_feature: GYAE6OF01B6ADF.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagcctgggtcctcggtgaaggtctccgtgcaaggcttcgtggagcaccttcagtagcaatgctgtcaccgtgggtgcgacacggcccctaggacaaggactcggagtggatagggaaatagtctcctagtctacggattaacaaactacgacacagtaagttcagggcagagtacacattaccgagacacgactacaactaacacagtactacattagacgttgacgtggaccttgaactatacgtgacggacgttacggacgttaattattagtttgtacgtcgagaggtaggacgggtacttaatttaaccgtcccgtactacggtacttaggtacggggacccgtagggtacccgttaccggg

SEQ ID NO: 186409 - DNA, 803 bp, Homo sapiens
  misc_feature: GYAE6OF01CT26L.42.2.A02.1.454.CMB.1.raw
  modified_base (140)..(140): a, c, t, g, unknown or other
  misc_feature (140)..(140): n is a, c, g, or t
tcagtgacgtatgtcacgaccggtgctcgatttagactcatctacaggggggagcttcacataaccgaccaccttcctcctactaaagaacgcccctgggagcacagctcatcaccatggactggacctggaggttcctntttggtggtggcagcagctacgaggtcgtcctacgccaggtgccagtcgtgggtagcgacggtcgaggggctgggaggtagaaggacgtccgtggggtcctgggtagaacggtctccgagcgtaggtccttcggtgggacgtcctaccgttcgagtacgactaagtcgtcgttaccgtccgtacggttcgggtcggaccgaccggaccgggtaccccgtagggaccaacgggtaccgtacggagggtaggagttacggggtaaattccgttccgacccgttaggtaccgtaacggtaactaaaccaacggtaccgaactaacgtaagttaacggttacgaagggcaacggtaccgtccgtaaccgtacgtacccgggactaacccactaccgtacctaaccgtaactacgtacgttaacccgtataccgtaggttagtacggtacggtaccggtccgttaacacgttaggtaccgtagggtaaacccgggttcgttaccgggtaccgttttaattacggtttcgttaaggggaccccggtagtaaggggtaacgggttacggggtacccggttaacgttttaaaccgtttacccggccccggttattacggggtactttacgggggacccgggtaacccggtcgggttaaacccttccccggg

SEQ ID NO: 186410 - DNA, 692 bp, Homo sapiens
  misc_feature: GYAE6OF01COVEL.42.2.A02.1.454.CMB.1.raw
  modified_base (137)..(137): a, c, t, g, unknown or other
  misc_feature (137)..(137): n is a, c, g, or t
  modified_base (143)..(143): a, c, t, g, unknown or other
  misc_feature (143)..(143): n is a, c, g, or t
  modified_base (188)..(188): a, c, t, g, unknown or other
  misc_feature (188)..(188): n is a, c, g, or t
  modified_base (246)..(246): a, c, t, g, unknown or other
  misc_feature (246)..(246): n is a, c, g, or t
  modified_base (261)..(261): a, c, t, g, unknown or other
  misc_feature (261)..(261): n is a, c, g, or t
  modified_base (282)..(282): a, c, t, g, unknown or other
  misc_feature (282)..(282): n is a, c, g, or t
tcagtgacgtatgtcacgaccggtgctcgatttagactcatctacgagggggagcttcacataacgaccaccttcctcctactaaagaacgcccctgggagcacagctcatcaccatgactggacctggagttcctntttggnggtggcagcagctacgaggtgtccaggtcccaggtgcagtctggncagtcgagggctgaggtgaacgacgccgttgggtaccgtcgggagtaacggtcctcgngcaaggtcttacggnggacgtctaccttcgaagtancgtaatcgactacggtcctacggtggtcggacgtccggaccggacccgtaggaacgtaacggtaccgtaggaggtagggtaagtacgggtaaattcggtacccgtacgttagtaccgtaggtaaactaaaccggaaattccgaatacgtaaggttaaccggttgaacgggactaacggggtactaccgaaccgttaacgtacccgggaacgtaacctacgtaaccttaaccgaaacttaacccacgtaacgttacctacgtagttagtaacgtcgaggtccgtactagacctagtacgagtacgcgttacggactttagtaactttggagtacgaggtagaggtcggtaggtattaacgtttaccgaccgtagttcgtacgttacgggaggacccggtagtcccgtacgg

SEQ ID NO: 186411 - DNA, 622 bp, Homo sapiens
  misc_feature: GYAE6OF01BICYN.42.2.A02.1.454.CMB.1.raw
  modified_base (543)..(543): a, c, t, g, unknown or other
  misc_feature (543)..(543): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttctctttgtggtggcagcagctacaggtgtccagtcccaggtgcagctggtgcagtcaggggctgaggtgaagaagcctggggtcctcgggtgaaggtctccgtggccaagggctttcgtgggacggccaacctttcgagtagcaatgctgtcaccgtggggtgcggtacacggccccgtaggaccaaggctacggagtggaagtgggaaaatgtctcctagtcgtacggtaatttaaacaaacgttacgacaacgtaggtaaacgttttcgaaggggtacaaggacgtaccaccgtacttaacccggcggaaccaacacgtaccaacgtaacacgtagtcctaactattagtagttagagtcgctgtacctagtcgacggtacggactaccggaccttatacgttagttgngacgaggtagaggagggtatacgttaaccgcccgtagtacgtacgtacgttaggggaccctaacgggtacccgttacgg

SEQ ID NO: 186412 - DNA, 810 bp, Homo sapiens
  misc_feature: GYAE6OF01BI31D.42.2.A02.1.454.CMB.1.raw
  modified_base (138)..(138): a, c, t, g, unknown or other
  misc_feature (138)..(138): n is a, c, g, or t
tcagtgacgtatgtcacgaccggtgctcgatttagactcatctacagggggagcttcacataacgaccaccttcctcctctaaagaagcccctgggagcacagctcatcaccatgactggacctggagttcctcttgnggtggcagcagctacgaggtgtccagtcccaggtgcagcgtggtgcagtcgagggctggaggtgaagacgccgtggtcctcggtagtacggtcctccgtagacgtaacggtcttaccggtaggacggtaccctaccgttacaaggtacgtacctaagtcgtacgttacgtaccgtaccggtgggttacgaccgaaccgaccggtacccccgtaggaaccgacggtaccgtacggtaggtaggtacgtagggtaaactacgtccttaccgtagtaccgtacggtaacttaaaccgaacctaccggactaacgtacggttaaacgtttaccggaacgggtaccgtaggtaacgtacccgtaaccgtaaccgttaacccgggaccggtaacctaaccgtaacctacccgtaaaccgtaaaccgaaccgtaccgttaccgtaacgtacgtttaggtaacggttacgtacggtccgtaccgtacgtaaccgttacgtccggtacgaacggttaccgtaccgggtacgtttaacttacgtttacggtttacgacggtaccgtaggtaacggtacgggtaccggggttaacctttaacggtttacccggacccggttacgttacggtaaccgttacgggttaccgggacccggttaaccgggtacccggttaccccggg

SEQ ID NO: 186413 - DNA, 884 bp, Homo sapiens
  misc_feature: GYAE6OF01BIP6J.42.2.A02.1.454.CMB.1.raw
  modified_base (182)..(182): a, c, t, g, unknown or other
  misc_feature (182)..(182): n is a, c, g, or t
  modified_base (236)..(236): a, c, t, g, unknown or other
  misc_feature (236)..(236): n is a, c, g, or t
  modified_base (256)..(256): a, c, t, g, unknown or other
  misc_feature (256)..(256): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggagttcctctttgtggtgcagcagctacaggtgtccagtcccaggtgcagctggtnctagtcgaggggctggaggtagaacgacgccgtgggtccgtcggtagacgttcncgtgacgtaggtctttcggnggacgcctaccgttacgaggtacgactaatcgtccgttacgtccgtaccggtggggtacgaccggaccgtaccgggtccccgttacggggaaccgtaacgggtcccgtacggaacggggttagggtaaggttaaccgggggtaaaactttacggttacccggtttacccgttaacgggttaccggttaaccggtaaaaccttttaaaaccccgtaaaccggtacccggtaaccgtaaaccggttaaacggttaaaccgggttttacccgggaaggggtaccgtaaacggtaacgtacccgaaccggtttaaccgttaacccggggaccggtaacccaaccgttaaccgtaaccccgtaaactaaaacccggtaacctaaccgttaacccggttaactttagggttaacggttacggttaacggtacggggttaccggtaccccgttaaggtaccttaacgggttccggttaacgggaccggttacccgttaccgggttaacttttagttaaccgtttaggttacgtacggtacggtaaacgggtacgggtagggttaccggttacttacggttaccgtccgtactacgtacggtaccggttacgggaccgttacgggtcccgtaccgg

SEQ ID NO: 186414 - DNA, 702 bp, Homo sapiens
  misc_feature: GYAE6OF01EME7Y.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctgaggtagaagaacgccgttgggtccgtcgggtgaaggttcctccgtgaccgaaggtcgtttacgtgggacggctacccgttcaggtagcctaagtgtctcgtcgaccgtgggtcgacgaccgacggtcccgtggacgaacggctcggagtggagtagggaaatacgttctaccgttgtacctcggtaattaaaccaaacgtacgaacgtacgaagtaacgtttacgaacgggacaaggtacgtacaaccgtacgttaccgggacggaacacgtaacctaccaactaaacacacgttactacgtacttaggtaagttgacgtcgtacgtacgtactatcgtacggtacggtaccgtacggtaccgttagtaacgttacgtttggtcggacggaaggacggtaagggtacgggtaacttttaacggtttaacccgtccggtacgtaacggtacggtttacggttacccgggggaacgttaacccgggggtaaccggttaaccccggg

SEQ ID NO: 186415 - DNA, 678 bp, Homo sapiens
  misc_feature: GYAE6OF01EKXQF.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctgaggtgaagaagccgtgggtcctcggtgaaggtcctccgtgcaaggtcttcgtggaggcctaccttcgagtagctaagtgctgtctacgtgggtcgcgacgacggcccgtacggacgaacggcgtcggaggtaggagtagggtaaactcggtaccgtccgtagtcctacggtaaacttaaaccgaaacgtaccgaccgtaacgaagtaacgtttacggaacgggtacgaggacgtacctaccgtacgttaccggtaccggaaccacctacgtaccaaccgttaaccaacctaacgtacctaacgtagttaggtagttaggacgtcggtactacgactagtcgtacggacggtacgtccggttacgttattacgttagttcggtaggtacgaaggtaggtacgggtacgggtacgtttaacgttaccgtcccgtagttacgtacgttacggttaccggggaccgtacgggtacccggtacgg

SEQ ID NO: 186416 - DNA, 630 bp, Homo sapiens
  misc_feature: GYAE6OF01BU8OZ.42.2.A02.1.454.CMB.1.raw
  modified_base (253)..(253): a, c, t, g, unknown or other
  misc_feature (253)..(253): n is a, c, g, or t
  modified_base (266)..(266): a, c, t, g, unknown or other
  misc_feature (266)..(266): n is a, c, g, or t
  modified_base (558)..(558): a, c, t, g, unknown or other
  misc_feature (558)..(558): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttggtggtggcagcagctacaggtcgtcagtcccaggtgcagcgtggtgcagtcgaggggctggaggtagaagagccgtgggtcctcggtgaacggtctcctgacaaggtcttcgnggacggcaccttnagtacgcaatgctgtccacgtgggtacgcgacgacggccccgtaggtacgaacggaccttcggacgttagggataggggaaaactcggttaccttacccgtagttccggtaacggtaactttaaaacgaaactaccggacaacgaagtaagttcgaagggtacagtacgtacaacctgtaccgacgaacactactacaactaacacgatactacattctagtgtagcggtactgacgtatcgtagacgtacctacggtacctagttcgttatacgtggtaccgaggaacggnggtacgggtacttacggttaaaccgccgtaagttacgtacttaagggttcgggaccaagggtaccgtacggg

SEQ ID NO: 186417 - DNA, 735 bp, Homo sapiens
  misc_feature: GYAE6OF01CCBRE.42.2.A02.1.454.CMB.1.raw
tcagtgacgtatgtcacgaccggtgctcgatttagactcatctacagggggagcttcacataacgaccaccttcctcctactaaagaacgcccctgggagcacagctcatcaccatggactggacctggaggttccttcgtttggtggtggcagcagctacgaggtgtccacgtcccaggtgcagtcgtggtgacagtcgagtgggctggaggtagaagacgtcgtcgggtccgtggtagtaagtcctccgtgacgtacggtcttacggtggacggtacctaccttacgagtacgacgtaagttgtcctgttaccgtccgttggggtcggcccgaacggacccgggtaccccgtacgggaaccgaacggtaccgtacgggtaggtaggaaggtaagggaaacgtttcgtacccgttaccgttacgtacgttaaccggtaaacttaaaacgtaaaccttaccgaacaacgtaaggttaacgttcggaggacgagtaaccgacacgtacgtaccggacgaccaacctacctaccaaactaacgacgtactacgtaactagtttagtacggtagaccgtcggtacctagaccgttagtacggtacggaccggttcgacccgggttaacgttattagtttacgtggtacggaggtagaaggacgggtacggttacgtttaaacgtcccgttccgagtttacggacttaccggggttacggcgtaacccggggttacccg

SEQ ID NO: 186418 - DNA, 734 bp, Homo sapiens
  misc_feature: GYAE6OF01ALKMS.42.2.A02.1.454.CMB.1.raw
  modified_base (266)..(266): a, c, t, g, unknown or other
  misc_feature (266)..(266): n is a, c, g, or t
  modified_base (503)..(503): a, c, t, g, unknown or other
  misc_feature (503)..(503): n is a, c, g, or t
tcagtgacgtatgtcacgaccggtgctcgatttagactcatctacagggggagcttcacataacgaccaccttcctcctctaaaagaagcccctgggagcacagctcatcaccatggactggacctgggaggttcctcgtttgtggtggcagcagctagaggtcgtccacgtcccaggtgcagctggtgcaggtcgaggggctggaggtagaagagccgtgggtccgtcgggtaggaacgtctaccgtgacgtaaggtctttacgngggacggtcctaccgttgaacggtagctaagtgtaccttcggtaccgtacgtggggtcgtaccggaccgaccgggtcccgaggtaccgaacggtactcggacgtaggtagtaagggtaaattccgtaccgtaccgtacgtaccgttaaggtaaaccttaaacgtaacctacgaacctaagtaacggtaacgttacggacgggactagggaacctaccgtaccgtacgtaaccccggntaaccgtactaccaactacaactacgtacttacgtactagttagtacggttgtacggtccgtacgtagaccgttatcgttaacggacgtacccgtcgtacgtttacttagttacgtcggtagaccggtaaaggacggtaacgggtacgggttaacttaccggtttaacccgacggtacgttaacggtacggttacggggtacggacccggttaaacggtccggttaaccgg

SEQ ID NO: 186419 - DNA, 736 bp, Homo sapiens
  misc_feature: GYAE6OF01BOM3J.42.2.A02.1.454.CMB.1.raw
tcagtgacgtatgtcacgaccggtgctcgatttagactcatctacagggggagcttcacataacgaccatcttcctcctctaaagaagcccctgggagcacagctcatcaccatggactggacctggaggttcctctttgtgggtggcagcagctacgaggtgtccacgtcccagggtgctagcgtggtgtcagtcgaggggctaggaggtagaaggaacgccggttaggggttcccgtgggtaggtaacggttcctcccgtggacgacggttcttcggtacggacggtacctaccgttacgaggttacggactaagtcgtcgtcgtaccgtaccggtgggtacgacgaccggtaccggacccgtagggaacgaacggtccgacggtaggtagggtaacgttaacgggtaactaccgttacccttccggtacgttacgtacggtaaattaaaccaaagtacccgtacaacggtaacgtaacgtttaggacgggtacacgtacgtaccaacgtacgtaccgacgtacaacctactaccaactaacacgtacttacactacgttagtcgtaggcgcgtaccgtagtcgtacttcggacgacggttaccgtccggtacgttaacttacgttacgttagtaggtaccgtaaggaacgggtagggtaccggttaacgttaccttaaccgtcgttaccgtacggtacgttcgggtaacccggttagggaacccggttacccg

SEQ ID NO: 186420 - DNA, 803 bp, Homo sapiens
  misc_feature: GYAE6OF01AG60T.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctcttgtggtggcagcagctacgaggtgtccagtccaggtgcaggctggtgcgaggtcgaggggctggagggtaggaaacggtaacggtcccggtacggggttcccgtcgggtaggaacgggttcctccgtggacgaacggtccgtttcggtcgggggacggtccctacgtttacgaaggtaacgtaccgaaagttcgccgttacgtacggtaaccggtggggtcgacccggtaccggaccccgggtccccgtacgggaacgaaaccggtaccggtagggtacgggttagggaacggttaagggtaaagttcccggttaccgttacccgttaggtaccggttaacggtaaaactttaaaccgaaaacggttacgaccgtaacgtaaacgggttacgtttccggaacgggacgtaacgtaaccggtccctaaaccggtaccgttaacccggacgtactaaccggacctaaccgaacctaaacctaacgtaacttaccgttaaacgtcgttaggtacgttggtacggtacggtacctagaccgtattggacggtacggcgttaccgaccggtttattacggttatggtagcgtaaggtagggacgtacggtactttacgttacccgtcgtacttagtaccgtgggttacggaccggtacggtccggtaccgg

SEQ ID NO: 186421 - DNA, 1105 bp, Homo sapiens
  misc_feature: GYAE6OF01BQMZ0.42.2.A02.1.454.CMB.1.raw
tcagtgacgtatgtcacgaccggtgctcgatttagactcatctacgagggggagcttcacaataacgaccaccttcctcctctaaaagagcccctgggagcacagctcatcaccagtggactggacctgggacggtttccttcgttttggtgggtggcaggcagtctacgtagggtcgtacctacggtcccgagggtcgcgaggtccgttgggtgcgtaggtcggaggggtcgttagggaagggtaagaaggacgtccggttcggggtcccggttacgggtacgaacggttccttccgtagtacggtaacggttcgttacgggtgggtaccggtaccttaaccgttacgtaaggttaacgaccgtaaagtcggtacccgttcggttaacccgtaccgggttacgggggtccgaaccggtaacccggaccccggttaccccgggtaagggaaaacccgaaccggggttccgttacggggtacggttaacgggtaacgggttaaagggtaaacgtttacccgttacccgttaaccgggtttacgttaacggtaacccggttaaaactttaaaaccggaaacccgttaccggtaaccgtaaacggttaacggtttaacgtttaccgggaacgggtaaaccgttaaggtaaccgttaacccggtaaccgttaaccgggttacccggaaccgtaaccgtaacccttaaccgtaaaccccgtaaccgtaaaacccgtacgtttaacgtaaccgttaaacgtttacgggttttaccgggttaaggttacggggttacggtttaaccgggttaaccctttaaacgggttacttaacggtttacgggaaccggggtttaacgggtaaccccggttaaccggggtttaaccggttttaattttaaacgggttacggttttcggggtaaacccgggttaaggggtaaagggttaaaccggggggttaacggggtttaaacccgggtttacgttttaaaaacccccggggtttcccttccccggtaacggggtttaaccggttaccggggttttaacgggggttaacccccggggggaaccctttaaccccggggggttaacgggttttaccccccg

SEQ ID NO: 186422 - DNA, 887 bp, Homo sapiens
  misc_feature: GYAE6OF01BTW4R.42.2.A02.1.454.CMB.1.raw
  modified_base (136)..(136): a, c, t, g, unknown or other
  misc_feature (136)..(136): n is a, c, g, or t
  modified_base (184)..(184): a, c, t, g, unknown or other
  misc_feature (184)..(184): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctnttgtggtggcagcagctagaggtgtccagtcccaggtgcagctggtgntaggtcgagggctggagggtagaagacgtccgttgggtacccttgggtagtaacggtcctccggtagacgtaacggtcctttcgagggacgtacctaccgttacgaagttaggacctaaagtcggtacttcggtaccgtaccggttgggtcggaccgtaaccggaccgggtacccccgtagggaacgtaacggtaccggtacgggtaagggtacggtaaggttaagggtaaacgttacggttacccgtaccccgttaacggttaccgttaaccgggtaaaactttaaaacccgaaaccgtacccgggaacgtaaaccgtaagggttaacgtttaccggaacggggtaacctacgggtaacgtaacccctaaccggtaaaccgttaacccgggaccgaaccctaaccgtaaccgtaacccgtaaacttaacccgaaaccgtaaccgttaccgtaacgttacgtttaaggttacgggttacgtaccgggtacggtacccttaacgggacctttacgtaccgtagggtaaccggttacccgtacgggttaaccttagtttaacgtttagttacgggtggtaacggaagggtaacggtacggggtaacgggtttacctttaaacccggtttcccggacccgttacggttaccggtaaaccgtttcgggggttaacgggccccgtaaacgggtaaccccggttccggg

SEQ ID NO: 186423 - DNA, 812 bp, Homo sapiens
  misc_feature: GYAE6OF01CF4UN.42.2.A02.1.454.CMB.1.raw
tcagtgacgtatgtcacgaccggtgctcgatttagactcatctacagggggagcttcacataacgaccaccttcctcctctaaagaacgcccctgggagcacagctcatcaccatggactggacctggaggttcctctttgtggtggcagcagctacgaggtcgtccagtcccgaggtcgaccagtcgtggtcgccgtaggtccgaaggggctggagggtaggaagaacgccgtcgggtccgtcgggtcgaacggttccgtccgtcggacgtaaggtccttacgtcggacggtccctaccgttacgtacgtacgacgtaacgtcgtacgtcgtaccgtaccggtacgggtcgaccgaccggacccggtacccggtacggaaccggtaacggtacggtacggtacgggtacggtaaggtacggtaacgttccgtaccgtaccgttacgtaccgttacggtaacgttaaaccgaaccgtaccgaacgtaacggtaacggttaacggttacgacggtacgtacgtaccgtaccgtaccgtaccgtacccggaccgtaaccgaacctaccctaacccgaaacctaaccgtaaccgtacgttacgtaacgttacgttaggtacgttacggtacggtcgtaccgtacgtaccgtaacgtcggtacggtacggtaccgtacggttacgttaagttacgttacgtacggtacggtacggaaggtaacgggtacgggtacgttaacgttaccggttaccgtaccggtacgttacggtaacggttacgggtaccgggtaccgttaccggggtacccgtccgg

SEQ ID NO: 186424 - DNA, 677 bp, Homo sapiens
  misc_feature: GYAE6OF01EIBYE.42.2.A02.1.454.CMB.1.raw
  modified_base (497)..(497): a, c, t, g, unknown or other
  misc_feature (497)..(497): n is a, c, g, or t
  modified_base (508)..(508): a, c, t, g, unknown or other
  misc_feature (508)..(508): n is a, c, g, or t
  modified_base (516)..(516): a, c, t, g, unknown or other
  misc_feature (516)..(516): n is a, c, g, or t
  modified_base (569)..(569): a, c, t, g, unknown or other
  misc_feature (569)..(569): n is a, c, g, or t
tcagtgacgtatgtcacgaccggtgctcgatttagactcatctacagggggaggcttcacataacgacctaccttccctcctctaaagaagcccctgggagcacagctcatcaccatggactggacctggacggttcctctttgtggtggcagcagctacaggtgtccagtcccaggtgcagctgggtcgcgagtcgacggggctaggaggtagaaggacggtccgtagggttcccgtcggtagtaacggttcctccgtagaccgaacgggtccttacggtagggacggacctaccgttcgaggttacgctaacgtcggctgtaccgtaccggtggggtacgaccgaccgtacggtccccgaggtaacggaacggtaccgtcgggaaggtcgggtacggttagggaaaacttcggtaccttccgtaaggttcgtacgtaaacgttaaaccaaacgtcgacaacgtaatacgttcgacgggtacagtacgacctaacncgttaacccgngaacctanacctactaactaacaacgtcgtataccgattacgtagtcgagtcgactgactntccgaggacgtacgtccggattacttagttattcggcgagtgagacgggtacgtacttactttacccgcgtatcgtaacgtcggttacggaccggtgacccgttccgg

SEQ ID NO: 186425 - DNA, 916 bp, Homo sapiens
  misc_feature: GYAE6OF01BPC2A.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtctccagtcccaggtgcgagctggtcgcacggtcgaggggctggaggtagaaacggagccgttggggtccgtcggttaggaacggtcctcagacgtaggtcttcgaggacggcctaccgttcaaggttacacgaacgtcgtcttcgtaccgtaccggtaggggtcgaccggaacgtaccggggcccccggttagggaaccggtaacggtaccgtaccggtaaggttacgggacggttaacgggttaaaacttccgggttacccttaccccggttaagggttcccgtaaccgggggtttaaacctttaaaaaccccgtaaaaccggttcccggtaaaccgtaccggttaaaaccggttaacgggttttaacggaacggggttaaaccgaaccgggtaaccgtaacccgtaaccgtaaccgtttaaaccccgggcggtaaccgtaacccgtaaccgtaacccgtaaaccgtaaccaaccggtaccgtttaacgtacccttaaggtttacggtacgtttaggtccgggttacggacgtttacgaaccgttagtacgtacggttacggtacccgttaccggtttaaccgttagtttaactttcggttaagggcggtacgggtaaggtaacggggttaacggggaccggttttaacttaacccggtttccccggaacccggtttcccgttaaacgggaccgggttttttacccggggtaacccggggaccggttaaacccggggttaccccgttaccccggg

SEQ ID NO: 186426 - DNA, 807 bp, Homo sapiens
  misc_feature: GYAE6OF01ARKF9.42.2.A02.1.454.CMB.1.raw
  modified_base (279)..(279): a, c, t, g, unknown or other
  misc_feature (279)..(279): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccgaggtcgccagctggtgctaggtcgaggggtctggacggtgaagaacgtccgttaggggtcccgtcgggtaggtaacggtcctaccgtggaccgtaaggtccgtttcgngggacggcctaaccgttcgaggtagaccaagtcgtctgtaccgtacggttcgggtcgaccgaccgacggaccccgtaggaacgaacggtaccgtcggtaaggtaggtaacggtaggggtaaaacttacggttacccgttacccgtaggttacgtaccggtaactttaaaaccgtaaacgtaccgacgtaaacgaacggttaaacgtttccggaagggacgaagggtactacccgtaaccgtacgttaacccgggtacgaacctaacgaccttaaccgaactaaaccgtacccgaattaaccgtaactagtttacggaacgtttacggtacggtcggtaccgtacgtaccgtacgttacgtaggtaacggtacgttccggtaacgttaagttagtttacgttcggtagtacgggaacggaacggtaaggggtaccggttacgtaaccggttttacccgtacccggttacgtacggttaaccgttacggggttaccgggacccggtaaccgggttaaccccggttacggg

SEQ ID NO: 186427 - DNA, 792 bp, Homo sapiens
  misc_feature: GYAE6OF01AFMEJ.42.2.A02.1.454.CMB.1.raw
  modified_base (164)..(164): a, c, t, g, unknown or other
  misc_feature (164)..(164): n is a, c, g, or t
  modified_base (200)..(200): a, c, t, g, unknown or other
  misc_feature (200)..(200): n is a, c, g, or t
  modified_base (377)..(377): a, c, t, g, unknown or other
  misc_feature (377)..(377): n is a, c, g, or t
tcagtgacgtatgtcacgaccggtgctcgatttagactcatctacgagggggagcttcacataacgaccaccttcctcctctaaagaagcccctgggagcacagctcatcaccatggactggacctggacggttcctctttgtggtggcagccagctacaggtntccacgtcccgaggtgcagctggtcgctacggtcgnggggtctggaggtaggaaggaacggtccgttcggggtccgttcgggtagtaacgggttcctcgtacgacgtacggtcttcggtcgggacggacctaccgttacgaggtacgtacgaagtcggtctacggtcgtaccgtgggtacgcgaccgaccggtcccgtaggacgacggtacgnggtacggtaggacgtaacgggtaacgtcgtaccttccgtacgtacgtacggtaacttaaacgaacctaacgtctaaacgaaggttacgttacggacgggcgtacggtactaccgacgtaccgttaccggacgtaacaaccacgtaccaaccgtaacacgttacgtcctaagtactaggtacgttcacggtccggtactacggaccgtataccggtaggtacccggtacggtaccgggttacccttaagttttggtacgtttaggtacgggtaacgtacggggaaggttacgggggtaacgggtttaacttttaacccggtttaacccggtaacccggttccggttaaacgttcccgggttaacggggttacggggtaaacccccggggttaacccgggtaaccggtttccccggg

SEQ ID NO: 186428 - DNA, 801 bp, Homo sapiens
  misc_feature: GYAE6OF01EB2A4.42.2.A02.1.454.CMB.1.raw
  modified_base (178)..(178): a, c, t, g, unknown or other
  misc_feature (178)..(178): n is a, c, g, or t
tcagtgacgtatgtcacgaccggtgctcgatttagactcatctacagggggagcttcacataacgaccaccttcctcctctaaagaagcccctgggagcacagctcatcaccatgactggacctggagttcctctttgtggtggcagcagctacgaggtcgtaccacgtcccaggtcncagctggtgcagtcgagggtctggaggtgaagtacgccgtgggtccgtcggtagtaacggttcctccgtgacgtaaggtccttcggaggaccgtcctaccgttcgaagtacgactaagtcgtacgtcgtaccgtacggtggtcgaccgaccgaccggacccgtaggaaccgaacgggtcgtacgggtaggtacggtaacggtaacggtaacgttccggttacccgtaccgttacggtaccgtaacggtaactttaaaaccgaaccgtacgtaactaaacgtaacggtttaacgttacggaaggtaccgtaacgggtactacccgtaacccttaaccggttaacccggacccggtaactaacccgttaacctaacccgaaccttaaacgaccgtaaccgtttaacacgttaagtttacggtacgttacggaccggttcgcccgtttaagaccgtagtacggtaacggaccgggtttaccgtaaccggtttacgttactttaagttcgttaggtacggacggtaaggaacgggttagggtacggtttaacttaacgttacccggccgttagtaaccgggttacgtacggggttaccgggcccgggtaaaccgttccggtacccgg

SEQ ID NO: 186429 - DNA, 487 bp, Homo sapiens
  misc_feature: GYAE6OF02JFGUP.42.2.A02.1.454.CMB.1.raw
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctccctgtctgcatctgtaggagacagaatcaccatcacttgccgggcgagtcaggtcattggcgatttttagcctggtatcagcaaaaacctggcacagttcctaagctcctcatctttcctgcttctactttgcaatcagggtcccatctcgcttcagcggcggtggctcgtgggacagatttcactctcaccatcagcagcctgcagcctgaacgatgttaggaacgttattactgtacaagtatattaactttgtcgtctctctacgtttcgggcggggtacagggtggagatcgaagactgtggctgcacatcg

SEQ ID NO: 186430 - DNA, 511 bp, Homo sapiens
  misc_feature: GYAE6OF02H52IK.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctccctagtctcggattaacaaactacgcacagaagtttcagggcagagtcaccattaccgcggacacatccactaacacagtctacattgagttgagtggcctgacatctgagactcggccgtatattattgtgcgagagagaggggctagttaactcccgctgactattggggccagggaccctcgg

SEQ ID NO: 186431 - DNA, 506 bp, Homo sapiens
  misc_feature: GYAE6OF02FYZNT.42.2.A02.1.454.CMB.1.raw
  modified_base (480)..(480): a, c, t, g, unknown or other
  misc_feature (480)..(480): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctggtgcgacaggcccctggacaaggactcgagtggatgggaaatagtctcctagtctcggattaacaaactacgcacagaagtttcagggcagagtcaccattaccgcgacacatccactaacacagtctacattgagttgagtgcctgacatctgaggactcggccgtatattattgtgcgagagaggagggctattaactccgntgactagttgggcgagggaccctcgg

SEQ ID NO: 186432 - DNA, 515 bp, Homo sapiens
  misc_feature: GYAE6OF02IJSB1.42.2.A02.1.454.CMB.1.raw
  modified_base (487)..(487): a, c, t, g, unknown or other
  misc_feature (487)..(487): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggccccctgggacaaggactcggagtggatgggaaatagtctccctagtctcggattaacaaactacgcacagaagtttcagggcagagtcaccattaccgcggacacatccactacacagtctacattgagttgagtgcctgacatctgagactcggccgtatattattgtgcgagagaggagggctatttaacgtcccgntgactagttggggcctagggaccctcgg

SEQ ID NO: 186433 - DNA, 510 bp, Homo sapiens
  misc_feature: GYAE6OF02IA0L7.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctccctagtctcggattaacaaactacgcacagaagtttcagggcagagtcaccattaccgcggacacatccactaacacagtctacattgagttgagtggcctgacatctgaggactcggccgtatattattgtgcgagagagagggctattaactccgcgtgactattggggcctagggacctcgg

SEQ ID NO: 186434 - DNA, 484 bp, Homo sapiens
  misc_feature: GYAE6OF02JYNUE.42.2.A02.1.454.CMB.1.raw
  modified_base (382)..(382): a, c, t, g, unknown or other
  misc_feature (382)..(382): n is a, c, g, or t
tcagtgacgtatgtcacgaccggtgctcgatttagactcatctacaggggaagtctctctcagtcaggacacagcttggacatgagggtccctgctcagctcctgggactcctgctgctctggctcccagataccagatgtgacatccagatgacccagtctccttcctccctgtctgcatctgtaggagacagaatcaccatcacttgccggcagtcaggtcattggcgatttttagcctggtatcagcaaaacctggcacagttcctaagctcctcatctttcctgcttctactttgcaatcagggtcctatctcgcttcagcggcgtggctcgtggacagattcactctcaccatcacgcacgtcctgcagcctagaanatgttagaacgtatactgtcaagtatataactttgtactctcttcgacgtttcggcggggtaccaggtggaatgtacaagactgtcggctggacacgtattc

SEQ ID NO: 186435 - DNA, 553 bp, Homo sapiens
  misc_feature: GYAE6OF02JP4S2.42.2.A02.1.454.CMB.1.raw
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctccctgtctgcatctgtaggagacagaatcaccatcacttgccgggcgagtcaggtcattggcgatttttagcctggtatcagcaaaactggcacagttcctaagctcctcatctttcctgcttctactttgcaatcagggtccatctcgcttcagcggcggtggctcgtgggacagatttcactctcactatcagcagcctagcacgcctagaagtatcgttaggaacgttattacgtagtactaaagttattaacttaacgtttgttaccgtctacttaccgtacgtttccggggaccggggggtaacctaaggggtggtaacggtacgtaaccgaaacggtaaccgttaggttacggaccgtggtaccaccgtacgttccg

SEQ ID NO: 186436 - DNA, 531 bp, Homo sapiens
  misc_feature: GYAE6OF02F7ZKX.42.2.A02.1.454.CMB.1.raw
  modified_base (431)..(431): a, c, t, g, unknown or other
  misc_feature (431)..(431): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctccctagtctcggattaacaaactacgcacagaagttcagggcagagtcaccattaccgcggacacatccactaacacagtctaacattagagttgagtggcctgacntctgaggactcggcgttactattattgtgcgagagaggaggggtataagtttaactcccgtactcggacttagttggggaccctaggggacccttacggg

SEQ ID NO: 186437 - DNA, 520 bp, Homo sapiens
  misc_feature: GYAE6OF02H3JRQ.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctcctagtctcggattaacaaactacgcacagaagtttcagggcagagtcaccattaccgcggacacatcactaacacagtctacattgagttgagtggcctgacatctgaggactcggccgttattattattgtgcgagagaggaggggctagtttaactcccgtatcgtactagttcggggcctagggaccctcgg

SEQ ID NO: 186438 - DNA, 650 bp, Homo sapiens
  misc_feature: GYAE6OF02F7K84.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacccgtgggtcgcgacgaccggccccgtggaacgaacggacctacggaggtggaggtagggtaaatagtcctaccgtagtccgtacggtaacttaaacaaactacgacaacgaaggttaacgtttacgagggacaaggacgtaccaaccgtacgttacccggacggaaccactactacccaactaaaccactacgtacctaactagttgttaggttagtaggtcgtactagactagtcgtaggacgtacgtaccggtaccttaattaagtttagttgcggacgtaggaggaagggtacggggtactttaacgtttaacccgcccgtagtacgtaacgttacgggttaccggggaccgtaaccgggtacccgttaccggg

SEQ ID NO: 186439 - DNA, 505 bp, Homo sapiens
  misc_feature: GYAE6OF02HJXAC.42.2.A02.1.454.CMB.1.raw
  modified_base (381)..(381): a, c, t, g, unknown or other
  misc_feature (381)..(381): n is a, c, g, or t
  modified_base (478)..(478): a, c, t, g, unknown or other
  misc_feature (478)..(478): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctcctagtctcggattaacaaactacgcacagaagtttcaggcagagtcacattaccgngacacatccactaacacagtctacattgagttgagtggctgacatctagaggactcggcgtatatattgtgcgagagagagggctagttactcccgntgactagtcgggacagggtaccctcgg

SEQ ID NO: 186440 - DNA, 521 bp, Homo sapiens
  misc_feature: GYAE6OF02H4SC3.42.2.A02.1.454.CMB.1.raw
  modified_base (429)..(429): a, c, t, g, unknown or other
  misc_feature (429)..(429): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggctctggaggcaccttcagtagcaatgctgtcacctgggtgcgacaggccccctggacaaggactcgagtggatgggaaatgtctccctagtctcggattaacaaactacgcacagaagtttcagggcagagtcaccattaccgcggacacaatccactaacacagtctacattgagttgagtggctgacntctgaggactcggccgtattattattgtgcgagagaggaggggtctaagttaactcccgctgacgtagttggggccgtagggaaccctcggg

SEQ ID NO: 186441 - DNA, 533 bp, Homo sapiens
  misc_feature: GYAE6OF02F1UZ4.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctccctagtctcggattaaacaaactacgcacagaagtttcaggcagagtcaccattaccgcgacacataccactaacacagtactacattgagttgagtggcctgactatctgaggtactcggccgttatacttattgtgcgtagagaggaggggacttagtttaacctccgtacgtgacgttagttcgggccgacgggtaccctacggg

SEQ ID NO: 186442 - DNA, 505 bp, Homo sapiens
  misc_feature: GYAE6OF02IJPAW.42.2.A02.1.454.CMB.1.raw
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctccctgtctgcatctgtaggagacagaatcaccatcacttgccgggcgagtcaggtcattggcgattttttagcctggtatcagacaaaaacctggcacagttcctaagctcctcatctttcctgcttctactttgcaatcaggggtccatctcgcttcagcggcggtggctctgggacagatttcactctcaccatcagcagcctgcagcctgaagattgttggaacgttattactgtacaaagttattaataaacttttgtccgtcttctactacgtttcgggacgggggtaccaagggtggagatacaaacgaactgtggctaggcaccatcg

SEQ ID NO: 186443 - DNA, 520 bp, Homo sapiens
  misc_feature: GYAE6OF02IXUD7.42.2.A02.1.454.CMB.1.raw
  modified_base (469)..(469): a, c, t, g, unknown or other
  misc_feature (469)..(469): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctccctagtctcggattaacaaactacgcacagaagtttcagggcagagtcaccattaccgcggacacatccactaacacagtctacattgattgagtggcctgacatctgaggactcggccgtattattattgtgtcgagagaggnggggacttagttaactcccgactgacttagtggggaccagggacccgtcgg

SEQ ID NO: 186444 - DNA, 521 bp, Homo sapiens
  misc_feature: GYAE6OF02HGBPF.42.2.A02.1.454.CMB.1.raw
  modified_base (489)..(489): a, c, t, g, unknown or other
  misc_feature (489)..(489): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatagggaaatgtctccctagtctggattaacaaactacgcacagaagtttcgaggcagagtacaccattaccgcggacacgatccaactaacacagtctacattagagttgagtcgctgacatcagaggactcggccttatattatgtgacgagagaggagggcttattaacgtcccgntacgtactgttcggggacctagggaccctcgg

SEQ ID NO: 186445 - DNA, 526 bp, Homo sapiens
  misc_feature: GYAE6OF02ISH6U.42.2.A02.1.454.CMB.1.raw
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctccctgtcctgccatctgtaggagacagaatcaccatcacttgccggcagtcaggtcagttggcgatttttagcctggtatctagcaaaaacctggcacagttcctaagctcctcatcttcctgcttctacttgcaatcagggtccatctcgcttcagcggcggtggctcgtgggacagtattcactctcacatcagtcacgctgcacgcctgaagtattgttaggaacgtaattacgtgtactaagtacttaagtaacttttgtctcgtctacgtaccgtttcgggacggggtaaccgtaagggtcggaagtagtaacgaaaccgtaagtcggtggcgttaggctaccgattaccg

SEQ ID NO: 186446 - DNA, 553 bp, Homo sapiens
  misc_feature: GYAE6OF02GPVET.42.2.A02.1.454.CMB.1.raw
  modified_base (485)..(485): a, c, t, g, unknown or other
  misc_feature (485)..(485): n is a, c, g, or t
  modified_base (520)..(520): a, c, t, g, unknown or other
  misc_feature (520)..(520): n is a, c, g, or t
tcagtgacgtatgtcacgaccggtgctcgatttagactcatctactaggggggtagggacttcgaacataacgaccgaccccttccgtccttctaaaggaagcccctggggagcacaggcctcgatcacccagtggaacgtggaccttcggaggttcctctttgtggtggcaggcaggctaacgaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctccctagtctcggattaacaactacgcacagaagtttcagggcagagtcaccattaccgcggacacatccactaacacagtctacattgagttgagtggcctgacatctgaggactcggccgtatattatttgngcgagagaggaggggtactagtttaacctcccgtntcgacttagttcggggcctagggacccttcggg

SEQ ID NO: 186447 - DNA, 519 bp, Homo sapiens
  misc_feature: GYAE6OF02HGQ59.42.2.A02.1.454.CMB.1.raw
  modified_base (384)..(384): a, c, t, g, unknown or other
  misc_feature (384)..(384): n is a, c, g, or t
  modified_base (456)..(456): a, c, t, g, unknown or other
  misc_feature (456)..(456): n is a, c, g, or t
  modified_base (460)..(460): a, c, t, g, unknown or other
  misc_feature (460)..(460): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcaccgtgggtgcgacacggcccctggacaaggactcgagtggagtgggaatagtctcctagtctacgattaacaaactacgacacagtaagttcaggcagagtcacgataccgngacacactaccaactacacagtactacattgagttgagtcgtctgacatctagagactcgcgtataacgttntcgngcgagtagaggagggtctattaccgccgtcgtgacgtgttcgggactacggtacctcgg

SEQ ID NO: 186448 - DNA, 502 bp, Homo sapiens
  misc_feature: GYAE6OF02GMH6L.42.2.A02.1.454.CMB.1.raw
  modified_base (390)..(390): a, c, t, g, unknown or other
  misc_feature (390)..(390): n is a, c, g, or t
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctccctgtctgcatctgtaggagacagaatcaccatcacttgccgggcgagtcaggtcattggcgatttttagcctggtatcagcaaaaacctggcacagttcctaagctcctcatctttcctgcttctactttgcaatcaggggtcccatctcgctttcagcggcggtggctcgtgggacaggattttcactctcaccatcagcagcctgcagcctgaagntgttggaacgttattactgtacaagtattaattaactttgtctctctctacgtttcgggcgggggtactaagggtggaagtactacgaaacgtaactgtggctgcacattcg

SEQ ID NO: 186449 - DNA, 518 bp, Homo sapiens
  misc_feature: GYAE6OF02IPPWS.42.2.A02.1.454.CMB.1.raw
  modified_base (353)..(353): a, c, t, g, unknown or other
  misc_feature (353)..(353): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggccccctgggacaaggactcgagtggatgggaaatgtctccctagtctggattaacaaactacgcanagaagtttcagggcagagtcaccattaccgcggacacatccactaacacagtctacattgagttgagtggcctgacatctgagactcggccgtatattattgtgcgagagaggaggggctagtttaactccgtactgactagttggggaccagggaccctacggg

SEQ ID NO: 186450 - DNA, 595 bp, Homo sapiens
  misc_feature: GYAE6OF02H03DH.42.2.A02.1.454.CMB.1.raw
  modified_base (296)..(296): a, c, t, g, unknown or other
  misc_feature (296)..(296): n is a, c, g, or t
  modified_base (362)..(362): a, c, t, g, unknown or other
  misc_feature (362)..(362): n is a, c, g, or t
  modified_base (398)..(398): a, c, t, g, unknown or other
  misc_feature (398)..(398): n is a, c, g, or t
  modified_base (450)..(450): a, c, t, g, unknown or other
  misc_feature (450)..(450): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctggaggtgaagaagccgtgggtcctcggtgaaggtctcctgacaaggcttcgtggaggcctaccttcagtagacaagtgactgtccaccgtgggtgcgacncggcccctggacgaaggactcggagtggatggaaatgtctcctagtcgtcggaattaacaactacncacagtaagttcaggacagacgtcaccagttaccgngacacactaccactaacactagtctactattagagttgagtgactgtaccgnttacgtaggacggacttcggaccgttaagttaacttagttgtagacgagtacggaggtaacggggttacttaacgtttaaccgtaccccgtacgttacggtacgttacggttacggggtaccctaacggggtaccccgttacggg

SEQ ID NO: 186451 - DNA, 547 bp, Homo sapiens
  misc_feature: GYAE6OF02GHMS7.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctccctagtctcggattaaacaaactacgcacagaagtttcagggcagagtcaccattaccgcgaacacatccaactaacacagtactacattgagttgagtcggcctagacactctgagactcggccgtatattattgtgcgagagaaggaggggtacttaagtttaacctcccgtacttacggtacttaggttcggggacccgtaacggggtacccttacggg

SEQ ID NO: 186452 - DNA, 525 bp, Homo sapiens
  misc_feature: GYAE6OF02IAI1F.42.2.A02.1.454.CMB.1.raw
  modified_base (442)..(442): a, c, t, g, unknown or other
  misc_feature (442)..(442): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctctgcaaggcttctggaggcaccttcagtagcaatgctgtcacctgggtgcgacaggccccctggacaaggactcgagtggatgggaaatgtctcctagtctcggaattaaccaaactaccgacaaccaagtaagtttcgagggcagagtcacctattaccgcgacacactccaactaacacagtactacattgagttgagtgctgacatcgngagctcggccgtatattatgtgcgagagaggagggtctagttaacctccgctagactagttcggggacctagggaccctcggg

SEQ ID NO: 186453 - DNA, 570 bp, Homo sapiens
  misc_feature: GYAE6OF02GN46W.42.2.A02.1.454.CMB.1.raw
  modified_base (434)..(434): a, c, t, g, unknown or other
  misc_feature (434)..(434): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttcgtggaggcaccttcagtagcaatgctgtcacctggtgcgacaggcccctggacaaggactcgagtggatgggaaatagtctccgtagtcgtcggattaacaaactacgcaacagtaagttcagggcagagcaccattaccgcggacacatccaactacacagtacacattgagttgagtgctagactatcngagtacgtcggccgttatattattgtagtcgagcggtaagggaggggtactttaacgtttaaccgtccccggtacgttacggtaaccgttacggtttacgggggacccggtacggggtaaccccgttacccggggg

SEQ ID NO: 186454 - DNA, 540 bp, Homo sapiens
  misc_feature: GYAE6OF02H5MMC.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcacctttcagtagcaatgctgtcacctgggtgcgacacggcccctggacaaggactcgagtggatgggaaatgtctccctagtctcggattaacaaactacgcacagaagtttcagggcagagtcacattaccgcggacacactccactaacacagtctacattgagttgagtggcctagacatctgagtactcggaccgttatattattgtgcgagagaggaggggtacttaagtttaaccgtcccgtgtcgtacgttagttcggggacctacggggtaacccttacggg

SEQ ID NO: 186455 - DNA, 650 bp, Homo sapiens
  misc_feature: GYAE6OF02HZ285.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagcctgggtctcggtgaaggtctcctgcaaggctcgtggagcaccttcagtagcaatgctgtcaccgtgggtgcggacacggcccctaggaccaaggctcgagtcggagtgggaaataggtctccgtagttcgtacggtaattaacgaaactacgacacaagtaacgtttcgaaggggacgaagacggtaccaaccgacgtttacccgacggaccaactactaccaactaaaccacacggtacctaactattgtaacggttgaagtcggtacctagacctagtacgtaggacgtaccgtacggtaccgttattagttaacgttgtacgtacggtagtaaggtagggtaacggggtaccttaaacgtttaacccgtaccccggtacgttacggtaaccgtttagggttaccgggggtacctaccggggggtaaccccttaccgggg

SEQ ID NO: 186456 - DNA, 546 bp, Homo sapiens
  misc_feature: GYAE6OF02HZ24S.42.2.A02.1.454.CMB.1.raw
  modified_base (440)..(440): a, c, t, g, unknown or other
  misc_feature (440)..(440): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcaccgtgggtgccgacaggcccctggaccgaaggactcgagtggagtgggaaatagtctcctagtcgtcggattaacgaaactacgacacaagtaagtttcgagggcagagtcacacgttaccgcgacacatccactaacacagtactacattgagttgagtcgctgacntctagagcgtcggccttatattagtgtgctagaggaggagggtacttaattaaccgtcccgtactcggtacttaggttcggggtaccgtacgggtaacccttcggg

SEQ ID NO: 186457 - DNA, 562 bp, Homo sapiens
  misc_feature: GYAE6OF02IN6IN.42.2.A02.1.454.CMB.1.raw
tcagtgacgtatgtcacgaccggtgctcgatttagactcatctacagggggagcttcgacataacgacctaccttcctcctctaaagaagcccctgggtagtcacaggctcgatacgaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcactgggtgcgacaggcccctggacaaggactcgagtgagtggaaatagtctcctagtctcggaattaacaaactacgcacagtaagttcagggcagagtcaccattaccgcgacacatccaactaacacagtctaacatcgagttagagtggcctgacatccgagaggacctcgggccttattacttattagtgtcgaggtaggaaggacggggtacttaacgttttaacctcccggtattcgtaacgttaggttcggggacccaacggggtacccttccggg

SEQ ID NO: 186458 - DNA, 527 bp, Homo sapiens
  misc_feature: GYAE6OF02FPFJB.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctccctagtctcggattaacaactacgcacagaagtttcagggcagagtcaccattaccgcgtacacatccactaacacagtactacacttgagttgagtggcctgacatctgagactcggccgtatattagttgtgcgagagagaggggctaacgttaacgtcccgtcgtcgacgttacgttgggccgtacgggtaccgtacgg

SEQ ID NO: 186459 - DNA, 517 bp, Homo sapiens
  misc_feature: GYAE6OF02HWGAB.42.2.A02.1.454.CMB.1.raw
  modified_base (284)..(284): a, c, t, g, unknown or other
  misc_feature (284)..(284): n is a, c, g, or t
  modified_base (385)..(385): a, c, t, g, unknown or other
  misc_feature (385)..(385): n is a, c, g, or t
  modified_base (486)..(486): a, c, t, g, unknown or other
  misc_feature (486)..(486): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcactgggtgcgacncggcccctggacaaggactcggagtggatgggaaatagtctcctagtctcggtattaacaactacgcacagaagttcaggcagagtcacattaccgcgacncatccactaacacacgtctacattagagttgagtggctgacatctagagactcggacgtatattatgtgcgagaggaggagggtacttattaacgtcccgntacgactagtggggaccagggtaccctacgg

SEQ ID NO: 186460 - DNA, 523 bp, Homo sapiens
  misc_feature: GYAE6OF02GFCTK.42.2.A02.1.454.CMB.1.raw
  modified_base (462)..(462): a, c, t, g, unknown or other
  misc_feature (462)..(462): n is a, c, g, or t
  modified_base (484)..(484): a, c, t, g, unknown or other
  misc_feature (484)..(484): n is a, c, g, or t
tcagtgacgtatgtcacgaccggtgctcgatttagactcatctacagggggagcttcacataacgaccaccttcctcctctaaaaaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggagcaccttcagtagcaatgctgtcacctgggtgcgacgagcccctggacaaggctcgagtggatgggaaatagtctcctagctcggattaacaactacgcacaagtaagtttcgaggacagagtcaccattaccgcggacacactccactaacacacgtctacattagagttgagtggcctagacatctgagactggacctattacttattgtagngagtagagagggtctagttacnccgtactgactagtcgggacgaacggtaccgtggtaccg

SEQ ID NO: 186461 - DNA, 589 bp, Homo sapiens
  misc_feature: GYAE6OF02GO5EC.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaggctctggagcaccttcagtagcaatgctgtcacctgggtgcgacaggcccctggacaaggacctcgagtggatgggaaatagtctccctagtctcggattaacaaactacgacacagaagtttcaggcagagtcacctataccgacgacacactccactaacacagtctaacattcagttgaagtcggcctggaccacgttcgtgacgggtaccgttcgggtacccgttaagttacttagtttcggtgtaccgtaggtaggaagggtaggggtactttaacgtttaacccgtcccggtacttaggaaccgttaggttacgggggacccctaacggggaaccccttaccgggg

SEQ ID NO: 186462 - DNA, 636 bp, Homo sapiens
  misc_feature: GYAE6OF02FM7Y5.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggaggtgaagagccgtgggtcctcggtgaaggtctcctgcaaggcttcgtggaggcaccttcagtagcaatgctgtcaccgtgggtgcgacacggccccgtggacaaggactcggagtggagtagggaaatagtcctacccgtagtctacggattaaacaactacgcacagtaagttcgaggacagacgtcacctattaccgcgacactactaccaactaacacacgtactacagttagagttggagtcggcctggaacctagttcgtaggacggtaccttccgggaccttaattatttagttggtacggacggtaggacgggtaagggtaacgggggtacctttaaacgttttaaaccccggtcccggtacgttacggtaacccgtttaagggtttccggggggaacccgttaaccgggggtaacccctttaccgggg

SEQ ID NO: 186463 - DNA, 547 bp, Homo sapiens
  misc_feature: GYAE6OF02IMXPX.42.2.A02.1.454.CMB.1.raw
  modified_base (440)..(440): a, c, t, g, unknown or other
  misc_feature (440)..(440): n is a, c, g, or t
  modified_base (509)..(509): a, c, t, g, unknown or other
  misc_feature (509)..(509): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttcgtggaggcaccttcagtagcaatgactgtcaccgtgggtcgcgacacggcccctgggaccaagggactcggaggtggagtgggaaatgtctcctagtctcggattaaacaaactacgacacagtaagtttcaggcagagtcaccattacgcgacacataccactaacacagtctacattagagttgagtcgctgacntctgagctcggcctaattagttattggtagacgtagaggaggtaaggggtcttaatttaccgtcccgtnttacgacttacggtggggaccctacgggtaccctcggg

SEQ ID NO: 186464 - DNA, 522 bp, Homo sapiens
  misc_feature: GYAE6OF02JHBSQ.42.2.A02.1.454.CMB.1.raw
  modified_base (255)..(255): a, c, t, g, unknown or other
  misc_feature (255)..(255): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcagggctgaggtgaagaagcctgggtcctcggtgaaggtctcctgcaaggcttctggaggcaccttnagtagcaatgctgtcacctgggtgcgacaggcccctggacaaggactcgagtggatagggaaatagtctccctagtctcggattaacaactacgcacagaagtttcaggcagagtcaccattacgacggacacatccactaacacacgtactacattgagttgagtcggctgacatcgtagagactcggccgtatattattgtgcgagagaggagggtactagttaacgcccgtagtcgacgtagttcggggcctaggacccgtcgg

SEQ ID NO: 186465 - DNA, 578 bp, Homo sapiens
  misc_feature: GYAE6OF02HTP9T.42.2.A02.1.454.CMB.1.raw
  modified_base (371)..(371): a, c, t, g, unknown or other
  misc_feature (371)..(371): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcacctttcagtagcaatgctgtcacctgggtgcgacaggcccctggacaaggactcgagtggagtgggaaatgtctccctagtctcggattaacaaactacgcacagaagtttcaggtcagngtcaccattaccgcggacacatccactaacacacgtctactattagagttgaggtcggcctagacattacgtgacggactcggccgttattatttattgttagcggtagaggtaaggagggggtaccttaagtttaaccgttccccgtcgttacggtacgttacggtttacgggggtacccgtacggggtaaccccgtttacccggg

SEQ ID NO: 186466 - DNA, 522 bp, Homo sapiens
  misc_feature: GYAE6OF02JCWQ4.42.2.A02.1.454.CMB.1.raw
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctccctgtctgcatctgtaggagacagaatcaccatcacttgccgggcgagtcaggtcattggcgtatttttagccttggtatcagcaaaaacctggcacagttcctaagctcctcactctttcctgcttctactttgcaatcagggtcccatcctcgctttcagcggcggtggctcgtgggacaggtactttcactctcacctatcagcagcctcgcacgcctgaagtatggttcgtaacgtacttactgtacgaagttataattaactttgtacgtcttctcgtacgttgggccggggtacaagggtggaagacgtacaaacggtaacgtggtcggctgactaccgtattcg

SEQ ID NO: 186467 - DNA, 518 bp, Homo sapiens
  misc_feature: GYAE6OF02F9JIY.42.2.A02.1.454.CMB.1.raw
  modified_base (432)..(432): a, c, t, g, unknown or other
  misc_feature (432)..(432): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctccctagtctcggattaacaaactacgcacagaagtttcagggcagagtcaccattaccgcggacacatccactaacacagtctacattgagttgagtggctgacatcngaggactcggcgtatattattgtgcgagagaggagggacttagttaacgtcccgctgactagttgggccgtagggacccttacggg

SEQ ID NO: 186468 - DNA, 836 bp, Homo sapiens
  misc_feature: GYAE6OF02IG30T.42.2.A02.1.454.CMB.1.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
tcagtgacgtatgtcacgaccggtgctcgatttagactcatctacagggggaagtctctctcagtcaggacacagcttggacatgaggtccctgctcagctcctggactcctgctgctctggctcccagataccagatgtgacatccagatgacccagtctccttcctccctgtcctgcatcgtgtagganacagaactcaccattcacttgccgggnagtcaggtcagttggatattttagcctggtatcagtacaaaaaccgtggacactacgttacctaaggtcctcctactacgtaccttttcctacgtctttccgttacgtttgtaccgtaacgttaccgtacggggttcccctaagttcccgtaccggtaccgtttaccgtaacggtccggtaccgggttacgggtaccgttccggtacggggtaaccttaagggtaccgtttaccgtaaccgttaccgttacccgtaacccgtacgttacccgtaacggtcccgtaacggtcccgttaacggtaccggtaaccggtaccgttacggtaaaaccggttacgtttacgggtttaaaccgggttaaccgtttaacggtttaaccgttaaccggtttaaccgtaaacggttaacgtttaaaccgttaaaaccggtttttcggtaaccgtttacccgttaaccggtttacccgttaaccggggttttacccggggaccggggggttaaccttaaaccgggggtacgggttaaccggtaacgggttaacccgttaaaaccggtaaccggtttcggtaaccgggttaccgttacccggtaacgttacccggtaacgttttacccgg

SEQ ID NO: 186469 - DNA, 531 bp, Homo sapiens
  misc_feature: GYAE6OF02HOS9C.42.2.A02.1.454.CMB.1.raw
  modified_base (461)..(461): a, c, t, g, unknown or other
  misc_feature (461)..(461): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagcctgggtctcggtgaaggtctctgcaaggcttctggaggcaccttcagtagcaatgctgtcacctgggtgcgacaggcccctggacaaggactcggagtggatgggaaatagtctccctagtctcggattaacaaactacgacacagaagtttcgagggcagagtcacacttaccgcggacacataccactaacacaagtctacattgagttagagtcggctgacatctgacgactcggcctattattatgtgngagaggaggagggacttacgttaactcccgtagtcgtacgtagttggggaccctaggggtacccttcggg

SEQ ID NO: 186470 - DNA, 510 bp, Homo sapiens
  misc_feature: GYAE6OF02IDT1D.42.2.A02.1.454.CMB.1.raw
  modified_base (451)..(451): a, c, t, g, unknown or other
  misc_feature (451)..(451): n is a, c, g, or t
  modified_base (460)..(460): a, c, t, g, unknown or other
  misc_feature (460)..(460): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaggactcgagtggatgggaaatgtctccctagtctcggattaacaaactacgcacagaagtttcagggcagagtcacattaccgcgacacatccactaacacacgtctacattgagttgagtgctgacatctgagactcggcctatatattgtgngagagaggngggtcttagttaactcccgtatcgacttagtgggccgtacgggacctcgg

SEQ ID NO: 186471 - DNA, 776 bp, Homo sapiens
  misc_feature: GYAE6OF02H2K8V.42.2.A02.1.454.CMB.1.raw
  modified_base (242)..(242): a, c, t, g, unknown or other
  misc_feature (242)..(242): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctgaggtgaagaagcctggtccgtcggtgaaggtctctgcaggcttcnggagctactcagtagcaagtgctgtcaccgtgggtgcgacgaccggtccccgtaggacgaacggaccgtacggagtgggagtagggtaaatacggtcctacccgtaggtaccgtacggtaacttaaaccgaaaacttacgaccaacgtaacgtaaacggttttacgaacggggactaaggtaacggtacctaacccgtaacgtttaacccgggacgggtaaacccacccgtaaacctaccccgaaaacccttaaaccaaccgtaacgttaccttactaacgttaggttaacggtttgtaacggttccggtaccgtagtacgtacgttaccgttaagggtaccggtaaccggttccgggtaaccgtttaacgttttaagtttaacgtttagggtacggtacggtaacggaacgggtaggggtaacggggttaaccgtttaaaccgtttaacccggttacccgttaccgtaacggttaaccggttaaccgggttccggggtaacccggtacccgggggttaccccttaacccgggg

SEQ ID NO: 186472 - DNA, 545 bp, Homo sapiens
  misc_feature: GYAE6OF02HH300.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcggagtggatgggaaatagtctccctagtctcggattaacaaactacgcacagaagtttcagggcagagtcaccattaccgcggacacatcccactaacacacgtactacattgagttggagtgcctgacatcgtagacggctcggccgttatattattgtgacgagaggaggaggggtcttaagtttaaccgtcccgtcttcggacttacggttacgggggcctacgggacccgttccggg

SEQ ID NO: 186473 - DNA, 549 bp, Homo sapiens
  misc_feature: GYAE6OF02HI9LQ.42.2.A02.1.454.CMB.1.raw
  modified_base (505)..(505): a, c, t, g, unknown or other
  misc_feature (505)..(505): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggagcaccttcagtagcaatgctgtcacctgggtgcgacaggcccctggacaaggacctcgagtcgggatgggaaatagtctcccgtagtctcggaattaacaaactacgcacagaagtttcaggcagagtacaccattaccgcggacacactccaactaacacagtactaacattgagttgagtcggcctgacatctaggacggtactcggccgttattattagttgtgcgaggaggaggaggggtcttaagtttaaccncccgtatacgaccgttagttcggggacctacgggtaccctcggg

SEQ ID NO: 186474 - DNA, 572 bp, Homo sapiens
  misc_feature: GYAE6OF02JDCUA.42.2.A02.1.454.CMB.1.raw
  modified_base (454)..(454): a, c, t, g, unknown or other
  misc_feature (454)..(454): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcagggctgaggtgaagaagcctgggtcctcggtgaaggtctcctgcaaggcttcgtggacggcaccttcagtagcaatgctgtcacctgggtgcgacacgggcccctggaccaaggactcgagtcggatagggaaatacgtctccctaggtctacggtattaaacaaactacgacaacagaagtttacgagggctagacgtacaccgattacccgcgacacactaccaactaacacgatacctacattgtagtgagtgcctgactntctaggacgtacgtccggacgttaacttattacttgtgacgagagtaggaggggtcttaagtttaaccgccgtactacggtacgttacgttcgggaccgtacgggtacccgttacggg

SEQ ID NO: 186475 - DNA, 637 bp, Homo sapiens
  misc_feature: GYAE6OF02JJIW1.42.2.A02.1.454.CMB.1.raw
  modified_base (119)..(119): a, c, t, g, unknown or other
  misc_feature (119)..(119): n is a, c, g, or t
  modified_base (194)..(194): a, c, t, g, unknown or other
  misc_feature (194)..(194): n is a, c, g, or t
  modified_base (546)..(546): a, c, t, g, unknown or other
  misc_feature (546)..(546): n is a, c, g, or t
  modified_base (559)..(559): a, c, t, g, unknown or other
  misc_feature (559)..(559): n is a, c, g, or t
  modified_base (598)..(598): a, c, t, g, unknown or other
  misc_feature (598)..(598): n is a, c, g, or t
tcagtgacgtatgtcacgaccggtgctcgatttagactcatctacaggggaagtctctctcagtcaggacacagcttggacatgagggtccctgctcagctcctggactcctgctgctntggctcccagataccagattgtgactatccagatgacccagtcctccttcctccgtgtctgctaatctagtaggntacagaatcaaccatcgacttcggcccgggagtaatccgaggttcaattcgggactagttttttacgccgtagggttacttaccgagacctaaaaaacccgttggaccgtaactaagtttacccgtaagaccgttcctacaacttaccgttttcctgaccttttctaaccttttgtacgaaattcccgtagggttccctaatcccgttgtcctttacacggtccggtcggttggaaccttcggtcgggaaacttcggaacttttcaccttcgtcacgtactgacgtcagccttgcttaacgccgtagtagtaacttggtacggtaacgttactactcggtaacattaacgtnttaaacttgcgtnttactctaacggtttcgggaccggttagagttaacgggntaacgtcgaaagtccgtagcggtactcgtacgagtactg

SEQ ID NO: 186476 - DNA, 525 bp, Homo sapiens
  misc_feature: GYAE6OF02GXR0X.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttcgtggaggcaccttcagtagcaatgctgtcacctgggtgcgacaggcccctggacaaggactcgagtggatgggaaatagtctcctagtctcggattaacaaactacgcacagaagtttcagggcagagtcaccattaccgcggacacatccactaacacagtctacattgagttgagtggcctgacatctgacggactcggccgttatattattgtgcgagagaggaggggcttagtttaactcccgctcgacttagttcggggcctacgggacccttcggg

SEQ ID NO: 186477 - DNA, 648 bp, Homo sapiens
  misc_feature: GYAE6OF02GG910.42.2.A02.1.454.CMB.1.raw
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
  modified_base (285)..(285): a, c, t, g, unknown or other
  misc_feature (285)..(285): n is a, c, g, or t
  modified_base (453)..(453): a, c, t, g, unknown or other
  misc_feature (453)..(453): n is a, c, g, or t
tcagtgacgtatgtcacgaccggtgctcgatttagactcatctacaggggagcgttcacataacgacaccttcctcctctaaagaagccctggagcacagctcatcacatggactggacctggaggttcctctttgtggtggctagcagctacaggtgtccagtcccaggtgcagctgggtgacagtcgagggctgaggtgaagagcgtgggtcctcggtagaaggtcctccgtgcaaggtcttcgnggacgcgaccttnagtagcaatgctgtcgacctgggtncggacaggcccctggacgaaggctcggagtggaagtgggaaataggtctccgtagtcgtacgagttaaacaactacgacacaaggtaacgtttcgaagggtcaaggtaacgtcgaaccaagttacccgacggaacacacgtacaccgtaaaccacgaacgtacctaanactttaggaatttcggaaggttgacctaggtaccagtactaggtaccggtaactcccggggacgttaacgtacgtttagttacggtagtacgtaacgaagggttaccggtaaggggtacttaaacgttttaaccgcccgtaaggttacgtaccgttaaggtttcggggaaccctagggggtaaaccccttcgggg

SEQ ID NO: 186478 - DNA, 539 bp, Homo sapiens
  misc_feature: GYAE6OF02F9155.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcactgggtgcgacaggcccctggacaaggctcgagtggatgggaaatgtctccctagtctcggattaacaaactacgcacagaagtttcagggcagagtcaccattaccgcggacacatccactaacacagtctacattgagttgagtggactgacatctgaggactcggccgtattattagttgtgcgagagaggaggggacttaacgttaaccgtcccgtacgtacgacgttaaggttcggggaccgtacgggtaacccttaccggg

SEQ ID NO: 186479 - DNA, 587 bp, Homo sapiens
  misc_feature: GYAE6OF02IDWDZ.42.2.A02.1.454.CMB.1.raw
  modified_base (244)..(244): a, c, t, g, unknown or other
  misc_feature (244)..(244): n is a, c, g, or t
  modified_base (355)..(355): a, c, t, g, unknown or other
  misc_feature (355)..(355): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggaggtgaagaagcctgggtcctcggtgaggtctcctgcaggcttcnggagcaccttcagtagcaatgctgtcacctgggtcgcgacacggcccctggacaagggactcgagtggagtgggaaatagtctcctagtctcggattaacaactacgcaanagtaagtttcgagggacagacgtacaacctagttaccgacggacaccaactccaactaacacagtactactattcgtagttgagtgctgacagtctaggagaccgtcgggaccttagttacttagttgttagcgaggaaggagggaacggggtcttaacgttttaacctccccggtgttacggtaccgttaacgggtttcggggaccgtaccggggtaaccccgttacgggg

SEQ ID NO: 186480 - DNA, 543 bp, Homo sapiens
  misc_feature: GYAE6OF02FQ4I1.42.2.A02.1.454.CMB.1.raw
  modified_base (283)..(283): a, c, t, g, unknown or other
  misc_feature (283)..(283): n is a, c, g, or t
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctccctgtctgcatctgtaggagacagaatcaccatcacttgccgggcagtcaggtcagttggcgtatttttagcctggtatcagcaaaaacctggcacagttcctaagctcctnactctttcctgctttctactttgctaatcacgggtcccatctcgcttcagcggcggtggctcgtgggactaggactttcactctcaaccatcagcacgtcctgccagccgtagaagattgttaggaacgttattacgtgtacaaagttataattaactttgtaccgtcttctactacgtttccgggaccggggggtaactaagggtcggaagtagtacgtaaacggtacgtggtacggactggacctaccgtattaccgg

SEQ ID NO: 186481 - DNA, 615 bp, Homo sapiens
  misc_feature: GYAE6OF02JJ98A.42.2.A02.1.454.CMB.1.raw
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctccctgtctgcatctgtaggagacagaatcaccatcacttgccggcgagtcaggtcattggcgtatttttagcctggtatcagacaaaacctggcacagttcctaagcctcctcactctttcctgtcttctactttgctatcagggtccatctcgcttcagtcggtcggtggctcgtgggactagatttcactcctaccacctactcacgcacgtcctacgacgtaccgtacgtaagaagttcgttacggttaaccgttaactttacgttacgttacgtaacgttaagttatttaaacgtttacgtttacgttaccttcgttaccgttacgttttaccggggtccggggggtaccggttaacgggtacggggtaacggtaacgtacgtaaaccgtaacggttaggttacggtcggtaccgaccgtaccgttaccgtcgttaaccgg

SEQ ID NO: 186482 - DNA, 531 bp, Homo sapiens
  misc_feature: GYAE6OF02GJLGZ.42.2.A02.1.454.CMB.1.raw
  modified_base (433)..(433): a, c, t, g, unknown or other
  misc_feature (433)..(433): n is a, c, g, or t
  modified_base (457)..(457): a, c, t, g, unknown or other
  misc_feature (457)..(457): n is a, c, g, or t
  modified_base (460)..(460): a, c, t, g, unknown or other
  misc_feature (460)..(460): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagcctgggtcctcggtgaaggtctcctgcaaggcttcgtggaggcaccttcagtagcaatgctgtcaccgtgggtgcgacacggcccctggacaaggactcggagtggagtggaaatgtctcctagtctcgattaacaactacgacacagtaagttcagggacagacgtcaccagttaccgcgacacactaccactaacacagtctactattgagttgagtgctgacntcgtgagctcggccgttatacttntgngcgagnggaggngggtacttaacgttaccgtcccgtctacgtacttagtcggggcctacgggtacctcggg

SEQ ID NO: 186483 - DNA, 547 bp, Homo sapiens
  misc_feature: GYAE6OF02HKGXM.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacacggcccctggacaaggactcgagtggatgggaaatgtctccctagtctcggattaacaaactacgcacagaagtttcagggcagacgtcaccattaccgcgacacatccactaacacacgtactacattgtagttgagtgcctgacatcgtagaggactcggaccgtatattattgtagcggagaggtaggaggggtacttaagtttaaccgtacccgtcgtacgtacttacgttacggggacctacgggtaacccttcggg

SEQ ID NO: 186484 - DNA, 725 bp, Homo sapiens
  misc_feature: GYAE6OF02I8V10.42.2.A02.1.454.CMB.1.raw
  modified_base (284)..(284): a, c, t, g, unknown or other
  misc_feature (284)..(284): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctgaggtgaagaagcctgggtcctcggtgaacggtctcctgcaaggcttcgtgggacgcaccttcagtagcaatgctgtcgacgtgggtncgacacggccccgtaggacgaaggaccgtcggagtagggagtagggaaactcgtactaccctaggtcgtaccggtaattaaaccgaaacgtaccgacaacgaaggtaaacgttttcgaagggctaaggacgttacaacctacgttacccgcggaaactaccaatacccactaaacactacgtctaactagttgtaagttcgaaggtcgacctagtacgactttcgggtacgaacggtaccgtaccgggtacgttaaactttagtttaacggtttacggtacggtaacggtacggtaaggtaacggggtaacggggttaacccgtttaaacgtttttaaaccccggtaccccgttaaccggtttacggttaacccggttttaaaggggtttccccggggggtaaccccgtaaaccgggggttaacccccgtttacccggggg

SEQ ID NO: 186485 - DNA, 541 bp, Homo sapiens
  misc_feature: GYAE6OF02INAJL.42.2.A02.1.454.CMB.1.raw
  modified_base (457)..(457): a, c, t, g, unknown or other
  misc_feature (457)..(457): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcagggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctccctagtctcggattaacaaactacgcacagaagtttcagggcagagtcaccattaccgcggacacatccactaacacagtctacattgagttgagtgcctgacatctagaggactcggcgtatattattgtgngagaggaggaggggtcttagtttaaccgtcccggtacttacgtacgttacgttgggggaccctacggggtaacccgttaccggg

SEQ ID NO: 186486 - DNA, 544 bp, Homo sapiens
  misc_feature: GYAE6OF02I2I2R.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggccccctggacaaggactcgagtggatgggaaatagtctcctagtctcggattaacaaactacgacacagaagtttcagggcagagtcaccattaccgcgacacatccactaacacagtctacattgagttgagtggcctgacatctagacggactcggccgttatacttattgtgcgagacggaaggaggggtacttagtttaaaccgtcccgacttcgtacgttagttcggggacccgtacggggaacccttcggg

SEQ ID NO: 186487 - DNA, 529 bp, Homo sapiens
  misc_feature: GYAE6OF02H2WDJ.42.2.A02.1.454.CMB.1.raw
  modified_base (367)..(367): a, c, t, g, unknown or other
  misc_feature (367)..(367): n is a, c, g, or t
  modified_base (493)..(493): a, c, t, g, unknown or other
  misc_feature (493)..(493): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttcgtggaggcaccttcagtagcaatgctgtcacctgggtgcgacacggcccctggacaaggactcgagtggatgggaaatagtctaccctagtctcgattaacaactacgcacagtaagttcaggnagatcacagttaccgcgacacatccactaacacagtctactattcgagttgagtcgctagactatcagaggtactcgggaccttatacttattgtgacgagagaggagggtcttattaacctccgntagtacgtagttcggggacctagggacccttacggg

SEQ ID NO: 186488 - DNA, 544 bp, Homo sapiens
  misc_feature: GYAE6OF02FR1VS.42.2.A02.1.454.CMB.1.raw
  modified_base (281)..(281): a, c, t, g, unknown or other
  misc_feature (281)..(281): n is a, c, g, or t
  modified_base (438)..(438): a, c, t, g, unknown or other
  misc_feature (438)..(438): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctggggtncgacaggcccctggacaaggactcgagtggatgggaaatagtctcctagtctcggattaacaaactacgcacagtaagtttcagggtcagagtcaccattaccgcggacacactaccactaacacagtactacattgagttgagtgcctgacatcgngagactcggccgttatattattgtgcgagaggaggaggggtcttaacgtttaaccgtcccgtacttacgtacgttagttcggggacctaacggggtacccttcggg

SEQ ID NO: 186489 - DNA, 550 bp, Homo sapiens
  misc_feature: GYAE6OF02I1KRC.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagcctgggtcctcggtgaaggtctcctgcaaggcttcgtggaggcaccttcagtagcaatgctgtcacctggggtgcgacaggccccgtggacaaggctcgagtggatagggaatgtctccgtagtctacggattaacaaactacgacacagtaagtttcgaaggcagagtcacctattaccgcgacacactaccacaacacagtactactattgagttgagtcgctgactatcgtgacgtacgtcggacttattattagttgtgcgagaggacgggaggggtcttacgtttaacctccggtactagtacgttaggttcgggaccgtacgggtacccttacgggg

SEQ ID NO: 186490 - DNA, 685 bp, Homo sapiens
  misc_feature: GYAE6OF02JQ0KE.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcagggctgaggtgaagaagcctgggtcctcggtgaaggtctcctgcaaggcttcgtggagcaccttcagtagcaatcgctgtcaccgtggtgcgacacggcccctggacaaggactcgagtggagtagggaatacgtctaccgtagtcgtacggtaacttaaacgaaacttaccgactaacgtaagtaaacgtttacgaaggggtaccaaggtaacggtaccaccgtaagtaccgacgggaaccacactacccgaactaacactaacgtactaactattacgagtttacgaggttacgacctagacctagttacgtacggacggtaaccgtcgggtaacccgtttaagttacgtttaagttacggtacgtaccggtaggtaacgggtaacgggtaacgggggtaactttaacggtttaacccgttacccggtaccgttaacggttaacgtttacgggtttacggggtaccggtaacgggtaccccggtttaccgggg

SEQ ID NO: 186491 - DNA, 555 bp, Homo sapiens
  misc_feature: GYAE6OF02IU29I.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagccgtgggtcctcggtgaaggtctcctgcaaggcttctggaggcaccttcagtagcaatgctgtcaccgtgggtgcgacacggccccgtggacaaggactcgagtggagtgggaaatagtctcccgtagtctacggtacttaaacaaacctacgacaacacgtaagtttcgagggtcagagtacaccattaccgacggacacactccaactaacacagtctaacattgagttgagtgcctgactatctagacgactcggacgttaatattatgtagcgagagaggagggtactattaacgtcccgtagtgtaacgttacgtggggtaccgtacggggtaccctacggg

SEQ ID NO: 186492 - DNA, 573 bp, Homo sapiens
  misc_feature: GYAE6OF02H17MK.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcactgggtgcgacacggccctggacaaggctcgagtggatgggaaatacgtctccctagtctacgtattaacaactacgcacagaagtttcgagggtcaggacgtacaccctaagttacccgacggaccacacgtacccaactaaccacaacgtactaactattagagttgagtggcctagactatcgtaggacggtactacggacgttattattattgtagacgagaggaggaaggggtacttaagtttaaccgcccgtgtacgtacttaggttcggggtaccgtacgggtacccgttacggg

SEQ ID NO: 186493 - DNA, 526 bp, Homo sapiens
  misc_feature: GYAE6OF02F0ZYM.42.2.A02.1.454.CMB.1.raw
  modified_base (463)..(463): a, c, t, g, unknown or other
  misc_feature (463)..(463): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcactgggtgcgacaggcccctggacaaggactcgagtggatgggaaatgtctcctagtctcggattaacaactacgcacagaagtttcagggcagagtcaccattaccgcgacacatccactaacacagtctacattgagttgagtggcctgactatctaggaggactcggtcctattagttattgtgcgagnggaggagggcttaagttaaccgtccgactagactagttacggggccctagggtacccctcggg

SEQ ID NO: 186494 - DNA, 619 bp, Homo sapiens
  misc_feature: GYAE6OF02JB2YU.42.2.A02.1.454.CMB.1.raw
  modified_base (287)..(287): a, c, t, g, unknown or other
  misc_feature (287)..(287): n is a, c, g, or t
  modified_base (352)..(352): a, c, t, g, unknown or other
  misc_feature (352)..(352): n is a, c, g, or t
tcagtgacgtatgtcacgaccggtgctcgatttagactcatctactagggggggagcttcacataacgacccacccttcctcctctaaagaagcccctgggagcgcagctcatcaccatggactggacctggaggttcctctttggtggtggcagcagctacaggtcgtccagtcccacggtgcagctggtcgcagtcagggctgaggtgaagagccgtgggtcctcggtgaggtctcctgcaagctctggagcacctcagtagcaatgctgcacctgggtgcgacncggcccctggacgaggctcgagtcggagtagggaatagtctcctagtctacggataacaaacgtnacagagtaagttcgaggacagactacgaccataccgacgtaacactatacccaacaacacgtagtctaaccgtattagtacgttagtacggtacggtctacgtaacctagtccgtacggtacggtaaccgtccggggtaacctttactttattaacggttcgtacggtaccgttaggacgtaggggtaacgggtacttaacgtttaacccgcggttaccgtacgttacggttacggttacggggcccttaacgggttaccccgtggg

SEQ ID NO: 186495 - DNA, 536 bp, Homo sapiens
  misc_feature: GYAE6OF02IP66P.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctcctagtctcggattaaacaaactacgcacagaagtttcaggcagagtcacctattaccgcgacacatccactaacacagtctacattagtgtgagtaggcctgacatctgacgacgtcggccgttaagtattattgtgcgagagaggagggtacttagtttaacctccggtcttagtacgtagttcgggggacctacgggtacccctacggg

SEQ ID NO: 186496 - DNA, 544 bp, Homo sapiens
  misc_feature: GYAE6OF02HJHZ3.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagcctgggtcctcggtgaaggtctcctgcaaggcttcgtggaggcaccttcagtagcaatgctgtcacctgggtgcgacacggcccctggacaaggactcgagtggatagggaatagtctcctagtctggattaacaaactacgcacagaagtttcaggcagagtacacattaccgacgacacatccactaacacatctactattgagttgagtcggctgactatctagacggactcggacgttattattattggtagcgagagacgggagggtaccttagttaaccgtcccgattacgtacgttacggttacggggaccgtacgggtacccgtccggg

SEQ ID NO: 186497 - DNA, 526 bp, Homo sapiens
  misc_feature: GYAE6OF02HZM0M.42.2.A02.1.454.CMB.1.raw
  modified_base (391)..(391): a, c, t, g, unknown or other
  misc_feature (391)..(391): n is a, c, g, or t
  modified_base (417)..(417): a, c, t, g, unknown or other
  misc_feature (417)..(417): n is a, c, g, or t
  modified_base (432)..(432): a, c, t, g, unknown or other
  misc_feature (432)..(432): n is a, c, g, or t
  modified_base (456)..(456): a, c, t, g, unknown or other
  misc_feature (456)..(456): n is a, c, g, or t
  modified_base (464)..(464): a, c, t, g, unknown or other
  misc_feature (464)..(464): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctccgtgcaagggcttcgtggaggcaccttcagtagcaatgctgtcaccgtgggtgcgacacggcccctggacaaggctcgagtggagtagggaatgtctcctagtctcggaattaacaaactacgacacagtaagtttcgaggacagatcacctattaccgngacacactaccactaacacagtctanattgagttgagtgcngacatctgacgactcggccttatnttatgtgngagagaggaggcttagttacctccgtatcgtacgttacgtcgggacctacgggtacctccgg

SEQ ID NO: 186498 - DNA, 791 bp, Homo sapiens
  misc_feature: GYAE6OF02FLI5U.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtccccaggtgcagctggtgcagtcaggggctgaggtgaagaagccgtgggtcctcggtgaaggtctcctgcaaggcttcgtggacggcaccttcagtagcaatgctgtcaccgtgggtcgcgtacacggccccgtggaacgaaggtacctcggaggtgggaatacgggaaattacgtcctcccgtagtccgtacgggtaactttaaaccgaaaccgttacgacctaaacgtaaggtaaacgttttccgaaggggtacctaacgggtaacgttacccgaacccgtaacgtttacccggacccggtaaaccaacgtaacgttacccgaaaccgttaaaccgaaccgtaacggttaccttaaaccagttttacggtaacgtttacggtaacggttaccggtacccgttaggtaaccgttaccgtttacgtagggtaacggtacccgttaccggtacccgtttaaagttaacgttttaagtttcgggttacgtaccggaagggtacggtaacggggtaacgggggttacctttaaaccggttttaaacccgtaccccggttaccgttacggttaaccgtttaacggggtacggggtaccccggtaaccggggtaacccgttacccgggg

SEQ ID NO: 186499 - DNA, 537 bp, Homo sapiens
  misc_feature: GYAE6OF02J2L74.42.2.A02.1.454.CMB.1.raw
  modified_base (373)..(373): a, c, t, g, unknown or other
  misc_feature (373)..(373): n is a, c, g, or t
  modified_base (500)..(500): a, c, t, g, unknown or other
  misc_feature (500)..(500): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagcctgggtcctcgggtgaaggtctcctgcaaggcttctggaggcaccttcagtagcaatgctgtcacctgggtgcgacaggcccctggacaaggactcgagtggactgggaaatagtctcccgtagtcgtcggattaacaaactacgcacagaagttcagggcaggntcacattaccgcgacacatccactaacacacgtctacattgagtttgagtggcctgacatctgaggactccggcgttaatacgtttatgtgccgtagaggtaggaggggtactacgttaactcccgntacgtacgtagttcgggggactacggggtaccctcgg

SEQ ID NO: 186500 - DNA, 518 bp, Homo sapiens
  misc_feature: GYAE6OF02JEUZW.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggagcaccttcagtagcaatgctgtcacctgggtgcgacaggcccctggacaaggactcgagtggatgggaaatagtctccctagtctcggattacaaactacgcacagaagtttcagggcagagtcaccattaccgcggacacatccactaacacagtctacattgattgagtggctgacatctgaggactcggccgtatattattgtgcgagaggagtaggggcttagttaacctccgacgtgtacgtagttgggccgagggtacccgtcgg

SEQ ID NO: 186501 - DNA, 569 bp, Homo sapiens
  misc_feature: GYAE6OF02FMVOR.42.2.A02.1.454.CMB.1.raw
  modified_base (391)..(391): a, c, t, g, unknown or other
  misc_feature (391)..(391): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctggtgaaggtctcctgcaaggcttcgtggaggcaccttcagtagcaatgctgtcaccgtgggtgcgacaggcccctggacaaggctcggagtggactgggaaatgtctcctagtctcggattaacaactcgacacagaagtttcaggcagagtcacctattaccgcgacactanaccactaacactagtactacattagagttgagtcgactgactgtctagagtacgtcggaccgttataacgttattgtacgcgagtagacggtaggggtaccttaacgtttaacccgtcccggttacgtacggtaacttacgggttacggggacccgtacggggtaaccccttaccggg

SEQ ID NO: 186502 - DNA, 565 bp, Homo sapiens
  misc_feature: GYAE6OF02GWOQD.42.2.A02.1.454.CMB.1.raw
  modified_base (243)..(243): a, c, t, g, unknown or other
  misc_feature (243)..(243): n is a, c, g, or t
  modified_base (283)..(283): a, c, t, g, unknown or other
  misc_feature (283)..(283): n is a, c, g, or t
  modified_base (349)..(349): a, c, t, g, unknown or other
  misc_feature (349)..(349): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagcctgggtcctcggtgaaggtctcctgcaaggcttcnggaggcaccttcagtagcaatgctgtcactgggtgcgacnggccctggacaggactcgagtggatagggaatgtctaccgtagtctcggaataacaactacgacanagtaagttcgaggacagatcaccattaccgcgactacatccaactaacacagtactactagttagagttagacggtgaccgtagtacacttatacgaggaccgtccggtacgttagttaagtttagtagttagcgaggtaggaaggtaagggtcttaaagttacccgtcccgtagtacgtacgttaggttccgggaccgtacgggtacccgtacgg

SEQ ID NO: 186503 - DNA, 677 bp, Homo sapiens
  misc_feature: GYAE6OF02J018W.42.2.A02.1.454.CMB.1.raw
  modified_base (260)..(260): a, c, t, g, unknown or other
  misc_feature (260)..(260): n is a, c, g, or t
tcagtgacgtatgtcacgaccggtgctcgatttagactcatctacaggggagcttcacataacgaccaccttcctcctctaaagaagcccctgggagcacagctcatcaccatggactggacctggaggttcctctttgtggtggcagcagctacaggtgtccagtcccaggtgcagctggtgcagtcagggctgaggtgaagaagcctgggtcctggtgaagtctcctgcaaggcttcgtgggagcaccttcagtacgnaatgctgtcaccgtgggtgcgacgacggccccgtggacgaaggacgtccgagtgggacgtgggaaagtagtcctcctaggtctcggtattaacgaaacttacgactacagaagtttacgaggtcgacggagttaccgaacctaacgttaccgacggtaacgaccagtacccaacgtaacaaccgtaagtacctaacgattagacgtttagagtacggtccgtaggtaccctagttacctaggtaacggtaccgtaccgggtacccgttaactttaacgttaccgttaggtttacgaacggttacggaaggtaacgggtaacgggggtactttaacggtttaacccgttcccggtaacgttacggttaacttacgggttaccgggtaccgggtaaccggttaccccggttaacccggg

SEQ ID NO: 186504 - DNA, 513 bp, Homo sapiens
  misc_feature: GYAE6OF02FP4EP.42.2.A02.1.454.CMB.1.raw
  modified_base (470)..(470): a, c, t, g, unknown or other
  misc_feature (470)..(470): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctccctagtctcggattaacaaactacgcacagaagtttcagggtcagagtcaccattaccgcggtacacatccactaacacagtctacattgagttgagtggcctgacatctagagactcggccgtatattattgtgcgagagaggngggctagttaacctccgctgactagttgggcagggaccctcgg

SEQ ID NO: 186505 - DNA, 628 bp, Homo sapiens
  misc_feature: GYAE6OF02JW5YK.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctggaggtgaagaagcctgggtcctcggtgaaggtctcctgcaaggcttcgtggaggcaccttcagtagcaatgctgtcctaccgtggggtcgcgacgacggccccgtggacaaggactcggagtggagtagggaatgtctacctagtcgtcggaataacaactacgcactagaacgtttacgaggtacagagtaccaacacttaccgacggacacactacctaacgtaaccactacgtactaactagttagtacgttagaacggtcggccttaggacctattcgtagaacggtacgttaccgggtacgttaagttacgtttattcgggtagtacggtacgtaaggtacgggtacggggtacttaacgtttaacccgtcccgtacgttacgtacgttacgggttcgggacccgtacggggtaaccccgttcggg

SEQ ID NO: 186506 - DNA, 655 bp, Homo sapiens
  misc_feature: GYAE6OF02JVUDU.42.2.A02.1.454.CMB.1.raw
  modified_base (524)..(524): a, c, t, g, unknown or other
  misc_feature (524)..(524): n is a, c, g, or t
tcagtgacgtatgtcacgaccggtgctcgatttagactcatctacaggggagcttcacataacgaccaccttcctcctctaaagaacgcccctgggagcacagctcatcaccatggactggacctggaggttcctctttgtggtggacagcagctacaggtgtccagtcccaggtgcgagctggtgcagtcgagggctgaggtgaagaagccgtagggtcctcggtgaaggtctccgtgcaaggcttcgtggagctaccttcgagtagcaagtgctgtcaccgtgggtcgcgtacgcggccccgtggaccgaaggacgtcggagtacggagtagggtaaatcgtcctaccgtacggtccgtacggtaacgtaaacgaaacgttacgacacgtaagtaaacgtttcgaagggacaaggacgttaccaaccgtaacgttacccggccggaacgacactaccgaaccaactaccgtacgtaccttacaacttagtacgttagacggttacgccgtagtacgtatcgngtaacggtacgtacggtacgttaagtacgttagttacgtacgtaccgtagtaggaggtacgggtacttacggttaacccgtaccgtacgttacggtacgtagttccgggaccgtacggtacccttaccggg

SEQ ID NO: 186507 - DNA, 535 bp, Homo sapiens
  misc_feature: GYAE6OF02HAHEI.42.2.A02.1.454.CMB.1.raw
  modified_base (279)..(279): a, c, t, g, unknown or other
  misc_feature (279)..(279): n is a, c, g, or t
  modified_base (431)..(431): a, c, t, g, unknown or other
  misc_feature (431)..(431): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcagggctgaggtgaagaagcctgggtcctcggtgaaggtctcctgcaaggcttcgtggaggcaccttcagtagcaatgctgtcacctgggngcgacaggcccctggacaggactcgagtggatagggaatagtctcccgtagtctcggattaacaaactacgacacaagaagtttcgaggcagagtccacctataccgcgacacataccactaacacagtcacatgtagtgagtgctgacatngaggtactcggcgttatattatgtgagagtagaggaggggtacttaagttaccgtacccgtcgttcgacgtttcgtacggggacctaccggggacccttacggg

SEQ ID NO: 186508 - DNA, 573 bp, Homo sapiens
  misc_feature: GYAE6OF02HATNM.42.2.A02.1.454.CMB.1.raw
  modified_base (484)..(484): a, c, t, g, unknown or other
  misc_feature (484)..(484): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcaccgtgggtgcgacacggcccctggacaggactcgagtggatagggaaatcgtctccgtagtctacggattaacaaactacgaccacagtaagtttcgagggcaagacgtacaacctacgttacccgacggacacactaccaactaacacacgtactacattagagttagacgtggtcctagacatcgtagaggacgtcggacgttattattntgtgacgagaggaggaggggtacttaagtttaaccgtcccgtacgtcggtaacgttacggttcggggaccctacggggtaccccgtcgg

SEQ ID NO: 186509 - DNA, 695 bp, Homo sapiens
  misc_feature: GYAE6OF02JVT81.42.2.A02.1.454.CMB.1.raw
tcagtgacgtatgtcacgaccggtgctcgatttagactcatctacagggggaagtctctctcagtcaggacacagcttggacatgagggtccctgctcagctcctggactcctgctgctctggctcccagataccagatgtgacatccagatcgacccagtctccttcctcctgtctgcatctgtaggagacagaatcacatcacgttcgaccggcgtagtcgacggtcagttcggtacgttagtttttacgcgttggtaactcgaacgtacctaaaaaccgtgactactacgttactaagtcctacctctacttcctttcctagtccttacttacttcgactacgttcgtacggtcctacgttccgtcgtccttacgacggtccggtacggtcggtcgtacggtagggtactacgttactttaccgtacgttactccaacctacgtcgtaacgtcgaacggtcctacgactaccgtacggtagtaacgtaggttacgtaacggtaacttacttacgtaacgtataaacgttattaacgttacgtttcgttacgtacttaccgttacggttaaccgggttccgggggtaccggggttaatacggggtttaaaggaccggttaacggttaaacccgaaacgggttaacgtacgggttaccggtaccgtaccggtaacgtacccgttagtttcccgg

SEQ ID NO: 186510 - DNA, 708 bp, Homo sapiens
  misc_feature: GYAE6OF02HSB84.42.2.A02.1.454.CMB.1.raw
  modified_base (162)..(162): a, c, t, g, unknown or other
  misc_feature (162)..(162): n is a, c, g, or t
  modified_base (204)..(204): a, c, t, g, unknown or other
  misc_feature (204)..(204): n is a, c, g, or t
  modified_base (230)..(230): a, c, t, g, unknown or other
  misc_feature (230)..(230): n is a, c, g, or t
  modified_base (524)..(524): a, c, t, g, unknown or other
  misc_feature (524)..(524): n is a, c, g, or t
  modified_base (534)..(534): a, c, t, g, unknown or other
  misc_feature (534)..(534): n is a, c, g, or t
tcagtgacgtatgtcacgaccggtgctcgatttagactcatctacaggggaagtctctctcagtcaggacacagcttggacatgaggtcctgctcagctctggactcctgctgctctcggctcccaagataccgagactgtcgacatccagactcgaacccngtcctccttcctcctgtactcgcctatcgtgacggacacganaatccaccatccacgttgggcccggntagttccaagggtcaggtttgcttagttttacgctggtatacacgactaaaacgtcggactacgtacgttaacctacgaccttacctacttacttccgtttacctcgttccttacctttacttcgtacctaacgttccgtaaccgggttaccctatccgtacgtaccttacgacggtcggtcggtcgcgttcctaagggtaccaggttaccttcgtaactttccgacctacgtatccgacgtcctgtacgtcgtaccacggtctagaacgtacgttcggttacgaaccgtttanccggtttaanccgttaaacgttagtttaaccgtaacttttcgggacctttacctacgttacccttaacggggtttccggggaccggggtaaaacccggttggtaggttaaaccgtaacggttaaccgtaaaccggtaggtcggtttacgccgttaaccgggtacctaccgttaggttaacccgg

SEQ ID NO: 186511 - DNA, 880 bp, Homo sapiens
  misc_feature: GYAE6OF02G7MP9.42.2.A02.1.454.CMB.1.raw
  modified_base (244)..(244): a, c, t, g, unknown or other
  misc_feature (244)..(244): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctgaggtgaagaagctgggtcctcggtgaaggtctctgcaggtcttcgnggaggcaccttcaggtagcaagtcgctgtacctacgtggggtcgccggtaacgacgggccccgtagggaaccgtaacgggtaccgtacggacgggttggaagtaggggtaaaacgtacggttaccgttaccccgttaggtccgttaccggtaaatttaaaaccaaaccgttacggacctaaccggtaaacggttaaacggttttaccggaacggggtaccaacggtaaccggtacccgtaaacccgtaaccgtttaaccccggggacccggtaaaccctaacccgtaaccgttaaccccctaaaccgttaaacccgaaaccgtaacgggttaccttaaaccgttaaggtttacgttaacgggtttagtacgggttaccgggttaccttagggtaaccgtaacgttccggtacggtaacggggttaacccgttcccggggtaaccgttttaaactttacggttttaaacgttacgggtttacgaccgggtaagggtacggggtaaacggggttaaccgggggttactttaaacccgggttttaaccccgtaccccggttaacgttaccggttaaccgtttaagggggtttaccccggggaccggggtaaccggggttaaccccggtttaccccgggg

SEQ ID NO: 186512 - DNA, 647 bp, Homo sapiens
  misc_feature: GYAE6OF02HLK9J.42.2.A02.1.454.CMB.1.raw
  modified_base (195)..(195): a, c, t, g, unknown or other
  misc_feature (195)..(195): n is a, c, g, or t
  modified_base (425)..(425): a, c, t, g, unknown or other
  misc_feature (425)..(425): n is a, c, g, or t
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgaccctagtccttccttccctccctgtctgcatctgtagganacagaatcaccatcacttcggccgggcgagttcaggtctagttggtcgtatttttagtcgttgtagtacagaccaaaacgtacggcactacgttacctaacgtcctccttctacttccgtttccttcgtctttcctttactttgactaacgtacgtacggggtccctacgtctccgtctcgacgtcgggcggtgcgtcgtgggactagtacttctactctacaccatacngacacgacctggcacgtccgtaggaacgtagttaggttacggtaacgttaacgtttactcgtaactaagttaactttaacgttaacgtttcgttctaccgttctttaccgtacggtttccgggggtacgggggtaaccgtaaggggtacgggaacggttaactaacggtaaaaccgtaccggttagggtacggtacctacggaaccgtacctagtttcccgg

SEQ ID NO: 186513 - DNA, 736 bp, Homo sapiens
  misc_feature: GYAE6OF02G5R8Y.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctgaggtgaagagcctgggtcctggtgaaggtctccgtgcaggtctcgtggacggtcctaccttcgagtacgacaagtgactcgtcaccgtgggtcgcggtacgacggccccgtaggaacgaacggactcggaggtaggagtagggaaatacgtcctaccgtagtcgtacggtaataactaacgtacgcaacgagtacgttcgaggtacagaccgtacacgtacgtaccgacgtacactacgtaccaactaacgactagtactaactacgtttaggtaacggtttacggtaggttaccggttaccgttacgtaaaccgtacggttaacgtacgggtaacgtaccggttaccgggtaccgtttaaagttacgttttagtcggtacggtacgggtagtaacggggtaacgggttaacgggggttaacgttttaacccggtttaacccggttaaccccgggtttacggttaacccggttaaccggtttacggggttaccgggggtaaccccgggttaacgggggttaacccccgttacccggggg

SEQ ID NO: 186514 - DNA, 671 bp, Homo sapiens
  misc_feature: GYAE6OF02I5LKL.42.2.A02.1.454.CMB.1.raw
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
  modified_base (284)..(284): a, c, t, g, unknown or other
  misc_feature (284)..(284): n is a, c, g, or t
  modified_base (451)..(451): a, c, t, g, unknown or other
  misc_feature (451)..(451): n is a, c, g, or t
tcagtgacgtatgtcacgaccggtgctcgatttagactcatctacaggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggtctggaggtgaagaagcctgggtcctggtgaaggtctcctgcaaggcttcnggacggctaccttnagtagcaatcgctgtcacctggggtncgacacggcccctaggactaacggactcgaggtcggagtagggaacttagtcgttaccctagttccgtacggtaatttaaccgaaacgtaaccgcaacgaaggttaacgttacgagggtacagtaacgtcacctacgttacgacgacacgatacccgaataaccganacgttaccagtaacttgtaacgtttaggacgttcgggcctacgtacgtaacgtccgtaggtacgggtaacgtccgggtaccttaaaggtttacctttaaagttccgggttagtacggaggtaacggtaaagggcgggttaacctttaacgtttaaccgacccccggttgttactacgggttaaacgttcggggtaacccacggggtttaccccgtacggg

SEQ ID NO: 186515 - DNA, 556 bp, Homo sapiens
  misc_feature: GYAE6OF02F4X8R.42.2.A02.1.454.CMB.1.raw
  modified_base (435)..(435): a, c, t, g, unknown or other
  misc_feature (435)..(435): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctccctagtctcggattaacaaactacgcaacagaagtttcaggcagagtcaccattaccgcggaacacatccaactaacacacgtctacattgagttgagtgctagacatcngaggactcggaccgttataatttattcgtagcgagaggtaaggaggggctttaaacgttaaccgtccccgagttacgtacgttaacggttcggggacccgtacggggtaaccccttacggg

SEQ ID NO: 186516 - DNA, 679 bp, Homo sapiens
  misc_feature: GYAE6OF02HI3CI.42.2.A02.1.454.CMB.1.raw
  modified_base (191)..(191): a, c, t, g, unknown or other
  misc_feature (191)..(191): n is a, c, g, or t
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctccctgtctgcatctgtagganacagaatccaccatcacttggccgggcgagtcaggtcagttggcgttatttttagcctggtatcagaccaaaacctggacactacgttcctaacgtctcctctacttcctttcctcgtcctttcttactttgactaacgtcgtacggggtaccctatcctccgtaccttcgacggtccgggcggttcggcgttcgtagggactagtacgtttcaaccgttcctacctaacctacgtaccacgaccctacgtcccgttcggaccgtaccggtcccgtaggtaacgtaacgttgggtttaacggtaaacgtttaactttaaccggttagtaacgttaaagttaatttaacgtttaaccgtttcgttaccgttccttacgttaccgttacgggtttacccgggggtacgggggtaaccgtaggggttacgggaacgtaacgtaaccggtaaacgtacggttaggtcgcgtacggtcctaactcgtttaccg

SEQ ID NO: 186517 - DNA, 653 bp, Homo sapiens
  misc_feature: GYAE6OF02HN50O.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcagggctgaggtgaagagcctgggtcctcggtgaaggtctcctgcaaggcttcgtggacggcaccttcagtagcaatgctgtcaccgtgggtgcgacacggcccctggacgaaggacgtcgagtggacgtagggaaatagtcctccgtagtctacggtaacttaacaactacgacacagtaagtttacgaggcagagtacactacttaccggacgacacactaccactaaccactacgtcctaactattacgtaggttgacgttcggacctaggacctacgttcgtaggtacggtaccgtaccgggtaccgttaattagtttagttaggtttcgacggtacggtaaggtaaggggtaacgggggttacctttaaacggttttaaccccgtccccggttacgttacgtaaccggttacgggtttaccgggggacccggtaaccggggtacccccggtttaaccggg

SEQ ID NO: 186518 - DNA, 738 bp, Homo sapiens
  misc_feature: GYAE6OF02H1DXB.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagcgtggtgcaggtcgaggggtctggaggtggaagaaggccgtgggtccgtcgggtgtaaggtcctccgtggcgaaggtcttcgtggacggctccgttccgaagtagacagtcgctggtccacgttgggtcgacggtacgcccggtccctggaacgtaacggccgtacggacggtaggacgtagggaaactcggttacccgtaccgtaggtccgtaggtaactaaaccgtaaactaccgactacgtaagtaagttaccgacgggactaagtacggtacccaacgtaccgttaccggagaacccacgtaacccgtaccaaaccgtaaacctacgtaacgtaccttaacgtacgttaggtacgttacggtaagtccggtacctaggtaacctagttcgtacgaccgggtacgtcccgtacgtttacttaagtactagggtacgacggtaacggtaaggacgggtaaccggtacgttttaacctacccgggttacccgtacggttacggttaaccggttacgggtttcccggggaaaccggtcccgggttaacccgttccccggg

SEQ ID NO: 186519 - DNA, 603 bp, Homo sapiens
  misc_feature: GYAE6OF02ISXL1.42.2.A02.1.454.CMB.1.raw
  modified_base (304)..(304): a, c, t, g, unknown or other
  misc_feature (304)..(304): n is a, c, g, or t
  modified_base (556)..(556): a, c, t, g, unknown or other
  misc_feature (556)..(556): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcagggctgaggtgaagaagcctgggtcctcggtgaaggtctcctgcaaggcttcgtggaggcaccttcagtagcaatgctgtcactgggtgcgacacggcccctggacgaaggacncggaggtcgagtggaaatagtctcctagtctacggtattaaaccaaaactacgacaacgaagtaacgtttcgaagggcagagtaccaccactaccgacgaccacactaccaactaaccacacgtactaactattaggagttgtaggtggacctggacatctaggaggacgttccggacgttaattagttagtttagtacgacggtaggaaggtaggtaacggggtactttaacggtttaaccttacccggtnttacgtacgttaagttcggggtacccgtacgggaccccgttaccggg

SEQ ID NO: 186520 - DNA, 737 bp, Homo sapiens
  misc_feature: GYAE6OF02JOWED.42.2.A02.1.454.CMB.1.raw
  modified_base (217)..(217): a, c, t, g, unknown or other
  misc_feature (217)..(217): n is a, c, g, or t
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtcctccttcctcctgtctgcatctgtaggagacagaatcaccatcacgttcgccggnagtcgaggtcagttggcgtattttagccttggtatactagaccaaaaactggacactacgttacctaagacctccgtcactcttcctgtcttctacttcgctaacttcgacgggtccatccgtcgtactcgtacgtccgggtcggtacggtctcggtacgacgtacggtatttaccgacttcgtaccaacctacgttaccgacggtacctacggtacccttggaccgaacggtcccgttaagggaaacgttacgttaacgggttacggtaaaaccgtttactttaaccgggttagtaaccggttaaacgtttaacgtttaaaccgttttaaacgttttccggtttaccgttcccgttaaccgttaccggtttaacccgggtttaaccgggggtaccggggggttaaaccggtaaacggggtttaacgggtaacggtaaaccgttaaaccggtaaaaccggttaaaccggttcggtaacgggttccgtaaaccggtaccttaacccggtaacttttcccgg

SEQ ID NO: 186521 - DNA, 762 bp, Homo sapiens
  misc_feature: GYAE6OF02FSNC5.42.2.A02.1.454.CMB.1.raw
tcagtgacgtatgtcacgaccggtgctcgatttagactcatctacagggggagcgttcacataatgaccaccttcctccgtctaaagaacgcccctgggagcacagctcatccaccatggactggacctggaggtttcctctttgtggtgggcagcacgtctacaggtgtccagtcccaggtgcacgctggtgcagtccaggggctgaggtgaagaagccgtgggtcctcgggtgtaacgggtcctccgtagacgtaagggcctttacgtagggaaggcctaacctttcgaaggttagacctaaaagttcggtccttcgggtacctaacccggttcggggttacgtccggtaaccggacgggtccccccgtagggtaaccaaaggggtaccttacgggacggttcgggaaaccgttagggggaaaattccggttaccttacccgtaacggttccgttacggtaactttaaaccgaaaaccggttccgactaaccggaacgttaacggttcgaacggggctaaggacgttacccaaccgttagtacccggacggaccacgaacgtacccacaacactagtacctactagttgagttggacgtcggacctagactagtacgtggacgtacggtccggtaaccgttattacgttagttcgtacgtacgaggtacggaacggtaacgggttacttaacgtttacccgtcccggtacgttaccggttaaccgttacgggttccggggtaccctaacgggtaccccgg

SEQ ID NO: 186522 - DNA, 939 bp, Homo sapiens
  misc_feature: GYAE6OF02FV5J7.42.2.A02.1.454.CMB.1.raw
tcagtgacgtatgtcacgaccggtgctcgatttagactcatctacagggggagcttcacataacgaccaccttcctcctctaaagaagcccctgggagcacagcctcatccaccagtacggtacgtcggaccgtgggtacggtttccttcgtttggtgggtggacgagcagtacctaacgtaggtcgtaccgtaccgtcccgtagggtcgacgacgtcggttgggtcgacgtaggtacgggacggggtcgtagggtagggtaggaaaggaacgtccggttcgggttccgttcgggtaggtaacggttcctccgtgacgtaacggttcttcggtagggacggacctaccgttacgaaggttacggactaagtcgtcgttcgtcctaccggttggggtcgaccgaacgacccggtccccgtaggaacgaacggtaccgtacggaggttacggaaggtaagggtaaagttaccggtacccttaccggttacggttaccgttacggtaaacttaaaaccgtaaaccgtacgtaccaaacgtaaacggtttaacgtttacggacgggtacgaaacggtaccgtacctaaccgtacgttacccggacggtaaccactaacgtaccctaaacgtaaaccaacgtaccgttacctaaacgtacgtttaggttaacggttacggtaacggttcggtacccgtacgtaaacgttacgttacgttaagggtaccggttaacccggtccgggttaaccgttttaagtttaaacgtttttaggtttacgggtacggtaacggtacgggaaacgggtaagggggtaacccgggggttaacttttttaaaaccggtttaccccggttacccggttacggttaacggtttaaccggtttaaccgggggttacccggggaacccgttaacccgggggttaaccgtttaccccgggg

SEQ ID NO: 186523 - DNA, 908 bp, Homo sapiens
  misc_feature: GYAE6OF02FLMGK.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcagggctgaggtgaagagcctgggtcctcggtgaaggtctcctgcaaggcttcgtggacggcaccttcagtagcaatgctgtcaccgtgggtcgcgacgacggccccgtaggaccgaacggacgtcggaggttgggagtagggtaaatacggtaccttacccgtagtccgttaccgggaactttaaaaccgaaaaccgttaccgaccgtaaaccgtaaggtaaacgttttccgaacggggtacgtaacggacggttaccaaacccgtaacggtttacccgggaacccgggaaccaaacccgttaacgttaccccctaaaccgttaaacccgtaaccgaaaccgggtttaaccctaaaccgttaagttttacgggttaacggtttaacgggtaaacgggtttcggggtaccccgttacgggttaaacccgtaacggttttaccgtaacggggtaaccggggttaacccggttacccgggggttaaccgtttaaacggttttaaacggtttttaaccggtttttaccgggtttacgggtacccgggttaagggtaacggggtaaggggttaaccgggggggttaaccttttaaaccgggttttttaaaccccggttaccccgggtaccggttttaacgggttaacccggttttaaccggggtttacccgggggggtaaccccggtttaacccgggggggtaaccccccgttttaaccggggg

SEQ ID NO: 186524 - DNA, 670 bp, Homo sapiens
  misc_feature: GYAE6OF02IS6DE.42.2.A02.1.454.CMB.1.raw
  modified_base (290)..(290): a, c, t, g, unknown or other
  misc_feature (290)..(290): n is a, c, g, or t
  modified_base (498)..(498): a, c, t, g, unknown or other
  misc_feature (498)..(498): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctgaggtgaagaagcctgggtcctcggtgaggtctcctgcaaggcttcgtggaggcctaccttcagtagcaagtgctgtcaccgtgggtcgcgacncggccccgtggaacgaaggctcggagtggagtaggaatgtctccgtagtcgacgtaataaacaactacgacaacgtaagtaacgtttacgaacgggtacaggtacgtaccaccgtaacgttaccggacggaaccaacctactacccaaaccgtaaaccacctaacgttacctaacgtacgtttggaacggtttgacggttggccgtanacgtactcgtagacggtacgtccggtaccgttaagttaagttacgttaggtcgtacggaggtaacggtagggaacggggttactttaaacgtttaacccggtcccggtacgttaacggttaccggtttacgggttccggggtaacccgtaccggggtacccctttaccgggg

SEQ ID NO: 186525 - DNA, 535 bp, Homo sapiens
  misc_feature: GYAE6OF02GZ1S2.42.2.A02.1.454.CMB.1.raw
  modified_base (413)..(413): a, c, t, g, unknown or other
  misc_feature (413)..(413): n is a, c, g, or t
  modified_base (433)..(433): a, c, t, g, unknown or other
  misc_feature (433)..(433): n is a, c, g, or t
  modified_base (436)..(436): a, c, t, g, unknown or other
  misc_feature (436)..(436): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagcctgggtcctcggtgaaggtctcctgcaaggcttcgtggacggcaccttcagtagcaatgctgtcacctgggtgcgacacggcccctggacaaggactcgagtggatgggaaatgtctccctagtctcggattaacaaactacgcacagagtttcagggcagagtcacctattaccgcgacacactccaactaacacagtctaacnttagagttgagtgcctgacntcngagctcggctatattatgtgcgagagaggtcgggacttagtttaaccgtcccgtcttacggtacttaggttacggggtccgtacgggtacccttacggg

SEQ ID NO: 186526 - DNA, 646 bp, Homo sapiens
  misc_feature: GYAE6OF02H7OJP.42.2.A02.1.454.CMB.1.raw
  modified_base (349)..(349): a, c, t, g, unknown or other
  misc_feature (349)..(349): n is a, c, g, or t
  modified_base (568)..(568): a, c, t, g, unknown or other
  misc_feature (568)..(568): n is a, c, g, or t
tcagtgacgtatgtcacgaccggtgctcgatttagactcatctacagggggagcttcacataacgaccaccttcctcctctaaagaagccccctgggagcacagctcatcaccatggactggacctggaggttcctctttgtggtggcagcagctacaggtgtccagtcccaggtgcagcgtggtgcagtcgaggggctggaggtgaaggaagccgtgggtacccgttgggtacgaacgggttctccgtgacgaacggtccttcgtgggaggccgtacctttccgaagttagcaagtgctgtcgtacgtggtcgcgacaccgggcccctaggacgaaggcctcggacgnggtagtagggtaaagtcgtcctaccgtagtcgtacggtaattaaaccaaacgtacgccgaataacgtacgttacgagggacaggtataccgaacctagtaccgacggacacctactaccaacctaacactacgtctacgtattaggtagttacgacggttgccgtacgtactcgtacgtaggacggtacgttccggtacgttaattattagttgttggngagtaggacggtcgggtattaaccgttaccgtcccgagttacgttacgtaggttcgggacgtacggtacccgttacgg

SEQ ID NO: 186527 - DNA, 608 bp, Homo sapiens
  misc_feature: GYAE6OF02FZ0VE.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagcctgggtcctcggtgaaggtctcctgcaaggcttctggaggcaccttcagtagcaatgctgtcaccgtgggtgcgacacggcccctaggacgaaggactcggagtggagtagggaaatgtcctaccgtagtctacggattaaacaaactacgacacagtacgtttacgagggacagacgtcaaccagttaccggcgacacactaccaactaacactacgtactaactattaggtagttgaggtcggactacgtacacgtctaggacggtacgtccgggtaccttaagttatttagttgtcggtacgaggtaggaagggtacggggtacttaacgtttaacccgtcccggtactacgtaccgttaggttacggggtacccgtacgggtacccggttaccggg

SEQ ID NO: 186528 - DNA, 746 bp, Homo sapiens
  misc_feature: GYAE6OF02J01ZM.42.2.A02.1.454.CMB.1.raw
  modified_base (428)..(428): a, c, t, g, unknown or other
  misc_feature (428)..(428): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaacgccgtgggtcctcggtgaaggtctcctgccaaggcttacgtggaggctaccgttcgagtagcaagtgctgtcaccgtgggtcgcgaactacgggcccctaggaaccaaaggccgtgtaggtggaacgtgggtaaaatacggtcctaccccgttagaccttacgggaatttaaaccaaaccgtacggaccaacgtaacggtaaacggtttcgaaccggggnaacggtaacggttaccaaccgtaacgttaccggaccggaacacgtaacgttacccaaaccgttaacactaacgtactacctagtagtaacgttagacgttcgtacctcggaactagtacgtacggtaagtaccgttaccggtaccggttaaatttaacggtttacgttacgggtaagtccgggtaaggtaacgggtaacgggtaacggggttacctttaaaccgggttttacctaaccccggttaggtttaacgttaacccgttacggggtttaccgggggtaaccccgtaacggggttaacccccgtttaaccgggg

SEQ ID NO: 186529 - DNA, 841 bp, Homo sapiens
  misc_feature: GYAE6OF02IMYUR.42.2.A02.1.454.CMB.1.raw
tcagtgacgtatgtcacgaccggtgctcgatttagactcatctacaggggagcttcacataacgaccaccttcctcctctaaagaagcccctgggagcacagctcatcaccatggactggacctggacggttcctctttggtggtggcagcagctacgaggtgtccagtcccaggtgcagctggtgcagtcgagggctaggaggtgaagagccgtgggccctggttgaaggtcctaccgtgaccgaaggtccttcgtgggacggccaccgttcagtacggacaagtgcgttacgtccgacccgttggggttcgaccggtaccgtacgggcccccgttagggaacccgttaaacgggaacccgttccggtaaggttcgggaaacggttacgggggaaaaactacgggtttcctacccccgtttaaggtccgttaccggggtaaacgttttaaaacccgaaaacgtttaaccggacccgtaaacgtacggtaaaacggttttccggaaacgggggccaaggtaaccgttacggtaacccgtaacggttaacccgtaccgggtaaccgtaactaaccgtaacccgtaaaccgtaaaccgtaacctaacgtaaccgttaaccctaacggtttaggttacgtttacggaacggttacgtaccctaacggtactaacgttccgtaacggttaaccgggtaccttaccgggtacccgttaaagtttactttaaagggttctacgggttacggacgtaaggtacgggtaagggtaccgttaacgtttaaccggccgtttacgtacggtacgttacggttacggggtcgtaaccggggtaccgtaccggg

SEQ ID NO: 186530 - DNA, 570 bp, Homo sapiens
  misc_feature: GYAE6OF02IE7EH.42.2.A02.1.454.CMB.1.raw
  modified_base (453)..(453): a, c, t, g, unknown or other
  misc_feature (453)..(453): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttcgtggaggcaccttcagtagcaatgctgtcacctgggtgcgacaggcccctggacaagggactcgagtggagtgggaaatcgtctcctagtctacggtaattaaccaaactacgacacaagtaagtttcgagggtacagagtacaccattaccgacggacaacactaccaactaacacactactactattgtaagttgagttcgctgaacntcgtagacgacgtccggtccgttaatatttattgtgcgagaggacggaggggtacttaacgttaccgtacccgcgttacggacttaggttcggggaccgtacgggacccttaccggg

SEQ ID NO: 186531 - DNA, 691 bp, Homo sapiens
  misc_feature: GYAE6OF02HDW68.42.2.A02.1.454.CMB.1.raw
  modified_base (184)..(184): a, c, t, g, unknown or other
  misc_feature (184)..(184): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtncagtcaggggctgaggtgaagaagcctgggtcctcggtgaaggtctcctgcaaggcttctggaggcaccttcagtagcaatcgctgtcacctgggtcgcgaccagggcccctaggaccaaggacctcggagtggagtagggaatagtcctcctagtctacggacttaacaaactcgacactagaacgtttcagggtcagtactactaccgacgttaccgcgaaccactactaccctaacgtaaaccacgtacgtacctaacgtaattacggtaacgtttaggacggttcggtaccgtacggaactacgttaccgtacggtaacgggtaccgttaccgggtacccgttaagtttaacggtttacgtttagggtacggtacgggtaacggtaggtaacggggtaacggggttacctttaaacggtttaaccccgtacccggttacgttaccggttacggttaacgggttaccgggggacccggttaaccggggtacccgttacccgggg

SEQ ID NO: 186532 - DNA, 569 bp, Homo sapiens
  misc_feature: GYAE6OF02IYPTQ.42.2.A02.1.454.CMB.1.raw
  modified_base (276)..(276): a, c, t, g, unknown or other
  misc_feature (276)..(276): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggagttcctcttgtggtgcagcagcttacaggtgtccagtcccaggtgcagctggtgcagtcagggctgaggtgaagagcctgggtcctggtgaaggtctcctgcaaggcttcgtggacgcaccttcagttagcaatgctgtcacctgggngcgacacggcccctggaccaaggcctcgagttggatgggaaatgtctcccgtagtctggacttaacaaactacgcaacgagtaacgtttcgaagggcagacgtcacctaattaccgcggaccacgaactccacaaccacacgtctacattggagttggatggcctgcctatcctgacgtacgtcgggtacgtattacgttagttcgtagtcgtagagtaggaaggggtcttaacggttaaccgtcccgtagtcgtaccgttagttacggggcctaacgggacccgttaccggg

SEQ ID NO: 186533 - DNA, 583 bp, Homo sapiens
  misc_feature: GYAE6OF02JV91N.42.2.A02.1.454.CMB.1.raw
  modified_base (471)..(471): a, c, t, g, unknown or other
  misc_feature (471)..(471): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctggaggtgaagaagccgtgggtcctcggtgaaggtctcctgcaaggcttcgtggacgcaccttcagtagcaatgactgtcacctgggtgcgactacggccccgtggaccgaaggaccgtacggaggtcggatagggaaatacgtctacccgtagtctacggaattaaacgaaactacgaccaacaagtaagttcgaggacagacgtacacctaagttaccggacgacacgactaccaacaacactagtacaactatagagttgagtgcctgacatnagacgacgtcggtaccgtatagttatggagtacgagagaggtacgggtacttacgtttaaccgcccgtagtacgtaacgtacggttggggaccctacgggtacccttacggg

SEQ ID NO: 186534 - DNA, 536 bp, Homo sapiens
  misc_feature: GYAE6OF02III0F.42.2.A02.1.454.CMB.1.raw
  modified_base (288)..(288): a, c, t, g, unknown or other
  misc_feature (288)..(288): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcgggtgaaggtcctcctgcaaggcttcgtggaggcaccttcagtagcaatgctgtcacctgggtgcgacncggcccctggacaaggctcgagtggagtagggaaatgtctacctagtctacggattaacaaactacgacactaagaagtttcgagggcgagagtaccaaccagttaccgacggacacactccactaaacacagtactacattagagttgagtcgctgacatctagacgactcggcttatattattgtgcgagagagagggtctatttaaccgtccgctacgacttagtcgggacacgggtaccctcgg

SEQ ID NO: 186535 - DNA, 653 bp, Homo sapiens
  misc_feature: GYAE6OF02HZ08X.42.2.A02.1.454.CMB.1.raw
  modified_base (509)..(509): a, c, t, g, unknown or other
  misc_feature (509)..(509): n is a, c, g, or t
  modified_base (551)..(551): a, c, t, g, unknown or other
  misc_feature (551)..(551): n is a, c, g, or t
tcagtgacgtatgtcacgaccggtgctcgatttagactcatctacagggggagcttcacataacgaccaccttcctcctctaaagaagccccctgggagcacagctcatcaccatggactggacctggaggttctctttgtggtggcagcagctacaggtgtccagtcccaggtgcagctggtgcagtcgagggctgaggtagaagaagccgtcgggtcgtcggtgaaggtctccgtagcgaaggcttcgtgggaggctaccttcgagtagacaagttgcttgtaccgaccgttgggtcgacgacgacggccccgtaggacgaaggtcgtcgagtggagtagggaaactgtcctacctagtcgtacgtaacttaaaccaaactacgactaacgaagtaagttacgaggcaaggtactacgacctacgttaccggaccggactaaccacgtaacccaacctaaacacgtaacgtcctaactagttggtacgtagacggttgacgtatacntcgtaggacggtaccgtcggacgttatttagttattggacgnggaggtagggagggtaacggttaccttaacgtttacccgacccgtagttaggtaaccgttcggggttaacgggaccccggtaccggggtaaccttacccggg

SEQ ID NO: 186536 - DNA, 830 bp, Homo sapiens
  misc_feature: GYAE6OF02HLFW1.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctggaggtgaagaagccgtgggtcctcggtgaaggtctccgtgcgaaggcttcgtggaggctaccttcagtacgcaatgctgtcaccgtgggtcgcgacgacgggcccctagggaccgaacgggtaccgtaccgggagggttgggaagtaggggaaaaacgttacggtaccgttacccccggttaaggttaccggttaaccgggtaactttaaaacccgtaaaaccttacgggacctaaccgtaaaggtaaacggttttacgaacgggggtacctaaagggtaacggttacccgaaacccgtaaccggtttaaccgggacccgggtaaacctaacccgtaacgttaccccaaacctaaaccgaaaccgtacgttaaccttaacctaaacgtttacggtaagttttacggaggtttaccgggacccttaggaaaccttaggttaccgttaggtaacggggtaaccttacccggggtaacccgttttaagttacgttttacggttgttacggtacggtaggtaaggtacgggtaagggggttaccctttaaagtttttaacccgacccgggttacttaacggggttactttacggtttacggggggacccgttaacgggggttaaccccttaccgggg

SEQ ID NO: 186537 - DNA, 583 bp, Homo sapiens
  misc_feature: GYAE6OF02FLJ3X.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttcgtggaggcaccttcagtagcaagtgctgtcaccgtgggtcgcgacgaggcccctggacaaggactcgaggtggacgtagggaaagtgtctacccgtagtctcggattaacaaactacgacacagtaacgtttcagggtcagagtcaccataccgcgacacactccaactaacacacgtactacattagtagttagtagtggctcgactactcgtagaggactcgggtaccgttaagttacgtttattgtgtcgtaggaggtacggaggggtacttaacgtttaaccgtccggtcgtacggaccgttaggtaccggggaccgtacgggtaacccgtccggg

SEQ ID NO: 186538 - DNA, 741 bp, Homo sapiens
  misc_feature: GYAE6OF02FX79G.42.2.A02.1.454.CMB.1.raw
  modified_base (188)..(188): a, c, t, g, unknown or other
  misc_feature (188)..(188): n is a, c, g, or t
tcagtgacgtatgtcacgaccggtgctcgatttagactcatctacagggggagctttcgacataacgtaccaccttcctcctctaaagaagcccctgggagcacagactcatcaccatggacgttggtaccctggaggtttcctctttggtcgggtgccagcaggctacaggtgtccagtcccaggtncgagcgtgggtcggaccaggtcgagggggctggacggtgaagaacgtccgtcgggtcctcggtgaacggttctccgtgcgaaggtcttcgtggacgcaccttcaggtacgtctaaatcgcttgtacaccgtgggtcgccggaacgacgggccccgtaggacgaacgggtactcggaggttacggagtaacgggtaaatacgtactaccggtagtcgtacggtaacttaaacgaaccgtacgtacaacgacggtaacgtttacgaacgggtaccaaggtactacgaacctaagttaccgaccggaactaccgaactaccctaacctaaccgaactaacgtacctaactacgtttaggaacgtttacggacgttacgggtcccttagaccttaagttcgtcggaaggtaccgtccgggtaccgttaaagttaccgtttaagttcggggtatacccgggtagtacggtagggtcgggtaacctttaacgttaacccggtcccgtacggttacggtaaccgttacggttcgggaccctacggggtaaccccttcggg

SEQ ID NO: 186539 - DNA, 584 bp, Homo sapiens
  misc_feature: GYAE6OF02G7BCR.42.2.A02.1.454.CMB.1.raw
  modified_base (245)..(245): a, c, t, g, unknown or other
  misc_feature (245)..(245): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctgaggtgaagaagcctgggtcctcggtgaaggtctcctgcaaggcttcnggagcaccttcagtagcaatgctgtcacgtgggtgcgtacgacggcccctggacaacggacgtccgagtggatagggaatagtctcctagtctcggaattaacaaactcgacacagtaacgtttcgaggcagagtcacctagtaccgcggacacactaccaactaacacacgtactactagttgtagtttgagtcggtccgtgactatcgtggacgtacgtcggtacgttattatttagttcgtgtaccgagaggagggtacggggtacttaacgttaacccgtccgtacgtacggtacgttaggttaccgggggccgttaacgggtacccgttccggg

SEQ ID NO: 186540 - DNA, 568 bp, Homo sapiens
  misc_feature: GYAE6OF02JVX1Y.42.2.A02.1.454.CMB.1.raw
  modified_base (319)..(319): a, c, t, g, unknown or other
  misc_feature (319)..(319): n is a, c, g, or t
  modified_base (371)..(371): a, c, t, g, unknown or other
  misc_feature (371)..(371): n is a, c, g, or t
  modified_base (438)..(438): a, c, t, g, unknown or other
  misc_feature (438)..(438): n is a, c, g, or t
  modified_base (456)..(456): a, c, t, g, unknown or other
  misc_feature (456)..(456): n is a, c, g, or t
  modified_base (462)..(462): a, c, t, g, unknown or other
  misc_feature (462)..(462): n is a, c, g, or t
  modified_base (484)..(484): a, c, t, g, unknown or other
  misc_feature (484)..(484): n is a, c, g, or t
  modified_base (490)..(490): a, c, t, g, unknown or other
  misc_feature (490)..(490): n is a, c, g, or t
  modified_base (512)..(512): a, c, t, g, unknown or other
  misc_feature (512)..(512): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctggaggtgaagagtccgtgggtcctggtgaaggtctccgtgcgaacggcttcgtggaggcctaccttcgagtacgcaatgactgtcaccgtgggtgcgacacggcccctggacaaggactcggngtggagtagggaatgtctccgtagtcgcggtaataaccaaactacgcgtaanacgtaagtttacgaggcagacgtacactacgttccgacgacacactaccactaacacagttcaactnttagagttgaagtcgctnactagntagtacgcgttacgccgttatntttagngtgcgagaggaggtaacgggtnttaactttaccgccgacgttagtacttacggtcgggaccgtacgggacccgttcgg

SEQ ID NO: 186541 - DNA, 564 bp, Homo sapiens
  misc_feature: GYAE6OF02IP2H1.42.2.A02.1.454.CMB.1.raw
  modified_base (244)..(244): a, c, t, g, unknown or other
  misc_feature (244)..(244): n is a, c, g, or t
  modified_base (261)..(261): a, c, t, g, unknown or other
  misc_feature (261)..(261): n is a, c, g, or t
  modified_base (285)..(285): a, c, t, g, unknown or other
  misc_feature (285)..(285): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctggaggtgaagaagcctgggtcctcggtgaaggtctcctgcaaggcttnggagcaccttcagtagnaatgctgtcaccgtgggtgcgacncggcccctggacaaggactcgagtggagtagggaatagtcctcctagtctggacttaacaaactacgacacagtaacgtttcagggacagacgtcaccattacccgacggacacactaccaactaacacagtctaacattgagttgagtcggctgactatcgtagacgctcggaccttatactttattcgtgacggtagaggaggtagggtaccttaagtttaaccgtacccgtcgtacgtacgttacgttggggacccgtaccggggaccttaccggg

SEQ ID NO: 186542 - DNA, 569 bp, Homo sapiens
  misc_feature: GYAE6OF02G0HQ6.42.2.A02.1.454.CMB.1.raw
  modified_base (419)..(419): a, c, t, g, unknown or other
  misc_feature (419)..(419): n is a, c, g, or t
  modified_base (428)..(428): a, c, t, g, unknown or other
  misc_feature (428)..(428): n is a, c, g, or t
  modified_base (529)..(529): a, c, t, g, unknown or other
  misc_feature (529)..(529): n is a, c, g, or t
tcagtgacgtatgtcacgaccggtgctcgatttagactcatctacagggggaggcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagcctgggtcctcggtgaaggtctccgtgccaaggcttcgtggaggcaccttcagtagcaatcgctgtcaccgtgggtcgcgacacggcccctggaccaaggacctcggagtggataggggaatagtcctccgtagtcgtacggattaacaaacgtacgcacagaagtttcgagggcagagtcaccataccgcggacacactccactaaccanacgtctacnttagagttgaagttcgcctgactatcgtaggaacggtcgtcggtaccgtattacgtttatgtgcgaggagagggtagggtcttaagttaaccgtccccgtntacggtacttacggttcggggacctacgggacccttcggg

SEQ ID NO: 186543 - DNA, 603 bp, Homo sapiens
  misc_feature: GYAE6OF02HMJR6.42.2.A02.1.454.CMB.1.raw
  modified_base (194)..(194): a, c, t, g, unknown or other
  misc_feature (194)..(194): n is a, c, g, or t
tcagtgacgtatgtcacgaccggtgctcgatttagactcatctacagggggaagtctctctcagtcaggacacagcttggacatgagggtccctgctcagctcctgggactcctgctgctctggctcccagataccagatcgtgacatccagatcgacccagtctccttcctccctgtctgcattctgtagganacagaatcaccatcacttggccggcagtcaggtcagttggctatttttagcctggtattcagacaaaactggacacagttacctaagtcctcctctacttctttcctgtccttcttactttcgctaacgtcgacgggtccctagtctccgtcttcgacgtcgggtcggtacgcgtcgtgggtactaggttactttcacgttcctacacctattccacgtactacgccgtgccacgtcctagtaagtacttaggttacgtaaacgtttataaccgttgtaactaagttattaattacgtttcgtacgtcctctaccttacgggttacgggaccgggggtaacgtaacggtcgggaagtactaacgaaacggtaacgttggtacggtacgtacgacctaccgtattaccgg

SEQ ID NO: 186544 - DNA, 634 bp, Homo sapiens
  misc_feature: GYAE6OF02JYLVO.42.2.A02.1.454.CMB.1.raw
  modified_base (203)..(203): a, c, t, g, unknown or other
  misc_feature (203)..(203): n is a, c, g, or t
  modified_base (316)..(316): a, c, t, g, unknown or other
  misc_feature (316)..(316): n is a, c, g, or t
  modified_base (456)..(456): a, c, t, g, unknown or other
  misc_feature (456)..(456): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggaggngaagagcctgggtcctcggtgaacggttctcctggacaacgggtcttacgtggaacggcctacccttgagtagcaagtgctcggtcaccgtgggtcggcgaccgacggccccnggaacgacggtactacggaggtaggagtacgggaataccgtctaccgtgtctacggataacgaactacgacacagtagttccgaggtacagtacgcaacctacgttaccgacgacgacactcaactacgacagtactaanattacgtagttagtacgtcgtacgtactacgattacgagtaggaacgttccggtaccgttaattaccgtttaaatggttacgagtacgtagtaagggtgggtaacttacgtttaacccgttacgtacccgtacggtaacttacgggttacgggaccggtaccggtaccgttacccggg

SEQ ID NO: 186545 - DNA, 569 bp, Homo sapiens
  misc_feature: GYAE6OF02FPACV.42.2.A02.1.454.CMB.1.raw
  modified_base (355)..(355): a, c, t, g, unknown or other
  misc_feature (355)..(355): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcggagtggatgggaaatagtctccctagtctcggattaacaaactacgcaanacgaagtttcgaggtcaagagtcaccattaccgcggacacactccactaacacagtctaacattagagttgagtggacctgaacagtctaggagaccgtcggccgtattattaatttgtgtcggtagaggaagggtaggggtacttaacgttttaacgtccccgtgttacggtaccgttaagttcgggggaccctaggggtaaccccgttcggg

SEQ ID NO: 186546 - DNA, 563 bp, Homo sapiens
  misc_feature: GYAE6OF02FK040.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagcctgggtcctcggtgaaggtctcctgcaaggcttctggaggcaccttcagtagcaatgctgtcacctgggtgcgacgacggcccctggacaaggactcggagtggatagggaaatagtctcccgtagtcgtacggattaaacgaaactacgacaacgagaaagtttcagggcagacgtcaccataccgcgacacatccaacaacacagtactacattgagttgagtcggctgacatcgtagaggacgtcggtaccttatacttattgtgcgagagaggaggggtacttaacgtttaaccgtcccgtacgttcggtaacgttaggttacggggacccgtacggggtacccttacggg

SEQ ID NO: 186547 - DNA, 630 bp, Homo sapiens
  misc_feature: GYAE6OF02JCR8C.42.2.A02.1.454.CMB.1.raw
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctccctgtctgcatctgtagagacagaatcncatcacttgccggnagtcaggtcagttggcgtatttttagcctggtatctagacaaaactgcacagtcctaagctctcatcttcctgtcttcttactttgactaagttcgacggggttccctaatccgtcgtactttcgacggtccggtcggtcggtcgtacgtaggggtacaagtatttccgaacttctactaccgattcgaagactacgtccgtgtaccacgtcctaggaaactagttaggttacgtaaacgttactttaaaccgttgtaacctaaagttattaaacgttaacgttttgtaccgtacttaccgttaccgttaaccggtttacggggaccgggggtaacaaacggggttcggaaacgttaacgtaccgtaaaacggtaccgttaggttacggaccttacggtaccctaccgtattaccgg

SEQ ID NO: 186548 - DNA, 623 bp, Homo sapiens
  misc_feature: GYAE6OF02HL10A.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcagggctggaggtgaagaagcctgggtcctcggtgaaggtctcctgcaaggcttctggaggctaccttcagtagcaatgctgtcaccgtgggtcgcgacgacggcccccgtggaacgaacggacgtcgaggtcggagtagggaaatagtaccgtcctaaggtcgtacggtaacttaacaaacgtacgactaacacgtaaacgtttacgagggtcgtaagacgtcaacctacgtttaaccgcgtaaaccgactaactacccaactaaacactaacgtactaactattagacgtttgaagtcgcctgactatcgtaggacggtacgtaccggtcgttaagttacttagttcgtaggtcgagacggtaggacgggtacttaagttaaccgtacccgtcttacgtacgttacgttcgggacgtaccgggtaccgtacgg

SEQ ID NO: 186549 - DNA, 553 bp, Homo sapiens
  misc_feature: GYAE6OF02GWGG4.42.2.A02.1.454.CMB.1.raw
  modified_base (439)..(439): a, c, t, g, unknown or other
  misc_feature (439)..(439): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggtcttcgtggacggcaccttcagtagcaatgctgtcacgtggtcgcgacacggccctggacaaggactcgagtggagtgggaaatgtctccctagtcgtcggtattaaacaaactacgacacgagtaacgtttcgagggcagagtcaccactacgcggacacatccactaacactagtactacattgagttgagtcgcctnacatgagtagaccgtcggacgtattattattgtgaggagaggaggaggggtcttacttaaccgtcccgtcgtagtacttacggttacggggtacccgtacgggtacccgtcggg

SEQ ID NO: 186550 - DNA, 570 bp, Homo sapiens
  misc_feature: GYAE6OF02F1KIF.42.2.A02.1.454.CMB.1.raw
  modified_base (339)..(339): a, c, t, g, unknown or other
  misc_feature (339)..(339): n is a, c, g, or t
  modified_base (381)..(381): a, c, t, g, unknown or other
  misc_feature (381)..(381): n is a, c, g, or t
  modified_base (445)..(445): a, c, t, g, unknown or other
  misc_feature (445)..(445): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagagcctgggtcctggtgaaggtctcctgcaaggcttcgtggacggcaccttcagtagcaagtgtctgtcacctgggtgcggtacacggccctaggacaaggctcggagtggagtagggaataggtctcctagtcncggtattaacaactacgacaacagtaacgttcgaggacaganctaccagttaccgacggacacactacactacacagtctacagtagtgttagagttcggctcganacgtctagaggtccgtcgtacgttatattagttagtgtcgagacggaggtaggggtataacggtttaacctcccgtagtacggtacgttacgttaccggggaccgtaccgggtacccgttaccgg

SEQ ID NO: 186551 - DNA, 522 bp, Homo sapiens
  misc_feature: GYAE6OF02HDFGX.42.2.A02.1.454.CMB.1.raw
  modified_base (397)..(397): a, c, t, g, unknown or other
  misc_feature (397)..(397): n is a, c, g, or t
  modified_base (424)..(424): a, c, t, g, unknown or other
  misc_feature (424)..(424): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcagggctgaggtgaagagctgggtcctcggtgaaggtctcctgcaaggcttctggaggcaccttcagtagcaatgctgtcacctgggtgcgacaggcccctggacaaggactcgagtcggatgggaaatagtctccctagtctcggattacaaactacgcacagaagtttcagggcagagtcacattaccgcggacacatccactaacncagtctacattgagttgagtgctgacntctgagactcggaccgtattacgtattgtgcgtagagaggagggtctagtttaactcccgtatcgacgttagttcggggacctagggtaccctacggg

SEQ ID NO: 186552 - DNA, 554 bp, Homo sapiens
  misc_feature: GYAE6OF02HMNBV.42.2.A02.1.454.CMB.1.raw
  modified_base (456)..(456): a, c, t, g, unknown or other
  misc_feature (456)..(456): n is a, c, g, or t
tcagtgacgtatgtcacgaccggtgctcgatttagactcatctacaggggggagcttcacataacgaccaccttcctcctactaaagaagcccctgggagcacagctcatcaccatggactggacctggaggttcctctttgtggtggcagcagctacaggtgtccagtcccaggtgcagctggtgacagtcaggggctggaggtgaagagcctgggtcctcggtgaaggtctcctgcaaggcttcgtgggaggccaccttcagtagcaatgctgtcaccgtgggtgcgacacggccccgtggaacaagggactcggaggtggatagggaaatgtactcctagtctacggataaacaactacgacacagtaacgttcgaggcagagtaccacgtataccgcggacacactaccaactacaacactactactattacgagtttcgagtcgactgacntcgtagagacgtcggactattattatgtgcgtagaggtaggagggtcttagttacgtcccgtatcgacgttaggttcggggactacgggaccctacgg

SEQ ID NO: 186553 - DNA, 769 bp, Homo sapiens
  misc_feature: GYAE6OF02F78G6.42.2.A02.1.454.CMB.1.raw
tcagtgacgtatgtcacgaccggtgctcgatttagactcatctacaggggaggcttcacataacgaccaccttcctcctctaaagaagaccctcgggagcacagctcatcaccatggactggacctggagttctcttgtggtgcgagcagctacaggtgtccagtcccaggtgcagctggtgcgagtcgaggggctggaggtgaagaacggcctgggtcctcgggtgaaggtcgtccgtgcaagggcttcgtggacggctaccttcgaagtagacaagtgcgtacgtcgtaccgtgggttcgacggacgtaccggtaccccggttcgggaaaccgtaaagggcccgtttaaccgggagtacgggtaacgttaacggggaaagtttaacgtcccgttaccccgtaaggttccgtaacggggtaacttaaaacgtaaaccgtcgaacgtaacacggttaacgtttaggacgggtactaacgtaggtaacctaccgtaacgtttaacccgggcggtaaccaacgtaacacccgttaacaaacgtacgaccgtttactaccaaagtttcgaaaccggtttgaaacggttccggccttaacgacttacgttacgtagggtaccgaaccgttcggttaccgtaaagtttcttaaacggtttgacggtcggtagaacgggtaggtaccgggtaacgtttaccctttaacggcccgtacggttacggacgtttaaacgggttccggggcccgttaaacggggaccctttaccggggg

SEQ ID NO: 186554 - DNA, 790 bp, Homo sapiens
  misc_feature: GYAE6OF02HW80W.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggaggtagaagagcgtggtcctggtagaagtctccgtgacaacggtcttcgagggacggcaccgtttacgaggtacgctaaagttgcttcgtacaccggttgggagacgaacgccggccccgaggaacgaacggtacgtacggaggtagggaacgtagggtaaaactcggttacctaccgttagcgttaacggtaaacttaaaccgaaaacgtccgacaacgtaaaggttaacgtttacggaacgggtacgaaacggtacggttacccaacccgtaacgtttaacccggaacggaacctaactaacccgttaaccaaaccgttaaaccaacggtaacgtaaccgttaacctagtttaacggaacgtttaggaacgtttcggaccgtagtaacgacgttcgttaggaccggtaccgtaccggtaccgtttaattaacgtttacgttagtacgggacgtaagggtaagggtacgggtaacggggtttaccgttaaacgtttaaaccccgttaccccgggacgtttacgggtaaccgtttaaacgggtttcccggggggaacccgttaaccggggtaaccccggtttaaccccggg

SEQ ID NO: 186555 - DNA, 800 bp, Homo sapiens
  misc_feature: GYAE6OF02GSCBV.42.2.A02.1.454.CMB.1.raw
  modified_base (152)..(152): a, c, t, g, unknown or other
  misc_feature (152)..(152): n is a, c, g, or t
tcagtgacgtatgtcacgaccggtgctcgatttagactcatctacaggggagcttcacataacgaccaccttcctcctctaaagaagccctgggagcacagctcatcactagtgacgtcgaccgtggtacgttccttctttggtgggtgacngacgtagactaacggtggtcgtaccgtacgtacccgtaggtcgacgagtcggttggtcgacgtagtacgggacgggtctagggtaggtaacggaaagtaccggtccggttccggggttaccgtcgggtaaggtacggtccttaccggtagacggtaacggttcctttacggaggggacgtaccttaccgttacgtaggtacgacgtaagttcgtcgtcgtacctacgggttggcggaccgaccgtaccggtccccggtaaggaacgaacggttccgaggtaaggtaggacgtaagggtaaattcgtaccgtacccgttagtacgtaacggttaaactaaaccgaaccgtacacgtaaacgaaggtttaacgtaccgggaggtaaccgtaaggttacgaacccgttaacgtaacccgttaaccgggaccgaaacctacgaacctaacccgtaaacgtaaactacgtaacgttaccaacgttattacggtagtaacgtcggtaccgtcgtacgaactacgttgagtacggtaccgtaccggtacttagttaatttgttcggacgtacggtagaggaacgggtaggttaaccttaacgtttcccgaccgtgtacgttacggttagccgggaccgttaccggtaacgttccg

SEQ ID NO: 186556 - DNA, 746 bp, Homo sapiens
  misc_feature: GYAE6OF02JN45I.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctgaggtgaagagcctgggtcctcgggtagaaggtctccgtgacgaaggtcttcgtgggaggtcctacctttcgaagtacgacgaattcgcgttcgtccaaccggttggggtcgtccgaaccgacgggtacccccgtaggaaccgaaacggaccgtacgggtaagtcgggtaagttaggggaaacgttccgtaccttaccgtaggtccgttacggtaacttaaaccgaaaccgttacggacctaacgtaaggtaaacggttttacggacgggacgtaaggtacgtacccgtaaccgtaacgtttaacccgggacggtaacctaaccgtacgttaaccccaaacggtaaaccaacgtaggttaccctaacttacggtttacggtacggttacggtaggtccggtaccgtacgactacgttacggtagaccgggtacgtcggtaccgttaattacgtttagtgtacgtacgaggtaggacgggtagggtcttaaacgttaccgtccgtgtacggttacgttacgggtacgggacgtaccgggttacgtaccggg

SEQ ID NO: 186557 - DNA, 675 bp, Homo sapiens
  misc_feature: GYAE6OF02JAR7Q.42.2.A02.1.454.CMB.1.raw
tcagtgacgtatgtcacgaccggtgctcgatttagactcatctacagggggagcttcacataacgaccaccttacctcctctaaagaagcccctgggagcacagctcatcaccatggactggacctggaggtcctcttgtggtggcagcagctacaggtgtccagtcccaggtgcagctggtgcagtcaggggctgaggtgaagaagcctgggtcctggtgaaggtctccgtgcaaggcgttcgtggtaggtcaccgttcgaagtagcgaatggccttcgtcctaccgttggggtcgtcgaccgacgggtcccccgtagggaaccgaacgggacctcggtacggttcgggacgttaggggaaaacttcggtccgttccccgtacgtacgtaccggaatttaaacccaaacgttaccgcaacgtaaggtaacggttttaccgaacggggtcaagtacggtacctaacccgaagtttacccggaccggacctaacctactacccgtaactaacgacgtacgttacctacgtattaggagttacgagtcgggcctggaccattcgtagaggaccgttcggaccgttattagttacttgtagtcgagaggaggtaggggtacttacgtttaacctcccgtactgtacgttggttggggtacccgacgggtaccctcggg

SEQ ID NO: 186558 - DNA, 539 bp, Homo sapiens
  misc_feature: GYAE6OF02GVDDQ.42.2.A02.1.454.CMB.1.raw
  modified_base (430)..(430): a, c, t, g, unknown or other
  misc_feature (430)..(430): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcagggctgaggtgaagagcctgggtcctcggtgaggtctcctgcaggctctggagcaccttcagtagcaatgctgtcacctgggtgcgacacggcccctggacaaggactcggagtggatagggaaatgtctcctagtctcggattaacaactacgcacagtaagttcaggcagagtcacagttacgcggacacactaccactaacacacgtactacatgagttgagtcggcctgacatcgngacggtctcgacgtattattattgtgcgagaggaggacggggtacttaacgtttaacctcccggtattacggacttaggttggggacccgtagggtaccccttaccggg

SEQ ID NO: 186559 - DNA, 830 bp, Homo sapiens
  misc_feature: GYAE6OF02JL3G2.42.2.A02.1.454.CMB.1.raw
  modified_base (282)..(282): a, c, t, g, unknown or other
  misc_feature (282)..(282): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtcgtccagtcccgaggtgcaggcgtggtcgcaggtcgaggggctggaggtgaagaagtccgtgggtcctcgggtaggaacggttctccgtagcgtaaggtcttcgtggacggtcctaccgttnaggtacgactagtcggtcttacgtacgaccggttggggtcgaccggaaccgcgggtaccccgttagggaaccgtaacgggtaccgttcgggaagggttacgggtaaacgttaagggggtaaaacttcggttacccgttccccgttaaggtaccggttaacgggtaaacttaaaccgtaaaccgtaccggacttaaacggtaggttaacggtttacggaacggggtactaaacggtacggtaccaaccgttaacggttacccggacggaaacctaactaccgttaacccgaaccttaacaacgtacgtaacttacgtaacgtttaggttaacggttaggtacgttaccggtcgtaacggtaaccgttacgttaccggttacggacgggttaccgttaccggtacgttaactttacgtttacggttagtaccgtaagggtacggtaaggtaccgggtaacgggttaacttaaccgtttaccggtaccgtacggttacgttaacggttaccggttaccggggtaacccgttaccgggtacccggttaccgg

SEQ ID NO: 186560 - DNA, 698 bp, Homo sapiens
  misc_feature: GYAE6OF02I84OH.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtcggtggcaggcagctacaggtgtccagtcccaggtgcagcgtggtgcagtcagggctggaggtgaagaagccgtgggtccctcggtgaaggtcctccgtagccgaaggtccttcgtgggacgcctaccttcaagtacgctaatcgaccttgtccaccggttgggcgcgacgaccggtccccgtaggaacgaacggtaccgtacgacggtaggagtagggaaacgttcgtccttacccgtaggtcgtaacggtaacttaaaccgaaactaccgacaacgtaaaggtaacgtttccgaacgggcgaacgtacgtaccgactaacgtacccggacgaacaccgtaactacccaaactaactacgacttcaagtatacggtcgttagacggtcgacgtgaactgtcgttaacgggacgtacgtccggtaccgttaattacgtttataggtacggtaaccgagtacgggagggtaacgggtacgttttaaaccgtccgtacccggtacgttacggttaccgtacggttccggggacccggtaacggttaccccggttacggg

SEQ ID NO: 186561 - DNA, 790 bp, Homo sapiens
  misc_feature: GYAE6OF02JUBKK.42.2.A02.1.454.CMB.1.raw
  modified_base (311)..(311): a, c, t, g, unknown or other
  misc_feature (311)..(311): n is a, c, g, or t
tcagtgacgtatgtcacgaccggtgctcgatttagactcatctacaggggagcttcacataacgaccaccttcctcctctaaagaagcccctgggagcacagctcatcaccactgactggacctggaggttcctctttgtggtggcagcagctacaggtgtccagtcccaggtgcagctggtgcagtcagggctgacggtgagaagcctgggtcctcggtgtaagtcctccgtgcaaaggtccttgtcgaggccaccgttacacgtagtcgaattgcgtgtctaccgtggtcggtcgacgacggtccccgngtacgaacggtacctacggacgtcgggtacgtagggtaaactacggtctacgtacgtcgtacgtacgtaaacctaaaccgtacgacgtaacgtacgtaaacggttttacgaacgggtccgaagggtaacgttacccgaacctaacgttaacccgtacgggaaaaccctacgtaaaccgttacccgaaccgttaaaccaaccggttacgttaaacctacggtacttaacggtaacttaggtacgttacgggtaccctaggtaccttacggtacgtaccggtaaacggtccggttaaccggtcccgtttaaaggtaaccctttaaaggtttcgttaggtaacccgggtaggtacggaacggggttacgggtttaaccgtaaccggttttaaacggttcccctaagggtttacccgtaacgggttaccggtttaaccgggggtaccccgtttaaaccgggggtaccccgtttaaacccgggg

SEQ ID NO: 186562 - DNA, 781 bp, Homo sapiens
  misc_feature: GYAE6OF02JR7RN.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagacgcgtgggtcctcggtgaaggtctcctaggcaagggtcttcgtggaggctaccttcagtagcaagtgctcggcaccgtgggtgcgtacgacggcccctaggacaacggtcctacggagtgggaacgtagggaaacttacggtcctaccccgtaggtacgtaaccggtacgttaaacaaaccgttaacggactaacgtacggtaacggttttacggacgggtaacgtagggtacgttacccgaaccgtaccgttaaccgggccgggtaaaccctacgttaaccgttaacccccgtaacgttaaaacccaaccgttaacggttccccttaaacgttaacgttacggtaacggtttcgttaaacggtccgggtaaccccgttagtaaacccgttatacgggttacgggtaaaccggtaccggttaccgggttacccgttaaattacgtttaacggttcgtacggggtaccacgggtaagggtaacggggttaacggggtacttttaaaccggtttaaccgccgttacggtacgtaacgttaggggtaccgggtaaccccgtagggtaaccccgtacgg

SEQ ID NO: 186563 - DNA, 717 bp, Homo sapiens
  misc_feature: GYAE6OF02G4FBA.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcagggctggaggtgaagaagccgtgggtcctcggtgaacggtctccgtgcaaggcttcgtggaggcaccttcagtagcaatgcgtgtacaccgttgggtcgacgacgacggccccgtaggaaccaacggtaccgtcggaaggtgggagtaaggggtaaacttacggtccgttacccgttacgttaccgtacgggtaaactttaaaccgaaaaccgttacgacgaacgtaacggtaaacggttttacgaacggggtactaaggacgtaccgaaccgtaacgttacccggaccggaacaaccgtaactacccaaacgttaaaccaacgtacgtacctaacgtagttaggaagtttcgaggtcggaccgtgaacgtacttcgtacggaacgggtaccgtaccgggtaccttaagttattaacgttggtacgaccggtaggaaggtacgggtaacgggtaccttaaacgttacccgtaccgtattacggtaactttacggttacggggaaccctacgggtaacccttaccggg

SEQ ID NO: 186564 - DNA, 666 bp, Homo sapiens
  misc_feature: GYAE6OF02FXURL.42.2.A02.1.454.CMB.1.raw
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (253)..(253): a, c, t, g, unknown or other
  misc_feature (253)..(253): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggagttcctctttgtggtggcagcagctacgaggtgtccagtcccaggtgcagctggtgcagtcagggctgagtgaanagcctgggtccncggtgaggtctctgcaaggtcttcgtggacgcaccttnaagtacgcaatgctgtccactgggtgcgtacaggcccctaggacctaaggacttcggagttcggatacgggaatacggtactcccgtagtactacggtaacttaacgaaacgttacgcaacgtaaggtaacgtttcgaacggggactacggaacgttaccgaacccgtagttaacccgtacggaacctactacgtaaccaacgttaaacacgtagtactaacgtattacgtagttcgaagttccggaccttagacctaagtcgttaggaacggttacgtacgggacccgttaataactttagtacgtcgtacgaggtacggtaggtaacggggtaacttaccgttaacccgttccggtacttacggtacgtttaacggtttccggggaacgtaccgggtaccgttaaccgggg

SEQ ID NO: 186565 - DNA, 662 bp, Homo sapiens
  misc_feature: GYAE6OF02H2A7C.42.2.A02.1.454.CMB.1.raw
  modified_base (256)..(256): a, c, t, g, unknown or other
  misc_feature (256)..(256): n is a, c, g, or t
  modified_base (287)..(287): a, c, t, g, unknown or other
  misc_feature (287)..(287): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcgagtcgaggggctggaggtagaaggaagccgtgggtcctcgggtagaaggtctccgtgcgaaggtcttcgnggaggctaccttcagtagacaagttgacgtntccgaccgttgggtgacgacgacggccctagggacgaaggctacggaggtggaggtagggaaagttcgtacctaccgtacgtctacggtaactaaacgaactacgacacaagtaacgtttcgaggtacaagacgtaccaacgtacgttacccggacggactaaccactacccaactaaccacaagtacctacgtaatttacggtagttagtacggtcggtactaggtacacgttacgtaggacgtaccgttcggacttaacgttattaggttgtacgtcggtaggaaggtaggaagggttaacctacgttaaccgtacccgtcgtagtaaccggttaggttaccgggacccggtaacgggtacccgttaaccggg

SEQ ID NO: 186566 - DNA, 548 bp, Homo sapiens
  misc_feature: GYAE6OF02JCQ1S.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcagggctgaggtgaagaagcctgggtcctcggtgaaggtctcctgcaaggcttctggagcaccttcagtgcaatgctgtcacctgggtgcgtacaggcccctggacaggactcgagtggatgggaaatgctcctagtctcggattaacaactacgcacagaagtttcgaggcagagtaccaccattaccgcgaacacacgtccaactaacacagtctaacattacgagttgagtcggcctgactatcgtgagacgttcggccttatacttagttgtgcgagagaggagggtaccttagtttaacccgtcccgtacgttacgtacgttaggttacggggccgtaaccgggacccttacggg

SEQ ID NO: 186567 - DNA, 577 bp, Homo sapiens
  misc_feature: GYAE6OF02FPSQH.42.2.A02.1.454.CMB.1.raw
  modified_base (223)..(223): a, c, t, g, unknown or other
  misc_feature (223)..(223): n is a, c, g, or t
  modified_base (396)..(396): a, c, t, g, unknown or other
  misc_feature (396)..(396): n is a, c, g, or t
  modified_base (438)..(438): a, c, t, g, unknown or other
  misc_feature (438)..(438): n is a, c, g, or t
tcagtgacgtatgtcacgaccggtgctcgatttagactcatctacaggggggagcttcacataacgaccaccttccctcctctaaagaagcccctggggagcacagctcatcaccatggactggacctggaggttcctcttgtggtggcagcagctacaggtgtccagtcccaggtgcagctggtgcagtcaggggctgaggtgaagaagcctgggtctcggngaaggtctcctgcaaggcttcctggacggcaccttcagtagcaatgctgtcacctgggtgcgacaggcccctgacaaggtactcgagtgggatgggaaatagtctccctagcttacggattaaacaacctagcacagaaagtttcagggcagagtcgacataccgcggacacnaccactaaacacagtccacattgagttgtagtgctgacatgngacgaactcggccgtttaaatttattgtcggacggtagaaggacggtaacggggccgttaaacgttttaaacccgtcccggtacttacggaactttaacggttggggaccccgtaacgggggttacccccttaccgggg

SEQ ID NO: 186568 - DNA, 765 bp, Homo sapiens
  misc_feature: GYAE6OF02GR3S1.42.2.A02.1.454.CMB.1.raw
  modified_base (140)..(140): a, c, t, g, unknown or other
  misc_feature (140)..(140): n is a, c, g, or t
  modified_base (183)..(183): a, c, t, g, unknown or other
  misc_feature (183)..(183): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttctctttgnggtggcagcagctacaggtgtccagtcccaggtgcagctggtncagtcgagggctggaggtgaagaggcctagggtcctcgggtgaacggttcctcctaggacgtaagggtctttacggtggggacggtacctacccgtttcgaaacggttacgaccgtaagttcggtaccttacgtacccgtaccggttgggggttacgaccggtaaccggaccgggtaccccggtacgggaaaccgaacgggtaccgtacggtaagggtcggaagggttacggggtaaactacggtcccgttacccgttaacggttaccgtacgggttaaacctttaaaccaaaccgttaaccgaccgtaagtaacggttaacgtttacggaacggtacgaacgtacggtaccaccgtaacgttaccgacgtaaccacgtactactaacctaacacgtactactactagtaggtacgtacgtagtcgtctagactctacgtaggtacggtaccgtcggtaccttagttacttaggttacggtagtacgaggtacgggtacgggagggttaccttaacgttaccggtaccgtagttacgttacggttaccgggtacgggtaccggaaccggttacgttaccggg

SEQ ID NO: 186569 - DNA, 685 bp, Homo sapiens
  misc_feature: GYAE6OF02HL2AP.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctgaggtgaagaagcctgggtccgtcggtaggaaggtctccgtgacgaaggtcttcgtgggacggctaccgttcaggtagacaatgcttacgtcacgtgggtgaccgacgacggccccgtaggacgaacggactcggaggtaggagtagggaaatacgtcctccgtagtctacggtaactaacaactacgacactaagtacgttacgaggtacgacgagtaccaacgtacgtaccgacggaaccactactacccaaccgtaaactacaacgttactaacgtattacggtagtttagacgttacggtcctagtaacctcgtacgttaggaaccgggtaccgtaccgggtacgtttaaacttagttttacgttgggtacgtacgggtacggacgggtaagggtacggggttaacctttaacgttaaacccgttccggtacgtacgttaacggtacggttacccgggggaacgtaccggggtaacccttcgggg

SEQ ID NO: 186570 - DNA, 568 bp, Homo sapiens
  misc_feature: GYAE6OF02FKZJ7.42.2.A02.1.454.CMB.1.raw
  modified_base (191)..(191): a, c, t, g, unknown or other
  misc_feature (191)..(191): n is a, c, g, or t
  modified_base (214)..(214): a, c, t, g, unknown or other
  misc_feature (214)..(214): n is a, c, g, or t
  modified_base (299)..(299): a, c, t, g, unknown or other
  misc_feature (299)..(299): n is a, c, g, or t
  modified_base (397)..(397): a, c, t, g, unknown or other
  misc_feature (397)..(397): n is a, c, g, or t
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctccctgtctgcatctgtagganacagaatcacatcactggccggngagtcaggtcagttggcgtatttttagcctggtatcagcaaaacctggcacagttcctaagctctcatcttcctgcttctacttncatcagggtccatctcgtcttcacgcggcggtcggctcgtgggacacgtatttcacgttcctctaccatcagcacgtcctgacacgcctaggaaacgngttagttacgggaacttacgtttacgttagttctaaaggttaattaactttaacgttttagtaccgttactccttactaccggttttccgggacggggggtaccctaaggggtacggtaggtactaacgtaaaccgtacgtggtacggctacggacctaccgtattacccg

SEQ ID NO: 186571 - DNA, 585 bp, Homo sapiens
  misc_feature: GYAE6OF02IOSAJ.42.2.A02.1.454.CMB.1.raw
  modified_base (244)..(244): a, c, t, g, unknown or other
  misc_feature (244)..(244): n is a, c, g, or t
  modified_base (281)..(281): a, c, t, g, unknown or other
  misc_feature (281)..(281): n is a, c, g, or t
  modified_base (548)..(548): a, c, t, g, unknown or other
  misc_feature (548)..(548): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctggtccctggtgaaggtctcctgcaaggcttcgnggacgcaccttcagtagcaatgctgtcaccgtgggtncgacgacggccccctagggacaaggacgtcgagtgggatagggaaatagtcctaccgtagtctggtacttaaacaaactacgcacgaagtaagtttcgagggcgaagacggtcacccgtacttaccggacggacaacacgtacccaactaaaccactagtacctacagtttgagttacgaaggtcggcctgacgtatcgtaggacgtacgtcggaccgttattaacgttatacgttagccggagaggaggagggtactagttaaccnccgtctagacttggttacgggaccagggtaccctcgg

SEQ ID NO: 186572 - DNA, 895 bp, Homo sapiens
  misc_feature: GYAE6OF02GXSVJ.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatgactggacctggaggttcctctttgtggtggcagcagctacaggtgtccagtcccaggtgcagcgtggtgcagtcgaggggctgaggtagaagacgccgtgggtcctcgggtgaaggttctaccgtgacgaaggtcgttcgtagggtacggacgtacccttacgaaggttacgacgtaaacgttgtccgttggtaccctaaccggttggggttacggaccggtaaccgaccgggtcccccgttagggaaccggtaaacgggtaccgtaccggtaaggtggggtaacggttaaggggtaaaacgtttaacggttcccgtttaacccggttaacgggttaccgttaccggggttaaaactttaaaacccgtaaaaccggttaaccggtaccaaaaccggttaacgggttaaaacggttttaaccgaagggggtaaccctaaagggtacccgttaaccgaaaccccgtttacgtttaaccccggggaacccggtaaacctaaccggtaccgttaaccccgtaaaccgttaaaccgaaccgtaacggttaaccttaacggttaacgtttacgggttaaacgttacgggtaacggttacgggtacccgttacggaccgtaacgttcgtacggtacggttaccggtaccggttaccgttaattacgtttacttcggaacgtggtagaacgggtaacgggtacggttaaccttaacgttacccgtaacccggttacgtacgttacggttacggtttaccggggtaccgtacgggtaacccgttaccgg

SEQ ID NO: 186573 - DNA, 581 bp, Homo sapiens
  misc_feature: GYAE6OF02GRI8U.42.2.A02.1.454.CMB.1.raw
  modified_base (458)..(458): a, c, t, g, unknown or other
  misc_feature (458)..(458): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctgaggtgaagaagccgtgggtcctcggtgaaggtctccgtgcaaggcttctggaggcaccttcagtagcaatgctgtcacctgggtgcgacaggcccctggacaaggctcgagtggatggaatgtctccctagtctcggaattaacaaactacgactacgaagtaacgtttcgaggggcaggactcgaacctaagttaccggacgaaccacaactccaactaaaccacacgtctacattgaagttgacgtgctagactatcngagacgtacggccgttattacgttattagtcgcgaggagtagggtacgggtctttaacgttaacccgtcccggtacgtcggtacgttaggttaccggggacccgtacgggaccccgttacggg

SEQ ID NO: 186574 - DNA, 585 bp, Homo sapiens
  misc_feature: GYAE6OF02FK97R.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctggggtcgcgacacgggcccctggacgaaggactcgaggtggatagggaaatgtcctccgtagtcgtcggattaaacaaactacgactaacagtaacgtttcgaggtacagacgtcaaccattaccggcgacacactccaactaacactagtcacattgagttagagtcggctagacagttcgtaggacgtacgtccgggaccgttaattacttagtttgtacgcggagaggtaggacgggtacttaacgtttaaccgtacccgtcgtacgtacttaggttacgggaacccgtacgggtacccgttacggg

SEQ ID NO: 186575 - DNA, 704 bp, Homo sapiens
  misc_feature: GYAE6OF02I8G0H.42.2.A02.1.454.CMB.1.raw
  modified_base (167)..(167): a, c, t, g, unknown or other
  misc_feature (167)..(167): n is a, c, g, or t
  modified_base (249)..(249): a, c, t, g, unknown or other
  misc_feature (249)..(249): n is a, c, g, or t
  modified_base (446)..(446): a, c, t, g, unknown or other
  misc_feature (446)..(446): n is a, c, g, or t
  modified_base (479)..(479): a, c, t, g, unknown or other
  misc_feature (479)..(479): n is a, c, g, or t
  modified_base (594)..(594): a, c, t, g, unknown or other
  misc_feature (594)..(594): n is a, c, g, or t
tcagtgacgtatgtcacgaccggtgctcgatttagactcatctacagggggaagtctctctcagtcaggacacagcttggacatgagggtcccctgctcagctccgtgggacctcctgcctgctcgtcggctcccagactccagatgtcgacatccagatcgacccngtcctcccttcctccgtgtctgctatcaggtaggaactacgagtatccacctatacactcggccgggacgacgtcgacggtntaggttcgtacgttagttttacgcgttgtactcgaacgacaaaaccgtgaccacgacgttacctaacgacttccgtactcttccgtttcctcgtactttacctttacttacggacctacgtacggtaacgggtcccctagtccgtcctcgttacgcccggtcgggtggcggtctcggacggtacctagtccgttacncgtactccactacctataccgctaaccgtacgntacccggacgtactacggaaggtttaacttcgggtaaacggttaaccgttacttaaccgggttataaaccggttaacttaacttaaggttacccgtttagtccctttaacccgtnttaccgggtaacccggtttcggggacggggtaaccgaggttacggtaacgttaacaaccggtaaggttaccggtacggtcgttacgtaaccgaccgttacgtacgttacc

SEQ ID NO: 186576 - DNA, 662 bp, Homo sapiens
  misc_feature: GYAE6OF02IV6YZ.42.2.A02.1.454.CMB.1.raw
  modified_base (187)..(187): a, c, t, g, unknown or other
  misc_feature (187)..(187): n is a, c, g, or t
  modified_base (205)..(205): a, c, t, g, unknown or other
  misc_feature (205)..(205): n is a, c, g, or t
  modified_base (228)..(228): a, c, t, g, unknown or other
  misc_feature (228)..(228): n is a, c, g, or t
  modified_base (256)..(256): a, c, t, g, unknown or other
  misc_feature (256)..(256): n is a, c, g, or t
tcagtgacgtatgtcacgaccggtgctcgatttagactcatctacgagggggagcttcacataacgaccaccttcctcctctaaagaagcccctgggagcacagctcatcaccatggactggacctggacggttcctctttgtggtggcagcagctacgaggtgtccagtcccaggtgcagcgtggngcagtcgagggtctaggnggtagaagagccgtggccgtggngacggtctccgtagcaggtcttgtaggngcctaccttcgagtagacaagtcgtcgtcgtccgtaaccgtgggtcgaccgacgaccggtccccgtaggaaccgacggacgtcgaaggtggagtaggaactagtacctccgtagtcgtacgtaataaaccgtaactacgacaacgtaagtacggttacgaggtacacgtactaccgaccgtaacgttaccgacggtaaccacgtaactacctaacgaaccgtactaacgtaccgaacttagttagtacgtttacgagtaccggtccgttagaccgtacgtacgtcgaacgtcccggttacgtaccgttaagttccttagttacgtgtaccgagtacgagggtaggtaccttacgttaccgacccgtgttacgccgttagtccgggaacgtccggttaaccttccgg

SEQ ID NO: 186577 - DNA, 747 bp, Homo sapiens
  misc_feature: GYAE6OF02IXODQ.42.2.A02.1.454.CMB.1.raw
  modified_base (292)..(292): a, c, t, g, unknown or other
  misc_feature (292)..(292): n is a, c, g, or t
tcagtgacgtatgtcacgaccggtgctcgatttagactcatctacagggggagcttcacataacgaccaccttcctcctctaaagaagcccctgggagcacagctcatcaccatggactcggacctggagttcctctttgtggtgcagcagctacaggtgtccagtcccaggtgacagctggtgcagtcaggggctggaggtcgaagaacgcctgggtccgtcggtgaacggtctcctgcaacggcttcgtggcggccaccttcgagtagcaatgctgtacaccgtgggtcncgacgtacggccccgtaggacgaaggacttcggaggtggaagtaggggaaactaggtccgtaccgtacggtccgtacggtaactttaaaccgaaacgttaacgccgtaacaaggtaacggttttacgaacggggtacctaaggaaccgttcgtaaaccctaagtttaacccggaccgggtaaccctaacggtaaacttacccctaacctaaaccgtaacgtaaccgttaacctaaccgtaagttacgggtagtttacgacggttacggaccttacgtaacgtactacgttacggtacgggtacttaccgggtaacccgttagttaacgttttaagttacgtacgggttgggaacgtaacgggtaggaaacgggggtactttaaacggtttaacctcccggtagttaccggtacgttaacggtttcggggacccgttaccgggtacccgtaacggg

SEQ ID NO: 186578 - DNA, 634 bp, Homo sapiens
  misc_feature: GYAE6OF02IRJY4.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccgaggtgcagctggtgcagtcgaggggctggaggtgaagaagccgtgggtctcggtgaggtctcctgcaagtctcgtggagcaccttcgagtagcaatgctgtcaccgtgggtcgacgacgacgggccccgtaggaacgtaacgggactacggaggtaggagtagggaaatcgtccttccgtagtcgtagaactaaacgaaactacgcacgagtaacgttcgagacgagagtaccacacgttaccgacgacacacgtaccaactaacacgtaacgtactactagtaggtacgtttaggtacgtacggaccgtagaccgtactacgtaggacgtacgttccggtacgttaattagtttacgttagtcgtacggagaacggtacggaagggtacgtttaagtttacccgttaccgtcgttacgtaacgtttaggtaccgggtaccggtaccggggtaacccttcggg

SEQ ID NO: 186579 - DNA, 799 bp, Homo sapiens
  misc_feature: GYAE6OF02JVOF1.42.2.A02.1.454.CMB.1.raw
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
tcagtgacgtatgtcacgaccggtgctcgatttagactcatctacagggggaagtctctctcagtcaggacacagcttggacatgagggtccctgctcagctcctgggactcctgctgctctggctcccagactaccagatgtgactatccagtatcgacccagtcctccttcctccctgtctgctatctgtacgganacanaactcactatccgtacgttcgccgggctaggtctaggtctagttggtacgttagtttttacggcctttaggtacttaccgaacggtaacctaaaaacgtcggacctaacgtacgttaccctaaacggtcccttccctacctaactttcccgttttaccgtcgttcctttaccttactttaccggtactaaccgttaccggtaaccgggttcctacgttaccgttccgtcctttacggaccgggtccgggtcgggttccggtaccggttaccgggttaacgggaaccgttaacggttacgttttacccgaaccgttccgttacccgaacccgtacgtaccgtaacccgacgtaccgtccgttaccggccgtaaacggtacccgtaaggttaaacggtttcggttaacggttaaccggtaaacgtttacgttacggttagtaaccgtaaatttaccgttaaacttacgttttcgaccgttccgttaccggttacgtaccgggtttacggggaccggtaacggtagggtcgtaaccggtaacgtaaccggtaaacggttacttacgggtcggtacgtccgtaaccgtctacgtttaccgg

SEQ ID NO: 186580 - DNA, 827 bp, Homo sapiens
  misc_feature: GYAE6OF02ISAW7.42.2.A02.1.454.CMB.1.raw
tcagtgacgtatgtcacgaccggtgctcgatttagactcatctacagggggagcttcacataacgaccaccttcctcctctaaagaagccctgggagcacagctcatcaccatggactggacctggacggttctcgtttggtggtggcagcagctacgaggtcgtcacgtcccaggtcgcagctggtgcgtaagtcgaggggctggacggtagaagaggccgtggtccgtggtagaacggtcctcgtacgacgaaggtcgttcgaggacggctaccgttcagtacgactaagtgtacgtcgtccgaccgttgggtaccgacgacgccggttccccggaaggtaacgaacgggtaccgtaggaagggttacggtaacggtaagggtaaaactttacggtacccgttaccttacggttaccggtacggtttaaaacctttaaaaccgaaaccgttacgtaaccgtaacgttaaggttaaacggttttacgggaacggtaaccgtaaggttacctaccgtaaccccgtttaaccggttaacccggaccgtaacccgtaaaccggtaacctacccgtaaacgttaaccgtaacgtaacgtttacctaacgtacgtttaggtacggtttagtacgggttacgtaaccgtcgtaactaacgtctacgggtaacggttacggtaccggtaaccgttaatttacgttacggttacggtgaacggtaggtaacgggtacgggtacgggttaaccttaacggtttaaccccaccggttaccttacggttaccggttagggtacccgggtaacggttaccgggtaaccggttcccggg

SEQ ID NO: 186581 - DNA, 806 bp, Homo sapiens
  misc_feature: GYAE6OF02JXU01.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagcgtggtgcagtcgaggggctggaggtgaagagccgtgggtctcgggtgaaggtctccgtgcaaggtcttcgtggacggctaccgttgagtagactaagtcgctcgtccgacgtgggtacgccgaccgacggcccgtaggaacaacggtacgtccggtaggtcgggaagtagggtaaacttccggtaccgttaccggtagtccggttaacggaaacttaaaccgtaaaccgtacggacctaacggtaacggttacggttaccggaaagggtcgaaacgggttaccgtaccgaacccgttaacggttacccgggacgaaccgtaactaccgtacccgaaacgtaacctaccgtaacggtaactaacgttagttaacggttagtttacgggacgtccgggtacctacgtaacgtacggttccgtaagggtaaccgtaccggtaccggtttaaccgttaaacgtttacgtttaagttaccgggttaacgtagggttaacgggtacgggtaaacggggtaacgggttaaaccggtttaaccgtttaaaccccgggtcccgttaacgttacggttaaccgggttaaccggggttacccgggtaccggggtaacccggttaccccggttaccggg

SEQ ID NO: 186582 - DNA, 1186 bp, Homo sapiens
  misc_feature: GYAE6OF02HTFSR.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagcgtggtgcagtcgagggctggaggtagaagaacgccgtgggtccgttcgggtagaaggttcctccgtgacgaaggtcttcgtgggacggcctaccttacgaagttacgactaagttacggcgttcgtacccgtaaccggttggggtacggtaccggaacccggtaccgggcccccggttacggggtaaaccggaaaccggggtaacccggttaccgggtaacggggtacgggtaaagggttaagggggtaaaaactttaccggttaccccgttaccccggtttaacggttaccggttaacccggttaaaaagtttaaaaccccgtaaaaccgtttaaacccggaacccgtaaaccgttaaaacgggttaaaccggttttaaccgggaacgggggtaaccgtaaacgggttaacccgggttaacccgtaaaacccccgttaaccggttttaaaccccggggacccgggtaaaccccgtaaaccgttaaacccggtaaccccctaaaaacccgtaaaacccggtaaacccgttaaaacggttaacccgtttaaaaccggttaacggttttaacgggggttaaccgttttaaacggggtccggggttttaaacccgggacccgtttaaaccgggtaaacctttaacggttaaccgggtttaaccgggggttaaccccggggtaaccgggttttacccgggggttaaccccgttttttaaaagttttttaaaccgggtttttaaacgtttccgggggttttaacccgggtaaccggggtaaggggggttaaaaccggggtaaacgggggtttaccgggggtttaaaaccccgtttttttaaaacccggttttaaaaccccccgggttccccgggtttttaaaccggttaaccggggtttttaaaacccggggtttttaaaccccgggggttttaccccgggggggggggaaaaccccccggtttaaaacccgggggggttttaaacccccccgggttttaaaccccgggggg

SEQ ID NO: 186583 - DNA, 1018 bp, Homo sapiens
  misc_feature: GYAE6OF02G2WUD.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggaggtgaagtaacgccgtgggtaccgttcgggtagaacggttcctccgtggacgaacggtcttccgtagggtacgggacctacccgtttacgaacggttagaccgtaacgtcgtcgttacggtaccgtaacccggttgggggtaccgtacggtaaccggtaccgggtcccccgttacggggaaccgtaaacggggttaccgtacgggtacgggtttacgggaacggttaacgggggtaaaacgtttaccgggttaccccgttaacccccggttaacgggttttacccgttaacggggttaaacctttaaaacccggtaaaaacccgttaccggaccctaaacggtaaacggtttaaccggttttaaccgggaacggggtacccgtaaaggtaaccgggtacccaacccgttaacgttaaccccgggtaaccggaaaccgtaacctaacccgttaccctaaacccgttaaaacccgaaccgttaacggttaacccgttaaaccgtaacgtttacggtaaaggtttaccgggtaagggtttcccgggaccttaccgggtaaccgttaccggttaccgggtttaaaccgggaccggggttaacccgtttaccgggtaacccggtttttaacgttaacgggtttttaaacggtttccgggtaagggtaaccgggttaacgggtaacggggtaacgggtaaccgggggtttaactttaaaccgggtttaacccccggttacccggttacgtttaaccggtaacccggtttaggggttaacccgggggtaacccggttaaccggggtacccggtttaaccccgggg

SEQ ID NO: 186584 - DNA, 771 bp, Homo sapiens
  misc_feature: GYAE6OF02G7A5R.42.2.A02.1.454.CMB.1.raw
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
  modified_base (243)..(243): a, c, t, g, unknown or other
  misc_feature (243)..(243): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (273)..(273): a, c, t, g, unknown or other
  misc_feature (273)..(273): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagcgtggtgcgagtcgaggggctgaggtgaagagctgggtcctcggngaagtctcngcaaggctcgnggngcaccttcagancatgctgcacgtggngcgacacggcccgtggacgaaggacgtcgagtaggagtagggaattacgtctacccgtagtacgtacggtaataaaccgtaacgtacgactaacgaagttaacgttacggagggactaaggacgtaccgtaacccgtaacgttacccggaccggtaacctaccgtaaaccgtaccgtaaacccttaaaccgaaccgttacgttaaccttaaaccgttacggtttaacggtacggtttacggtaacggggttccgaccggtttacgaaccgttacgttacggttaggtaaccggtaacccgttcgggttaacccggtttaatttaacggtttactttaacggggtcgtaaccgggtaacgggacggtaaacgggggttaaggggttaaccgttttaacccgtttaaacccggttaccccggttacggtttaacggttaaccggtttggggttaaccccgggggtaacgtaccccgggggttaacccgtttaccccgggg

SEQ ID NO: 186585 - DNA, 677 bp, Homo sapiens
  misc_feature: GYAE6OF02FKUM6.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcagggctgaggtgaagagcctgggtcctcggtgaaggtctctgcaggtcttctggaggctacctcgagtacgcaatgctgtctacgtgggtcgcgacgacggccccgtaggacgaacggacgtcgaggtggacgtagggaaattacggtacctccgtagtcgtacggtacttaaacgaaacctacgactagaacgtaacgttcgacgggactaggaacgtccaacctacgttacccgacgtacacgactaccaactaacacctacgtactacagtttagagttgacgttcgactcgaactagttacgtagggacggtacgtccgggtactttaacgttaagtttacgttcggtagggtccgtaagggtaaggacggggttaagggttaaccgtttaaccggtttaacccggtaccccgtacgttaacggtaccggtttaacggggttaccgggggacccggttaaccggggtaaccccggttaccgggg

SEQ ID NO: 186586 - DNA, 720 bp, Homo sapiens
  misc_feature: GYAE6OF02HIU7X.42.2.A02.1.454.CMB.1.raw
  modified_base (141)..(141): a, c, t, g, unknown or other
  misc_feature (141)..(141): n is a, c, g, or t
  modified_base (242)..(242): a, c, t, g, unknown or other
  misc_feature (242)..(242): n is a, c, g, or t
  modified_base (257)..(257): a, c, t, g, unknown or other
  misc_feature (257)..(257): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgnggtggcagcagctacaggtgtccagtcccgaggtgcgagctggtcgcaggtcgaggggctggaggtagaaggagccgtgggtccgtcgggtagacggttcncctgacaggtcttgnggaggtcctaccttgagtacgacaagtgctgtcaccgtgggtcgaccgacgacggtcccctagggaaccgaacgggactcggaggtcggaaggtagggaaattacgtccgttaccgttaggtaccgtacggtaaacttaaaccaaacgtaccggactaacgtaagtaaccccggtttgaacgggtacgaacggtacgtaaccaacgttaccgttacccggacggtaacccaacgtaccgtaacccaaaccggtaaacaccgtaacgttacctaaacgttcgttaagtacgtttaggacgttcgggactacgactacgtcgtaggacgtacgtacggtacgtttatacgttagttcgacgacgagggtacggtacgggtaacgggtctttaacgtaacccgtcccgtagtaccggttacggtacgggttaaccggggaccgttaaccgggtacccgtacccggg

SEQ ID NO: 186587 - DNA, 811 bp, Homo sapiens
  misc_feature: GYAE6OF02FNRDQ.42.2.A02.1.454.CMB.1.raw
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatgacccagtctccttcctcctgtctgcatctgtaggagacagaatcaccatctactgccgggacgagtcaggtctagttggtacgttagtttttacgccgttaggttatacgtacgaacctaaaaaccgtggacctaacgtaccgttaccgtaaacgccttcctacgtactttaccttttacccgtaggttccttttaccgtttaacgtttcgaacgttaacttacccggtaacggggttacccctaagttcccgttccgtacttaccggaacggtccggggtcggttcgggtaccgttacgggtacgggaacgttaacggttactttaccgaacccttaccgttacgaaccctacgttacgaaccgttacaaccggtcctacggaccctaacggtacccgtaggtaaaggttacgtttacggttaaagggtaacccgtttaagtttaaccgttacggttaaagttaaacgtttactttaaacgttttaaaccgtttttcggtaccttacccgtttcgttaacccgggttaaccgggttttcccgggggaaccggggggtaacccgttaacggggtagggtaaaccggttaaccgttaacgggtaaaccgtaacgtttcgggaacggttaccgtacggacccgtacttacgttacccgg

SEQ ID NO: 186588 - DNA, 914 bp, Homo sapiens
  misc_feature: GYAE6OF02IDWZE.42.2.A02.1.454.CMB.1.raw
  modified_base (793)..(793): a, c, t, g, unknown or other
  misc_feature (793)..(793): n is a, c, g, or t
tcagtgacgtatgtcacgaccggtgctcgatttagactcatctacaggggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctggaggtgaagaagcctgggtccgtcgggtgaaggtctccgtagacgtaagggcctttcgtgggacggctaccgtttcaagttacgctaaagtcgacgttacgttaccgtacccggttggggttacggaccggtaaccgaacccggggtcccccccgttacgggggaaaaccgtaaacggggtaacccgttacgggaaccgggtaggggtaacggtaagggggtaaaaaacgttaacggtttccccgttaaccccggttaacggttaccggttaaacccggggttaaacgtttaaaaacccgtaaaaaacccgttaaaccggtaccgtaaaccgtaaacggttaaacgtttttaacggaacggggtccgtaaacggtaacggttacccaaacccgtttaaccggtttaacccgggaccggttaaaccgaacccgtaaactcccctaaaccgttaaaccgaaacttaaccggttacctaaaccgttaagttaggtacggtttaacggaacgttcgggtaccctacgtaacgtaacgttacgtacggacgggtaccgtaccgggttacgttaacgtttaagttacgtttaggttacggnggtaacggtaacggtagggtaacggggttactttaaacggttttaaccccgtcccggtagttaccggttacgtttaacgggttcccggggtacggacccgggtttaacccggttacccggg

SEQ ID NO: 186589 - DNA, 841 bp, Homo sapiens
  misc_feature: GYAE6OF02JC8UO.42.2.A02.1.454.CMB.1.raw
  modified_base (97)..(97): a, c, t, g, unknown or other
  misc_feature (97)..(97): n is a, c, g, or t
  modified_base (159)..(159): a, c, t, g, unknown or other
  misc_feature (159)..(159): n is a, c, g, or t
  modified_base (186)..(186): a, c, t, g, unknown or other
  misc_feature (186)..(186): n is a, c, g, or t
tcagtgacgtatgtcacgaccggtgctcgatttagactcatctacagggggagcttcacataacgaccaccttcctcctctaaagagcccctgggancacagctcatcaccatggactggacctggagttcctctttgtggtggcagcagctacaggtntccagtcccgaggtgccagtctgggtnacacgtcggaggggctggaagggtagaagaggtccgtgggtcctcgggtagtaacggtcctccgtaggaccgtaagggtcctttcggtagggaccggaccttacccgttacgtaacggttacgacctaaagttcggtaccgttaccggtaccgtaccggttcggggtaccggaacccggttaaccggacccggggtacccccgtagggtaaaccggtaacgggtaccggttaccgggaggggttagggtaaacggttaacggggtaaaattaccgggttcccgttacccggttacggttacccggttaacgggtaaacctttaaaccgaaaccgttaccgacctaaacggtaaggttaaccggtttacgacgggtacgaacggtacgtacctaaccgtagttacccggacgaacccgtactaaccgtaccgtaactaaccgactaccggtaacttactacggtagtaacgttacggtacggttcctacgtcaacgttacgtaccgaggtaccgtaccgtaccgggtacgttaactttagtcgttacgggtacgagtaggtaacgggacgggttaacgggttaccttacggtttacccggacgttacgtaccggtacggttacggacccgggtaacggttaccccggtagtaccgg

SEQ ID NO: 186590 - DNA, 660 bp, Homo sapiens
  misc_feature: GYAE6OF02GGZRA.42.2.A02.1.454.CMB.1.raw
  modified_base (249)..(249): a, c, t, g, unknown or other
  misc_feature (249)..(249): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgagggctagaggtgaagagccgtgggtcctcgggtgaacggtctcctgctaaggtcttgnggagcctaccttacagtagacaatcgctgccacgtgggtcgcgacgacggtcccgtaggaaccgaaggccgtacggaggtgggacgtaagggaaagttacgtcccttaccgtaggtcgtacggtaaacttaaaccaacgtaccgtacgtaacgaaggttagttaccgagggtactacgtacgtacccaaccgtactaaccggaccgtaacctacgtacctacccgaaacctaaccaactaacgtactaactagttagttaagttaggtcggtacgttaccgtatacgacgttacgtaggtaccgtacggttccggtacgttattagttagttggagtaggagaggaggtaacgggtacttagtaccttccgagtacgtacgttaggtccgggtaccgtacggtccgtacgg

SEQ ID NO: 186591 - DNA, 522 bp, Homo sapiens
  misc_feature: GYAE6OF02GAG2O.42.2.A02.1.454.CMB.1.raw
  modified_base (462)..(462): a, c, t, g, unknown or other
  misc_feature (462)..(462): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctggtgaaggtctcctgcaaggcttctgggagcaccttcagtagcaatgctgtcactgggtgcgacaggcccctggacaaggactcgagtggatagggaatagtctcctagtctcggattaacaaactacgacacagaacgtttcagggcagagtcaccattaccgcgacacactaccactaacacagtactacattgtagtgagtgtctgactatctgagactcgctatattatgtgcagagagngggtacttagttaactcccgatacgtacttaggttacggggctacggggaccttaccggg

SEQ ID NO: 186592 - DNA, 795 bp, Homo sapiens
  misc_feature: GYAE6OF02IE2RS.42.2.A02.1.454.CMB.1.raw
  modified_base (203)..(203): a, c, t, g, unknown or other
  misc_feature (203)..(203): n is a, c, g, or t
  modified_base (274)..(274): a, c, t, g, unknown or other
  misc_feature (274)..(274): n is a, c, g, or t
  modified_base (655)..(655): a, c, t, g, unknown or other
  misc_feature (655)..(655): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggagttcctctttgtggtgcgagcagctacgaggtgtccagtcccgaggtgcagcgtgggtgcgaggtcgacggggtntaggaggtagaaaggtaacgccgttcggggtctcgggtagtaacggtcctcgtagacgaacggtcgtttgnggaggcctaccgttagaggtacgactaagtcgacgttcgtcgtacggttggggtacgaccggaacggtaccgggtccccgtacgggaaccgaaacgggtacgtaccgggtaggtagggtaacgggtaacgggtaaaacgttcggttcccgttaccgttaaccggttaccggtaacggtaaaaccttaaaccggttaaaacgtccgaaccgaacgttaacggttaaacgttcgggaaacggtcgtaaacgtaccggtaccctaaaccgttaccgttaccccgggacggtaacctaaccgtacctaaccctaaaaccgtaacaccgtacgttaacccgagtacgttaggtaggttacggtaacgtccggtctacggtaacctnttacgtacgggacgtaccgccgttagttacttacgttagtacgtcgaggtacgtggtaaggtacgggttaaccttaacgttacccgtacgtcgttagtaccggtagggttaccggaaccggtacgggttacccgttacgg

SEQ ID NO: 186593 - DNA, 754 bp, Homo sapiens
  misc_feature: GYAE6OF02I95WJ.42.2.A02.1.454.CMB.1.raw
  modified_base (130)..(130): a, c, t, g, unknown or other
  misc_feature (130)..(130): n is a, c, g, or t
  modified_base (189)..(189): a, c, t, g, unknown or other
  misc_feature (189)..(189): n is a, c, g, or t
tcagtgacgtatgtcacgaccggtgctcgatttagactcatctacgagggggagcttcacataacgaccaccttcctcctctaaagaacgccccgtgggagcacagctcatcaccatggactggactggngtcctcttgtgtgcagcagctacgaggtcgtccgacgtcccaggtgcgaaggcgtcggnaccgagtcgagggtctgggaggtacggaacggtacgccgtcgggttccgtcgggtacgtaacggtctaccgtgacgaggtcttagcggacgtccctacttcgagtacggacagtcggtctacgtaccgtcggttggcgaccggtacgaccgggcccgtaggaacgacggtaacgtcgagggtagaaggtacggaaattcgtccgtacgttaggtacctaggtaacttaaaccgaacgtccgacgtaacgtaacggttaacgtcggaggtaactaacgtccgttacgacccttaacgtaccggaaccggtaactacccgaacctaacctaaccgtaaacgaccgttaacgtaccgttaacgttacgttcggttaagttttccgggaacgttaccgggtaaccctacggtacttaaccggtcggtaacgttaccgggcgttaccgggtacgtttattacgttttagccgggtacgacgaggtaccgggaggtcggttaaccgttaacggttccgaccgttagacgttaccgttaccgggtagggtacccgtacggtccgttacccgg

SEQ ID NO: 186594 - DNA, 663 bp, Homo sapiens
  misc_feature: GYAE6OF02HRI5N.42.2.A02.1.454.CMB.1.raw
  modified_base (263)..(263): a, c, t, g, unknown or other
  misc_feature (263)..(263): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtgcagcagctacaggtgtccagtcccaggtgcagctggtgcagtcgaggggctgaggtgaagagccgtgggtcctcggtagaaggtctccgtgctaaggtcttcgtggacggcaccgttnagtacgactaagtgcttcgtccaccgtgggtcgccgacgaccggtccccgtaggaccgtaaggacgtcgaggtacggaagtagggtaaaacgttcgtccttaccgtagttcccgtaaggtaacttaacgaaacctacggacaacgtaggtaagtttacgaagggcgaacgtacgtaccaacctacgttacccgacggactactacgtaccctaacgtaaccaacctacgtaccttacgtagtttacgagtttacgaggtcgtccgtagacctagtccgtagacggtaccgtcggacttaattgttagttgtcgtacgacggaggacggtaggttaaccttacgttacccgtcccgtagttacgtacgttacgggtacgggtaccggaccgggtacctcgg

SEQ ID NO: 186595 - DNA, 763 bp, Homo sapiens
  misc_feature: GYAE6OF02GUD4H.42.2.A02.1.454.CMB.1.raw
  modified_base (602)..(602): a, c, t, g, unknown or other
  misc_feature (602)..(602): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctaacaggtgtccagtcccgaggtgcagcgtggtgcagtcgaggggctggaggtagaagaacgcgtgggtcctcggtagaaggttcctcgtgacgaaggtcttcgtggacggctaccgttcagtagactaagtcgacgttcgtaccgtaccggtgggtacggtaccggaccggtacccggtcccccgttaggaacgtaaccgggtacgtacgggaagggttacgggacgtaaggggtaaaagttaacgttccgttaccccgttaggttaccgtaacggtaaacgttaaaaccaaaaccgttaaccgacgtaacgtaaacggttaacggtttacggacgggacgtaaacgacggtaccctaaaccgtaacgtacccggaccgaacaaacctactaaccaaactaacacgtactactactagttacgtagttggacgttcggccttagaacngttacgtacgtacggtaccgtacggtacgttaacgtttaatttagttcgtacggacgtacgtaaggtacgggagggttaacctttaaacggtttacccgtccgtacgtacgttaacggttaacgggtcccgggtaaccggtaaccgggtacccgttaccgg

SEQ ID NO: 186596 - DNA, 768 bp, Homo sapiens
  misc_feature: GYAE6OF02FLAG8.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctggtgaaggtctcctgcaaggcttcgtggaggcaccttcagtagcaatcgctgtcaccgtgggtcgcgacgaggcccctggacaacggactcggagtggagtgggaaatgtctcccgtagtcgtacggacttaaaccaaacgtacgtacaacgaaggtaacgtttcgacgggtacaaggtacgtacaaccgtacgttaacccggaccggaacaccgaacgttacccgaaaccttaaaccgaaccgtaacgttacctaaaccgtagtttacgaacggtttacggaacgttcggtacccgttaggaaccctaagttacccttagggaacggttaacccggttcccggggttaacccgttaacgtttaaacgttttaacggttacgggtttacgggtacccgggtaaggtaaagggtaaccggggtaacggggggttaaccctttaaagggttttttaaaaccccgtacccccggttaccgtttaacgggttaaccgtttaacggtttaccggggggaaccccgttaaccgggggttaaccccccgttacgggg

SEQ ID NO: 186597 - DNA, 712 bp, Homo sapiens
  misc_feature: GYAE6OF02JN4VE.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttctctttgtggtggcagcagctacgaggtgtccagtcccaggtgcagcgtggtgcaggtcgagggcgtggaggtgaagaagccgtgggtctcggtgaaggtctccgtgacgaggtcttcgtggaggcctaccttcgagtagacaagtgccgttgtccgaccggtgggtcgccggacgaccggccccgtaggacgaagacgtcgagtggagtaggaagtgtcctaccgtagtccgtaacggtaactaaacgtaaactacgacgaacgtaacggtagttaccgagggtacgaacgtacgacccgtaaccgtacgttaaccggacggtaaccaacgtaacctaacccgtaactaaaccacgtaacttaccgtaacgtaacgttaggtaggtttacggtaacgtccggtaaccgtacgacgtacgttacgtacggtaaccgggtaccgtccggtaaccgttaactttaaggttacgtttggtaacgcgggtagtacgggtaagggtacggggttacctttaaggttacccgacccggtattcgggtaacgtacggtccgggtaaccgtaccggacccgttaccgg

SEQ ID NO: 186598 - DNA, 849 bp, Homo sapiens
  misc_feature: GYAE6OF02JV076.42.2.A02.1.454.CMB.1.raw
  modified_base (178)..(178): a, c, t, g, unknown or other
  misc_feature (178)..(178): n is a, c, g, or t
  modified_base (315)..(315): a, c, t, g, unknown or other
  misc_feature (315)..(315): n is a, c, g, or t
  modified_base (490)..(490): a, c, t, g, unknown or other
  misc_feature (490)..(490): n is a, c, g, or t
  modified_base (606)..(606): a, c, t, g, unknown or other
  misc_feature (606)..(606): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggacggttcctctttgtggtggcagcagctacaggtgtccagtcccaggtgcngctggtgcagtcgaggggctggaggtagaagaacgccgtcgggtcctcgggtaggaacggtctccgtggaccgtaaggtcgttacgtgggacggacctaccgtttcgacggtagacctaagtcggtactcgttaccnccggtggggttcgaccggtaccaccgggtacccccggtagggaacgaacggaccgtccgggagggtaggaaggttaaggggtaactaccggttcctacccggtaggttccgtacggtaaactttaaaccgaaaccgtacgaacgtacgtaaacggttaagttacggaaacgggtntaaacgggtacctaccgaaccgtacggttaacccggacggaacctaccgtaactacccgtaaccaaaaccgtaacgaaccgttaactaactaacggtttacgtaaggtttaacggnggtacccgtaccgttacgtaaccttacgttacggtacgggtaacggtaaccgtttaccgggacgttttaagttttaagtttacggttcggttaacgggtaccgggtaggagggtaacgggtaacgggggttaacttttaaacccggttttacccggttacccggttacgtttaacggtacccgggtttacgggttaaccgggggtacccgggttaaacccggggtacccgggtttaacccggg

SEQ ID NO: 186599 - DNA, 585 bp, Homo sapiens
  misc_feature: GYAE6OF02IUH0S.42.2.A02.1.454.CMB.1.raw
  modified_base (398)..(398): a, c, t, g, unknown or other
  misc_feature (398)..(398): n is a, c, g, or t
  modified_base (473)..(473): a, c, t, g, unknown or other
  misc_feature (473)..(473): n is a, c, g, or t
  modified_base (475)..(475): a, c, t, g, unknown or other
  misc_feature (475)..(475): n is a, c, g, or t
tcagtgacgtatgtcacgaccggtgctcgatttagactcatctacagggggagcttcacataacgaccaaccttcctcctctaaagaagcccctgggagcacagctcatcaccatggactggacctggagttcctctttgtggtggcagcagctacaggtgtccacgtcccaggtgcagctggtgcagtcaggggctggaggtgaagagctgggtcctggtgaaggtctcctgcgaaggcttcgtgggaggccaccttcgagtagcaatgctgtcaccgtgggtcgcgacgacgggccccgtgggaaccgaagggaccgtcggaggtcggatagggaaattagtctacctagtcgtacggattaaaccaaactacgacaacgagtaagtttcgagganagacgtacaccgtacgttacgcgaccacactcccaactaacacagtctaactattgtattgaggtcgtcctagantntaggagtacgtcgccgttattattgtagtgagtagagacgggagggtacttaacgttaccgtcccgtgtacgtacgttacgtacggggtaccgtacgggaccccttacgg

SEQ ID NO: 186600 - DNA, 681 bp, Homo sapiens
  misc_feature: GYAE6OF02HZ11Q.42.2.A02.1.454.CMB.1.raw
  modified_base (145)..(145): a, c, t, g, unknown or other
  misc_feature (145)..(145): n is a, c, g, or t
  modified_base (161)..(161): a, c, t, g, unknown or other
  misc_feature (161)..(161): n is a, c, g, or t
  modified_base (192)..(192): a, c, t, g, unknown or other
  misc_feature (192)..(192): n is a, c, g, or t
  modified_base (384)..(384): a, c, t, g, unknown or other
  misc_feature (384)..(384): n is a, c, g, or t
  modified_base (540)..(540): a, c, t, g, unknown or other
  misc_feature (540)..(540): n is a, c, g, or t
tcagtgacgtatgtcacgaccggtgctcgatttagactcatctacagggggagctttcacataacgacccacctttcctcctactaaagaagccccctgggagcacagctcaatcaccatggactggacctggagttctctttgnggtgcagcagctaacnggtagtccacgtacccaggtgcagcgtggtncagtcgagggctgtaggagaacggaacgtccgtgggtcccgttagggtacggaacggttcctaccgttcggacgtaacgggtctttccggacggggtacgcctaacccgtttacaggtacaccgtaactagccttggtcccacggttgggtcgtaccgaaccgcccgggtccccaggaacgaacgggtcccnggtaacggtgggtaacgttacggaaaattcgggttacctaccccgttaggtccgtacgtaactttaaccgaaactcgacacaagttacgttgacggtgaacgacgtctaccgataccggacgaccgacacaccaacactacgacttacacttagtnttagtgtacgtcgacgtctacgattcgacgtacggacgtcgtacgttattacttgttacgtggactaggtagaggtcgtacgttaacgttccgtaccttcgtacgtacgttaggaccgggtacctacgggtaccgttccgg

SEQ ID NO: 186601 - DNA, 802 bp, Homo sapiens
  misc_feature: GYAE6OF02I7AJK.42.2.A02.1.454.CMB.1.raw
  modified_base (144)..(144): a, c, t, g, unknown or other
  misc_feature (144)..(144): n is a, c, g, or t
  modified_base (159)..(159): a, c, t, g, unknown or other
  misc_feature (159)..(159): n is a, c, g, or t
  modified_base (163)..(163): a, c, t, g, unknown or other
  misc_feature (163)..(163): n is a, c, g, or t
  modified_base (278)..(278): a, c, t, g, unknown or other
  misc_feature (278)..(278): n is a, c, g, or t
tcagtgacgtatgtcacgaccggtgctcgatttagactcatctacagggggagcttcacataacgaccaccttcctcctctaaagaacgccccgtgggagcacagctcatcaccagtggactggacctggacgttcctctttgnggtgcagcagctagnggtntccagtcccaggtcgcagctggtgcgagtcgagggctggaggtgaagacgccgtgggtccctggtagaacgttcctcgtcgacaggtcttcggaggacgtcctacgtcgaagtanactagtcgctacggttacaccggttagggtcgaccggaccgaaccggtccccgaaggtaaccgtaacggaccgttacggaggtaaggtacgtaagggtaaacttcgtaccgttccgtacgttcgtaacgtaaattaaacccgtaactaccggactaacgtaacggttacttaccgggtaaggacgtaaacggtcgtaaccccgtactaacccgggtacccgacggtaacctaaccgtacctaacccgtaccgtaaaccttccggtaacttacccgtaagtaccgtttaaggttaccgttaggtaccggttccgtaaccggtatacccgttaaccgttaggaccgtacggtaaccccgttcgggtaacctttaaggtttaactttacgggaccgttacggggaagacggttaagggtcccgggtttaaacggttactttttaaccggtaacccccggttcgtaccgttaccgggttacgttaccggggtacccgggtaaccggacccgggtttacccgtacccgg

SEQ ID NO: 186602 - DNA, 643 bp, Homo sapiens
  misc_feature: GYAE6OF02J0P0N.42.2.A02.1.454.CMB.1.raw
  modified_base (570)..(570): a, c, t, g, unknown or other
  misc_feature (570)..(570): n is a, c, g, or t
  modified_base (580)..(580): a, c, t, g, unknown or other
  misc_feature (580)..(580): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggagttctcttgtggtgcagctagctacaggtgtccagtcccgaggtcgcagtcgtggtgcagtcgagggtctggacggtagaacgacgccgtacgggtcctacggtagaacgttctcctagacgaggtcttgaggacgtcctacctaggagtgacgtatcgacgtcgaccgtcgtgggcgacgaccgtacggtcccgtaggaaccgtaagtacgtacggtacgggtaggaacggtagggtaacgttacgtctaccggttagtcgtacggtaacgtaacgtaacacgtacacgtaagtacgttacgaggtacaggtacgtacgtacgacgtaccggataccgactacgtacactaacgtatacgaactacgtcgtagttacgtggtacgtcgtacggtaacctagtacacggtagaccgaacgttcggtaaccttagtacgttanagtcgtaggngtaggtacgcggtacttacgtactaccgagtagttacgtagtccggacgaccggtcgtaacgg

SEQ ID NO: 186603 - DNA, 769 bp, Homo sapiens
  misc_feature: GYAE6OF02JSOO9.42.2.A02.1.454.CMB.1.raw
  modified_base (188)..(188): a, c, t, g, unknown or other
  misc_feature (188)..(188): n is a, c, g, or t
  modified_base (296)..(296): a, c, t, g, unknown or other
  misc_feature (296)..(296): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacgaggtcgtccacgtcccaggtgcagctgggtncgagtcgagggctggaggtgaagaaggcctgggtcctcggtagaacggttctccgtgacacggtcgttcgtggaggaccaccttcgagtagactaagtcgctgtaccncgtgggtcggcgtaccgcggccccgtaggaccgtaacggaccgtacggtaggtacggtaacggtaaggggtaaaacttacgtccgttaacccgtacggtttccgtaacgggtaaactttaaaccgaaaccttaacaacgtaacgtaaacggttaacgtttacgacgggtactaacggtacgtaccaaccgtaacgttacccggacgaaccgtacaacgttaccaacttaaaccgtacgtaacgtacctaaacgtcgttaagttacggtttaggtacgggttaccgacgttacgtaacgtacgttaccgtaacggacggtaaccgttaccgggtaacgtttagttaacgttaacggtttgttaccgtgggtaaggtacgggtaggtaacggggttaacttaacggttaacccgttacgtacggtcgttaacgggttcggttaaccgggtaccgggtacggtaccccggtacggg

SEQ ID NO: 186604 - DNA, 820 bp, Homo sapiens
  misc_feature: GYAE6OF02G38G0.42.2.A02.1.454.CMB.1.raw
  modified_base (176)..(176): a, c, t, g, unknown or other
  misc_feature (176)..(176): n is a, c, g, or t
tcagtgacgtatgtcacgaccggtgctcgatttagactcatctacagggggagcttcacataacgaccaccttcctcctctaaagaagcccctgggagcacagctcattaccatggactggacctggaggttcctctttgtggtggcagcagctacgaggtctccagtcccaggtncagctggtgacagtcgaggggctggaggtagaagacgccgtgggtcctcggtgacggtcctcgtgacgaacggtcgttacgtcggggacgaccgtaccgtttcgaacggtacggtacaagttggtccttcggtaccgtacccggttggggtccgaccgtaaccggaccgggtcccccgtagggaaccgaacgggtacccgtacgggtacgggtaacgggtacggtaaacggggtaaaactttccggttacccttacccgttacggttccgttaaaccgggtaaacttaaaacccgtaaccgttaccggacctaaacggttaacgttaaaccgggtttacggaacggggtacaaggttaccgttaccacccgtaaccggttaccggaaccggaacctacgtaacccgtacctaaaccgtaaccgtaacctacggttacctaacttacggttacgtaacgggtttagacgggtcggtacctagacccttaagcccgtagggtacggtacccgttcgtaaccgtttaagtttactttacgggtacgttcgggacgtaagggacgggtagggtaaccgttcggttaacctttaccggccctagtacgtacggtaccggtacggaccggtacggtacccgtcgtacccg

SEQ ID NO: 186605 - DNA, 844 bp, Homo sapiens
  misc_feature: GYAE6OF02IY8TQ.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactcggacctggacggttccttctttcgtggtggcagcagctacgaggtgtccacgtcccgaggtgcacgtcgtggtgcgtagtcgacgggcgtggaggtagaacggaacgtccgtacgggtccgtcggtacggaagggttccttaccgtagtaccgtaacggtcttacggtgggacggtcctaccttacacggtacgtacgtaagtccgtaccgttacgacccgtaccggttacggggtcgaccggtaacgaaccccgggtcccggtacgggaacggaacggttaaccggtaccgggtaggtacggtaacggtaacgggtaaacgttcggtaccgttaccccggtaacgtacgtacggttaacttaaaccaaacggtaccaccgaactaggttaacttcggaaacggtcgacgtaacgaccgtaacccgtacgtaacccgtcggaacctactaaccgtacccgtaacctaacgaacgtacgtaccttaacgtagttcgtaaggtttgtaacgtacggttaccgtacgtaacggttactacgggttaccgtaaccggtaaccggtacggttaccgttaagttttaaacgttaaacggtttcgtacggaacgtacgggttaacggtaagggtaccggggttaacctttaaacggttaacccgttacccggtacgttaccgtaagtttccggacccggggtaccggttaaccgggttaccgtaacccggg

SEQ ID NO: 186606 - DNA, 563 bp, Homo sapiens
  misc_feature: GYAE6OF02F43UU.42.2.A02.1.454.CMB.1.raw
  modified_base (445)..(445): a, c, t, g, unknown or other
  misc_feature (445)..(445): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctgaggtgaagaagctgggtcctcggtgaaggtctcctgcaaggcttcgtggaggcaccttcagtagcaatgctgtccaccgttgggtgccgacacgggcccctggacaaggactcgagtggagtgggaaatagtctccctagtcgtcggacttaaacaactacgcacgagtaagtttcgagggcagagtcaccataccggcgacacactccactaacacacgtactacattgtagttgagtgctgactntctagagacttcggacgtatattattgtagcgagaggagggacggggtacttaacgtttaaccgtcccgtagttcgtacgttaggttcggggacccgtacgggtaccccgttaccggg

SEQ ID NO: 186607 - DNA, 771 bp, Homo sapiens
  misc_feature: GYAE6OF02GJNGL.42.2.A02.1.454.CMB.1.raw
  modified_base (311)..(311): a, c, t, g, unknown or other
  misc_feature (311)..(311): n is a, c, g, or t
  modified_base (733)..(733): a, c, t, g, unknown or other
  misc_feature (733)..(733): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttctcttgtggtggcagcagctacaggtgtccgacgtcccgaggtgcgtagctggtgcagtacggagggtctagggaggtgaaggaacggtccgtgggggtaccttcgggtggtaaacggttcctacccgtgtacggaacgggtcttacgtagggacggtccgtaaccttcgaggtaacgngtaacgtcggtcgttaccggtctaccgggttcgggcgacggtaccgaccgggtaccccgtacgggacgaacggtaccgtacggaggtaggtaaggtaaggtaaacgtacgttccgtccgttaggtccgttacggtaaacttaaactaaacgtaccgtactaaccgtaaggtaacggtttacgaacgggtcgtaacggtaagacccgtaccgtaacgtacccggtacggaactaccgtaactaaccctaacctaacaccgttataaaccgtacttacggtttaggacggtttaggaccggttgaacccgtttacggacctagttaaccggtcgaaagggtccccgtaccggtacgttacgttagtttacgttacggagtacgagtaggaggggttacggagtttaccgttaaccgcgttaacncggttagttacggacggtcccggagggtacccgttcgg

SEQ ID NO: 186608 - DNA, 649 bp, Homo sapiens
  misc_feature: GYAE6OF02G8BOX.42.2.A02.1.454.CMB.1.raw
  modified_base (151)..(151): a, c, t, g, unknown or other
  misc_feature (151)..(151): n is a, c, g, or t
  modified_base (156)..(156): a, c, t, g, unknown or other
  misc_feature (156)..(156): n is a, c, g, or t
  modified_base (183)..(183): a, c, t, g, unknown or other
  misc_feature (183)..(183): n is a, c, g, or t
  modified_base (245)..(245): a, c, t, g, unknown or other
  misc_feature (245)..(245): n is a, c, g, or t
  modified_base (610)..(610): a, c, t, g, unknown or other
  misc_feature (610)..(610): n is a, c, g, or t
tcagtgacgtatgtcacgaccggtgctcgatttagactcatctacgagggggagcttcacataacgaccaccttcctcctctaaagaacgcccctgggagcacagctcatcacatggactggacctggagttcctcttgtggtgcagcagntacgnggtgtccagtccaggtgcagcgtggtncgaggtcgaggggcctggaggtgaagtacggccgtgggtccgtcggtagaacggttcctcgnggtacgaaggtccttcgtgggacgcctaccgttacgagttagctaagtcgctcgtcgtaccgtgggctaccggacgtcgtacccgtagaacgaaggccgtacgaggtggaagtaggaatcgtacgtactaggtccgtataacttaaacaaccgtgacgtaagtagtagttacggagtctaagacgtactacgtcgtaccgacgtaccacacttacccaacgtaactaccgtacgtaactaccgtagtacgtacgttgaacggtcgaccgtagtactacgtacgtacgacggtacccgtgtaccgttaagtacgttacgtagtccgaagtacgaggtacggtaacggtacttaagtcccgtaccgnttacggacgttacgggcggtaaccgacgggtactaccgg

SEQ ID NO: 186609 - DNA, 717 bp, Homo sapiens
  misc_feature: GYAE6OF02FYQM7.42.2.A02.1.454.CMB.1.raw
  modified_base (137)..(137): a, c, t, g, unknown or other
  misc_feature (137)..(137): n is a, c, g, or t
  modified_base (219)..(219): a, c, t, g, unknown or other
  misc_feature (219)..(219): n is a, c, g, or t
tcagtgacgtatgtcacgaccggtgctcgatttagactcatctacagggggagcttcacataacgaccaccttcctcctctaaagaagcccctgggagcacagctcatcaccatgactgacctggagttcctcttgnggtggcagcagctacaggtgtccagtcccaggtgcagctggtgcagtcgaggggctgaggtgaagacgcctgggtcctcggngaagtctctgacaaggtcttcgaggacggctaccttgagtagcaatcgtctgtcctacgtgggtcgacgacgcggtaccccgtaggaccgaaggtacgtacggaggtaggagtagggtaaacttcggtaccttacccgtaggtccgtacggtaacttaaaccaacgttaccgacgaacgtaagtaacgtttcgacgggacagtacgtaccaaccgtacgtacccggaccgaaccgtacctaactaacccgtaaacctaaacctaacgtacgttacctacgtaagttaggtaacggttgtaacggttccgacctacgtacgtagttaccgtacggaaccggtaccgtccggtaccgtttaattacgtttagttcggtacgtacggacgtacggacgggtaacggggtaccttttaaaccggttacccggtacccggttacgtacggttaaccggttcgggttaccggggtacccgtaaccggggtaccccttacccggg

SEQ ID NO: 186610 - DNA, 871 bp, Homo sapiens
  misc_feature: GYAE6OF02I2VNN.42.2.A02.1.454.CMB.1.raw
  modified_base (243)..(243): a, c, t, g, unknown or other
  misc_feature (243)..(243): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacgaggtgtccagtcccaggtgcagctggtgcagtcgagggctggaggtagaagagtccgtgggtcctcggtagtaacggtccttccgnggactaagggtcctttcgagggaacggtcctacccgtttcgaaggttacggacctaaagtcggaccttcggtaccctaccggttggggtacgaccgaccgaccggtcccccgtaggaaaccgaacggtacctacggtagggtaggacggtaagggtaaaacgttccggttaccttacccgttacggttccggttaacgggtaaactttaaacccgtaaaaccgttaaccggaccgtaaacgtaaacgggttaacggtttaccggaacggggtactaacggtaacgttaccctaaacccgtaacgttacccgggaacggtaaccctaaaccgtaccggttaacccaaaccttaacgaaccgttaacgttacctaacgtagttaaacgggttcggtttaacgacggttaccggtaaccgtcgtaaccgttacggtacgtagggtaacccggtacgttaccgggtaacctttaagttcgttttaaacggtcgggttaggaccgttaagggaacggttaacggggaacggtttccttaacggttttaacccggtccccggtacggtttacggtaacggttttaccgggggtacccggtaaccggtacccggggttaaaccccgtttccgggg

SEQ ID NO: 186611 - DNA, 660 bp, Homo sapiens
  misc_feature: GYAE6OF02FM777.42.2.A02.1.454.CMB.1.raw
  modified_base (314)..(314): a, c, t, g, unknown or other
  misc_feature (314)..(314): n is a, c, g, or t
  modified_base (325)..(325): a, c, t, g, unknown or other
  misc_feature (325)..(325): n is a, c, g, or t
  modified_base (327)..(327): a, c, t, g, unknown or other
  misc_feature (327)..(327): n is a, c, g, or t
tcagtgacgtatgtcacgaccggtgctcgatttagactcatctacagggggaagtctctctcagtcaggacacagcttggacatgagggtccctgctcagctcctgggactcctgctgctctggctcccagataccagatgtgacatccagatcgaccagtctccttcctcctgtctgcatctgtaggagacagaatccactatcacttggccgggcgacgtcgaggtcagttggacttattttacgcttggtatacgaacgaacctaaaaaccgtgactactacgttacctaagcctacctctacttctttcngtcttctcttnanacgtcgtacggtccatctccgtcttcgaggtcgggtcggttggtccgtacggtaggtaacgtagtacgttttccaccgtcttaccgaacctactaccaacgccgtaacgtcgtacgaccgacgtaccgtaaggtaaacgttaggttacggttacgggttaaaccgttagtttaacgttacgttaacttaaacgttaacgtttaacttttaaacgttcgttaacgtttccctacggttaccgttaccgggttacggggaccggggtacgtaaggggtcgtaacgtaactaacggtaaccgtaagtcggtacggtcgtcggacctacgtcttacg

SEQ ID NO: 186612 - DNA, 675 bp, Homo sapiens
  misc_feature: GYAE6OF02GU3CN.42.2.A02.1.454.CMB.1.raw
  modified_base (184)..(184): a, c, t, g, unknown or other
  misc_feature (184)..(184): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtncagtcgaggggctggaggtgaagagccgtgggtcctgggtgaaggtctcctgctaaggtcttcgtggagctaccgttcagtagacaatcgctgtaccaccgtgggtcgacgaccgacggccccgtaggaaccgaacgggtcctacgggagtaggaagtacgggaaattacggtccttaccgtacgtacgtacggtaacttaacaaacttcgactaacgaaggtaacgtttacgagggtactaagacgtacgacctaagttacccggacgaaccactaacgtacctaaactaactacacgttacctaactagttcgtaggtttacgtcggtacgcctaagaccagttacgtacggtacgggtaccttaccgggtccttaagttagttacgttcggtacgacggtagacggtagggtaacgggttacttaacggttaccgtcccgtgttacgtacggttaggtaccgggacggttaccggaacccggttccgg

SEQ ID NO: 186613 - DNA, 722 bp, Homo sapiens
  misc_feature: GYAE6OF02HDGY9.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcaggggctggaggtgaagaacgcctagggtccctgggtgtaacggtctaccgtcgcgaaggtcttcgtaggacggcctaccgtcgagtagactaatggtacctgtcctaccggtcgggtacgccgtaccgacggtacccccgtaggaaccgaaacgggaccgtacggtaaggtcgggaagtaacggggtaaattacggttacccgttaccccgtagttacgtaccgtaaactttaaaaccgaaaccgtacggaccaagtaacgtaacgttttacgaacggcgaagacgtccaaccgtacgtaccgacgacacgactacccgactaaccgacacgttcaacgtagttaggtagttagagtcgggtacctgaaccgttagtaccgtacggtacggaccgttaccgggtaacgttaagtttcgtttagttacgtcggtagacggtaaggtacgggaacgggttactttaacgttaacccgttcggtactacggttaaccgttacggtacgggtcccggtaagggtacccgtacccgg

SEQ ID NO: 186614 - DNA, 713 bp, Homo sapiens
  misc_feature: GYAE6OF02HHCZM.42.2.A02.1.454.CMB.1.raw
  modified_base (264)..(264): a, c, t, g, unknown or other
  misc_feature (264)..(264): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcgagcagctacaggtgtccagtcccgaggtgcagcctggtgcgagtcgaggggctggagggaggaaggaagccgtgggtccgtcgggtaggtaacggtctcctgcgaagggtccttgnggacggtctaccttcgaggtagcaagtgcgtacgtctaccgtgggtgccggtacgccggccccgtaggaacgaacggacctggtacggtggaagtagggaaattacggtcctacccgtacgtacgttaccggtaaacttaaaacgaaacgtacgactaacgaacgttaagttaccggagggtactaaggacgtaccaacgtaacgttacccgacggacctaacacgtaccaactaacgaacgtacgtactacctaatcgtaaacgttggtaagttaccgggtacgtacgtactaacgttacgtagacgggtacgtcggaccggttaaattaagtttacgttgtagacggtaggtaggacgggttaaggccttaaacgtttacccgtaaccgtacggtacgtaaccgttacgggtaacggggtaccgtaccgggtaacccggttaccggg

SEQ ID NO: 186615 - DNA, 767 bp, Homo sapiens
  misc_feature: GYAE6OF02JQ628.42.2.A02.1.454.CMB.1.raw
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (266)..(266): a, c, t, g, unknown or other
  misc_feature (266)..(266): n is a, c, g, or t
  modified_base (286)..(286): a, c, t, g, unknown or other
  misc_feature (286)..(286): n is a, c, g, or t
tcagtgacgtatgtcacgaccggtgctcgatttagactcatctacagggggagcttcacataacgaccaccttcctcctctaaagaagcccctgggagcacagctcatcaccatgactggacctggaggttcctctttgtggtggcagcagctacaggtgtcccagtcccaggtgcagctggtgcagtcgaggggctggaggtagaagaacgccgtgggtcctcggtagaaggtctcngcaaggcttagnggagctacttcagtanacaatgctgtcaccgtggtnacgacgacggccccgtggaacgaaggacgtacgagtcggagtagggaaattagtcctaccgagtcgtacggtaattaaaccaaacgtacgaccgactaagtaacgttacgtaggacgagacgtacctaactacgttaaccgaccggtaaacacctaacgtaccctaaacgtaaactaaccgtaaccgttaactaaccgttaagtttaacggtaggtttcggtaaacggttcgggaacccttaggtaacctaacgttaccgttaagggtaaccgggtaaccgttacccggggttaccttaaacgtttaacgttttaaacggttttacgaggttaacccggagggttaagggtaaccggggttacgggggttaaacctttaaacgggttttaaaccccgtacccggttaacggttaaccgttaacggtttaaccgggttcggggttaaacccccggaccgggggtttaacccgttaaccgggg

SEQ ID NO: 186616 - DNA, 746 bp, Homo sapiens
  misc_feature: GYAE6OF02GSUDU.42.2.A02.1.454.CMB.1.raw
  modified_base (255)..(255): a, c, t, g, unknown or other
  misc_feature (255)..(255): n is a, c, g, or t
tcagtgacgtatgtcacgaccggtgctcgatttagactcatctacgagggggagcttcacataacgaccaccttcctcctctaaagaagcccctgggagcacagctcatcaccatggactggacctggaggttcctcttgtggtggcagcagctacaggtgtccagtcccaggtgcagctggtgcagtcgaggggtctggaggtagaagaggccgtgggtcctcgggtgaaggtcctccgtgcgtaggtcttcgngggacggcctaccgtttcgaaggttacggactaagtcgtcgttacgttaccaccggttggggtacgaccggtacgtacccgggcccctagggaaccgaacggtctacgggaggtcgggtaggtaagggtaaacttcgttacctccgttaggttccgtacggtaaacttaaaccgaaccgtacgacaacgtacggtacgttacgagggtcgaagacgtacaccgtacgtacccggcgtacactacgtaccaacgtaaccacgtactaccgtagtacgtttaggtacgttaggtacgggttaccggtaccgttacgacgttacgttacgttaagggaccgggttaccgtcggggttaccttaagttttacgtttaggtttcgtacgggtacggaacgggtaggtaacggggtaccgggttaactttaaccgttacccgacgttactacggtacgttacgggttaccgggacgttacccggggaccttaccggg

SEQ ID NO: 186617 - DNA, 628 bp, Homo sapiens
  misc_feature: GYAE6OF02JTN51.42.2.A02.1.454.CMB.1.raw
  modified_base (192)..(192): a, c, t, g, unknown or other
  misc_feature (192)..(192): n is a, c, g, or t
  modified_base (204)..(204): a, c, t, g, unknown or other
  misc_feature (204)..(204): n is a, c, g, or t
  modified_base (288)..(288): a, c, t, g, unknown or other
  misc_feature (288)..(288): n is a, c, g, or t
  modified_base (323)..(323): a, c, t, g, unknown or other
  misc_feature (323)..(323): n is a, c, g, or t
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
  modified_base (434)..(434): a, c, t, g, unknown or other
  misc_feature (434)..(434): n is a, c, g, or t
tcagtgacgtatgtcacgaccggtgctcgatttagactcatctacagggggaagtctctctcagtcaggacacagcttggacatgagggtccctgctcagctcctggactcctgctgcctctggctcccagactaccagactgtgacatccgagatcgacccagtccttcccttacctccctgtctcgactntcgtgtaggganacagtaactccacctatccacggttcgcccggtgtacgcgtaggtacctagttcggtcgttacttttacgcgtttagataccanaacgtaaaccgtgcacgtacgtactaacgcctccnctctcttctctctacttctntctatcgtacggtctacnctcctntcncggtacgtggactcgtgtgccgtagtactctacttcacgactcgtcactctaccgtgtacgccncggtacctaggtaacggttacgtaggttaccggtaacttacgttcttacgtaaccgtaatttagtacttaaacgtttcgtaccttcgtaaacttctaaccgggtttcggggaaccgacgttaggtaccgggtataacggttaccaaacggtttcggacggtacgtttaccggcttaaccggacttcgttaaccg

SEQ ID NO: 186618 - DNA, 811 bp, Homo sapiens
  misc_feature: GYAE6OF02FTJBF.42.2.A02.1.454.CMB.1.raw
  modified_base (625)..(625): a, c, t, g, unknown or other
  misc_feature (625)..(625): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcaggctacaggtgtccagtcccaggtgcagctggtgcagtcgagggctgaggtgaagacgtccgtgggtacctcgggtagaacggtctccgtgacaaggtcttcgtgggacggtcctaccttcgaggtagcctaaagtgtactacgtcctaccggtggggttcgcggtaaccgaccggtcccccgttagggaacgtaacgggtaccgtaccggaagggttggaggtaacggggtaaaactttacgggttaccctacccggtttaacgtccggttaccgggtaaactttaaaacccgtaaccgtaaccgtaccgtaaacggaaacgttaaacggtttacggaacgggtacgtaaggtaccgtaaccctaaccgtaacgttacccgggaccggttaacaaccggtactaccctaaaccgtaaccgtaacgaacgttacctaactaggttacgtacggttagtacgggttcggccgtanaacgttagttaccgtagtacccggtacgggttacgtacccgttaaagttcgtttaggttgtacggacggtagggaaccgtaagggtaacggggttacctttaaaccgttaacccggttcccgttaggttacggtaaccggttaggttacccgggggaaccctaccgggttacccggttaacccggg

SEQ ID NO: 186619 - DNA, 684 bp, Homo sapiens
  misc_feature: GYAE6OF02IHX5X.42.2.A02.1.454.CMB.1.raw
  modified_base (226)..(226): a, c, t, g, unknown or other
  misc_feature (226)..(226): n is a, c, g, or t
tcagtgacgtatgtcacgaccggtgctcgatttagactcatctacagggggaagtctctctcagtcaggacacagcttggacatgagggtccctgctcagctcctgggactcctgctgctcgtggctcccagataccagatgtgacatccagatgacccagtctcccttcctcccgtgtctgctattcgtgtaggagacagaactcaccatcgacttcggccgggngacgtcgtaggtcctagttcggtacgttattttttacgccgtttaggtactacgacgaaacaaaaaccgtcgacaacgtacttaccgtaacgtccttccgtactactttccctttcctcgtccttttcttaccttttgaactaacgtaccggtacgggtaccctcgtccgtcgtacttccgacggcgggtccggtcggtccgtcggtaggtaaccgtacgttaccgtttaccacccgttaccgtcctaacccgtactaccgacgtacgtacgccgtacgccgaacggtctagaagtcgttaggtacggtaacgttacttaacgtacgtaaacttagttaaacttattaacgtttcgtaccgttcgttacgttacgtacggttacggggaccggggtacgagggttacgacgtaacgtaacgtaaacgtacgtagtcggacgtcaacgtctagttaccg

SEQ ID NO: 186620 - DNA, 685 bp, Homo sapiens
  misc_feature: GYAE6OF02IIJ1D.42.2.A02.1.454.CMB.1.raw
  modified_base (53)..(53): a, c, t, g, unknown or other
  misc_feature (53)..(53): n is a, c, g, or t
  modified_base (154)..(154): a, c, t, g, unknown or other
  misc_feature (154)..(154): n is a, c, g, or t
  modified_base (172)..(172): a, c, t, g, unknown or other
  misc_feature (172)..(172): n is a, c, g, or t
  modified_base (181)..(181): a, c, t, g, unknown or other
  misc_feature (181)..(181): n is a, c, g, or t
  modified_base (263)..(263): a, c, t, g, unknown or other
  misc_feature (263)..(263): n is a, c, g, or t
tcagtgacgtatgtcacgaccggtgctcgatttagactcatctacagggggancttcacataacgaccaccttcctcctctaaagaagcccctgggagcacagctcatcacatggactggacctggagttcctctttgtggtggcagcagctanaggtctccagtccaggtncagctggtnctaggtcgagggctaggagtcgaagacgtccgtggtcctaggtagtaacggttcctcgtcggactaaacgggtcctttcggnggacggtacctaccgttacgtagtacgactagtcgtcgtacgtaccgtacggtggtacgaccgtacgacccggtaccgtacggaacgtacggtacgtcggtaggtaggtaagtaacggtaactcgttaccgtacgtagtaccgtagtaactaaacctaacgtaacgacgtaacgtaacggttacgtacgaggtactaacgtacgtacctaacgtacgtacgacgtactactactaaccaactaacgactacgtacgtacttgtagttacgtcgacgtctactatactacgtacgaggtacgtacgtacgtacttaagttagtacgttcgagtacgtagtacggtaggtacgttaccttaccgttaacgtccgtagttacggacggttaccggtaccgggtaaccgtaccggttaccgtacgg

SEQ ID NO: 186621 - DNA, 773 bp, Homo sapiens
  misc_feature: GYAE6OF02F0HK8.42.2.A02.1.454.CMB.1.raw
  modified_base (250)..(250): a, c, t, g, unknown or other
  misc_feature (250)..(250): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcaggtcgaggggtctgaggtgaagaagccgtgggtcctcggtgaagtctcctggcaaggtcttcgnggacggcctaccgttcgaagtacgaccgtaaatgactcgtacgtacccggtgggtcgaccggtaccgaccggggcccccgttagggtaaccgaagggtaaccttacggaggtacgggaggtaagggtaaaacgttcgttacccgttacccgttacggtaccggttaccgggtaaacttaaaaccgtaaaccgtaaccggtacctaacgaaacggttaacgttacggagggtactaagacggtaccaacctacgtaccgacgaccacgtacctaaccgaactaaacacgtacgttacctaacgtagttagttacgttacgtaggtaccggtctaccggtactacgttcgtacggtacggtaccgtccgggtaacttacgttaacgtttagtttacgtaggtaccgtagggaacggtacggggttaacgggtaaccgtttaaccggttacccggttacccgtacgttaccggttaacggttaccggttaccggggtaaccgggtacccggtacccggttaccggg

SEQ ID NO: 186622 - DNA, 602 bp, Homo sapiens
  misc_feature: GYAE6OF02FHM1H.42.2.A02.1.454.CMB.1.raw
  modified_base (223)..(223): a, c, t, g, unknown or other
  misc_feature (223)..(223): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggaggtgaagaagcctgggtcctggngaaggtctcctgcaaggcttcgtggaggccaccttcagtagcaatgtctcgtcaccgtgggtcgcgaccgacggccccgtggaccgaacggactcggagtaggagtagggaaatacgtctcccgtagtccgtacggaattaaaccgaacgtacgacacgaagtaagttcagggacagacgtcacagtaccgcgacacactaccaactaacacagtaccacattacgtagttgtagtcggctagactactgtacggtacgccgttacgtccgttaagtactttagttcgtgtacgtagaggacggtaacggggtacttaacgttaaccgtcccgtgttacgtaccgttaggttccgggaccgtacgggacccgttaccgg

SEQ ID NO: 186623 - DNA, 868 bp, Homo sapiens
  misc_feature: GYAE6OF02H29WE.42.2.A02.1.454.CMB.1.raw
  modified_base (150)..(151): a, c, t, g, unknown or other
  misc_feature (150)..(151): n is a, c, g, or t
  modified_base (176)..(176): a, c, t, g, unknown or other
  misc_feature (176)..(176): n is a, c, g, or t
  modified_base (601)..(601): a, c, t, g, unknown or other
  misc_feature (601)..(601): n is a, c, g, or t
tcagtgacgtatgtcacgaccggtgctcgatttagactcatctacagggggagcttcacataacgaccaccttctcctctaaagagcccctgggagcacagctcatcaccagtggactggacctggacgttcttctttgtcggtggcagnngctacgagtgtccagtcccgaggtncagcgtggtgacgagtcggagggctaggacggtgaagtacgcgtcgggtaccgtcggtagacggttcacgtcgacgtaagtccgttgacgggcgtaccttaccgttacaggtaccgtactacgttacgtccgttaggtaccccgttacggttacgggtcggaaccggtaccggacccggttcccccggaagggtaaccgtaaaccgggtccggttaacggtacggtaacggggttaagggttaaacggtaaaccgtttaccgtttacccgttaacccgtttaacgggttacgttaaaccggttaaacccgtttaaacccgtaaaaccgccgtaaaacctacgggtttaaacggttaacgtttaccggacgggttaaccaaacggttccgtaacctaaacccgtaacccgggttacggacccgtanaacccgtaccttacccgaaacgtaaaccgtattaaccgttacttaccgtttaagtttacggtaaggtttacggtaacggttccggtacgtaaccgtaccgtttaacgtaacgtccgggtaaacccgttccggttaacccggttacgttaaacgtttggtttaaaccgttcggttaagtaccggagtacggtacgggtacgttaaccgtttacgtaaccggtactccgtaacgtcgtttacgggacgtaccgtaccggtacgtaccgg

SEQ ID NO: 186624 - DNA, 689 bp, Homo sapiens
  misc_feature: GYAE6OF02IRN54.42.2.A02.1.454.CMB.1.raw
  modified_base (249)..(249): a, c, t, g, unknown or other
  misc_feature (249)..(249): n is a, c, g, or t
  modified_base (268)..(268): a, c, t, g, unknown or other
  misc_feature (268)..(268): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttcctctttgtggtggcagcagctacaggtgtccagtcccaggtgcagctggtgcagtcgaggggctggagggtagaagacgccgtgggtcctggtagaggtctcgtgcgaggcttcgnggacggctaccttcagtanacgaatgctgtcacgtgggtcgcgacgacggcccgtaggacgaacggacgtcggtaggtagggagtaagggaacttacgttcctacccgttacggtccttacggtaaactttaaacaaactaaccggactaacgaagtaacggtttacgagggtacaggaacgtacctaaccgtacgttaacccggacggaaccactacaccctaactaaacacacttactactagttgtaggttagagttacggtacctagacctgtacgtacggacgtaccggtaccggtaccgttatttaacgtttagttacggtgacggtacggaagggtacgggtaagggttacctttaaccgttaacccgtcccgtacgttacgtaaccggtttagggtaccggggacccgttacccgggtaacccgttaccggg

SEQ ID NO: 186625 - DNA, 828 bp, Homo sapiens
  misc_feature: GYAE6OF02JYXXM.42.2.A02.1.454.CMB.1.raw
tcagtgacgtatgtcacgaccggtgctcgatttagactcatctacagggggagcttcacataacgaccaccttcctcctctaaagaagcccctgggagcacagctcatcaccatggactggacctggaggttctctttgtggtggcagcagctacaggtgtccagtcccaggtgcagctggtgcagtcgaggggtctgaggtgaagtaacgccgtagggtcctcgggtagtaacggtcctccgtaggtacgtaacgggtccttacgtgggaacggctaaccgttcgaaggttagacctaaagtcggtaccttcggtaccaccggttagggtcgaccggtacgacccgggtacccctgggaacctaaacgggtcgttacggagggttagggaacgttacgggggaaaactttacgggtacccttaccggttacgtaccggttaccggtaaagtttaaaccgaaaaccgttccggaacctaaccggtaaaggttaacggtttcgaacggggactaaggtacgtacctaaccgtacgttacccgggacgtaacaccgtaccgttaacctaacgtaacctaacgtacgtacttaacctaggtttcgtaaagtcggtaacgttcggacctggaaccttgtaccggtacgtacggttaccgtaccggttaacgtttaacgttacgtttacgttacgggtacgggtaaccggtaggtaacgggtaaggggttaccggggtaaccttttaacggttaccccggttaccgtacggttacggttaacgtaacggggttttcccggggaaccggttacccgggggtaaccccttcgggg

SEQ ID NO: 186626 - DNA, 676 bp, Homo sapiens
  misc_feature: GYAE6OF02G8IIL.42.2.A02.1.454.CMB.1.raw
  modified_base (290)..(290): a, c, t, g, unknown or other
  misc_feature (290)..(290): n is a, c, g, or t
  modified_base (316)..(316): a, c, t, g, unknown or other
  misc_feature (316)..(316): n is a, c, g, or t
tcagtgacgtatgtcacgaccggtgctcgatttagactcatctacagggggagcttcacataacgaccaccttcctcctctaaagaagcccctgggagcacagctcatcacatggactggacctggagttctcttgtgtgcagcagctacgaggtgtccagtcccaggtgcagctggtgcagtcgagggctgaggtcgaagagccgtgggtcctcggtgaaggtcctccgtgacgaaggtccttgagggacggcctaccttgacgtagcaatgacctgtacaccgtggtncgacacggcccgtaggacaaggtacncgtagtggacgtagggtaactcgtcctaccgtagtcgtacggtaactaaaccgaacgtaccgacaaccgtaagtaacgtttacggaacgggtactaacggtaacgtacctaaccaacgtttaacccgacggaacctaaacgtaccaccctaaacgaaacgtactaacgtaccgtataagttacggagttacgtaagcgaacctagactcttacgtagacgtcgtaccgtcttaattacgttatacgtgaacggtaggagtaacggggtacggtacctttaaacgttaacccgtccggtaacttacgggtaaccgttacgggttacccggggtacccgtaaacgggtaccccgttaacggg

SEQ ID NO: 186627 - DNA, 764 bp, Homo sapiens
  misc_feature: GYAE6OF02GNRPL.42.2.A02.1.454.CMB.1.raw
  modified_base (123)..(123): a, c, t, g, unknown or other
  misc_feature (123)..(123): n is a, c, g, or t
  modified_base (143)..(143): a, c, t, g, unknown or other
  misc_feature (143)..(143): n is a, c, g, or t
  modified_base (592)..(592): a, c, t, g, unknown or other
  misc_feature (592)..(592): n is a, c, g, or t
  modified_base (600)..(600): a, c, t, g, unknown or other
  misc_feature (600)..(600): n is a, c, g, or t
  modified_base (719)..(719): a, c, t, g, unknown or other
  misc_feature (719)..(719): n is a, c, g, or t
tcagtgacgtatgtcacgaccggtgctcgatttagactcatctacagggggaagtctctctcagttcaggacacagcttggacagtgagggtccctgctcagctcctgggactcctgctgctntggctccagatccagactgngtacatccgagatcgaccctagtcctccttccgtcctgtctacgctactctggtaagggacacgtaagaacttcaccgtatacgtaaccgttcgggaccgggtacgtaggttcccaagggttaccgaagtttggggtaccgttaagttttttaaccggccgtttagggtaacttccgaagtaaaccccgtaaaaaccgttcggaactaaccgtacgttaccgttaaggtcccttaccgtactacgttacctttccgtagttccgtttactacgtttcgacctaaagttccggaaccgggttcctcttaccgtagttccgtacgacgggtacggtcgggttacgccgtacggtcgggtaactacggttaccttacgtccgttctaccgtaacgtacgttcaaccgacgttcacgttcggcacggactacggaatcgtagtaccgtaactntttaccgngtaaaccgtagttactaaccgttagtacgttaccctgttcccgtagttaccgggttaccgggaggggttaccgtaagggtttaacgggacgttaacgtaacccggaaacggttttaacncgggtttaacggtacctaaccgggaccttaccggttagtttcccg

SEQ ID NO: 186628 - DNA, 1087 bp, Homo sapiens
  misc_feature: GYAE6OF02GACEO.42.2.A02.1.454.CMB.1.raw
  modified_base (278)..(278): a, c, t, g, unknown or other
  misc_feature (278)..(278): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggaggttctctttggtggtggcagcagtctacaggtgtccagtcccaggtgcagcgtggtgacgagtcgagggctggaaggtacgaaggacggtcctcggggtccgtcggtaggtaacggttccgtaccgtacgacgtaacggtctttaccgngggacgcctacgttacgagtacgtactacgtcgtacgtcgtcgtacggtacggtcgtacgaccgtaccggtaccgacggtaacgaacggtacgtacggtaggtacggtaacggtaacggtaacgttaccgtccgtaccgtacgtacgtacgtaaactaaacgtacgtacgtacgtacgtaacgtacgtacgaggtaacgtacgtaacgtaccgtaaccgtaacgtaccgacgtaaccgtacctaacgtaaccgtaaccgtaaacgtaccgtaacgtaaccgttaaacgttacggttaacgggttaaccgtacggttaacgggttacccgttaaccggttacggtaaccgttaacccgggttaccggtaacccggggttaacccgggttaaccccggggtttaacccgggttaaaccccggtttttaaaggggttttttaaaacccgggttttaaacccggggggtttttaacccggggttaaaccccgggggtttaaaacccgggggtttaaaacgggggggttaaaaccccgggggggtttaaaaacccggggggggttttaaaacccccggggggttttaaaacccccggttttttaaaacccccccgggggttttaaaaacccccgggggttttaacccccgggggttttaaacccccgggggttttaaaaccggggttttaaacccccggggggtttttaaccccggggggggtttttaaaaacccccgggggggttaacccccccgggggtttaaaaaccccccgggggggttttaaccccccggggttttaaacccccggggg

SEQ ID NO: 186629 - DNA, 741 bp, Homo sapiens
  misc_feature: GYAE6OF02G7DWK.42.2.A02.1.454.CMB.1.raw
  modified_base (181)..(181): a, c, t, g, unknown or other
  misc_feature (181)..(181): n is a, c, g, or t
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
  modified_base (288)..(288): a, c, t, g, unknown or other
  misc_feature (288)..(288): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggagttctctttgtggtgcagcagctacaggtgtccagtcccaggtgcagctggtncgagtcgaggggtctggaggtgaagagccgtggtcctggngaggtctcctgcgagtcttcgnggacgctaccgttcagtagctaatcgctcgtccaccgtgggtacnccgtacgaccggtcccccgtaggaaccgtacggaaccgtccggtaaggagggtaacgtaagggtaaattacgttccgttacccggtagttccgtaacggtaaacttaaacgaaacccgtacgacaagtaacgttaacggttcgtaacgggactaggtaaccgtcaaccgtaacgttacccggacgaaccaccgtacctaaccaaactaacgaactacgtacctaaacgtagttaccggttaaagttggtaacggttcggtaaccgtacgtaaaccgttcgtacggttaacggtaccgggtacggtccgggtaacctttagtttaacgttacgttaagtacgaccgtaggggtacggttagggtaacgggttacttaaaccggtttaccacccgttagtaaccgttccgttaagggttcccggggtaccggtaacgggttacccttaacccggg

SEQ ID NO: 186630 - DNA, 705 bp, Homo sapiens
  misc_feature: GYAE6OF02I112F.42.2.A02.1.454.CMB.1.raw
  modified_base (128)..(128): a, c, t, g, unknown or other
  misc_feature (128)..(128): n is a, c, g, or t
  modified_base (233)..(233): a, c, t, g, unknown or other
  misc_feature (233)..(233): n is a, c, g, or t
  modified_base (279)..(279): a, c, t, g, unknown or other
  misc_feature (279)..(279): n is a, c, g, or t
tcagtgacgtatgtcacgaccggtgctcgatttagactcatctacagggggagcttcacataacgaccaccttcctcctctaaagaagcccctgggagcacagctcatcaccatggactggacctggnggttccttctttgtggtggcagcagctacaggtgtccagtcccaggtgcagctggtgcagtcgagggctgaggtagaagagccgtggtcctcggtgaacgtctcngcaggtcttcgtggagctacctcgagtacgactaatcgctcgtccncgtgggcgacgacacggcccgtggaacgaaggacgtacggaggtacggaagtagggtaaactacgtcctaccgtacggtcgtacggtaacttaaacgaaaccttacgacgtaagtaaggtaacgtttacgaagggtacctaacgtacgtaaccaaccgttaacggtacccggaccgaaacctaaccgaccttaacccgtaaccgtaaacctaaccgtacgttaccgttaaccgtagtttacggttaacgttgggtacgtacgggttactacgacgttatacgtaggtaaccggtacttacggttacgttatttaagtttagttacggtcgaggtaggtaggacgggtaacgggttacttaacgtttaaccgaccgttagttaacggtacggttacgtacggggtacccgacgggttaccgtaccgg

SEQ ID NO: 186631 - DNA, 777 bp, Homo sapiens
  misc_feature: GYAE6OF02IAZOU.42.2.A02.1.454.CMB.1.raw
  modified_base (101)..(101): a, c, t, g, unknown or other
  misc_feature (101)..(101): n is a, c, g, or t
  modified_base (161)..(161): a, c, t, g, unknown or other
  misc_feature (161)..(161): n is a, c, g, or t
  modified_base (234)..(234): a, c, t, g, unknown or other
  misc_feature (234)..(234): n is a, c, g, or t
  modified_base (471)..(471): a, c, t, g, unknown or other
  misc_feature (471)..(471): n is a, c, g, or t
  modified_base (553)..(553): a, c, t, g, unknown or other
  misc_feature (553)..(553): n is a, c, g, or t
  modified_base (561)..(561): a, c, t, g, unknown or other
  misc_feature (561)..(561): n is a, c, g, or t
  modified_base (617)..(617): a, c, t, g, unknown or other
  misc_feature (617)..(617): n is a, c, g, or t
  modified_base (667)..(667): a, c, t, g, unknown or other
  misc_feature (667)..(667): n is a, c, g, or t
tcagtgacgtatgtcacgaccggtgctcgatttagactcatctacagggggaagtctctctcagtcaggacacagcttggacatggacgggtccctgctcngcctcgtgggactcctgctgctgtgggctacccagataaccgagtagtgtcgaactaacnccgaagtctacggaccctagtccttcccgttcccgtaccctggtcttcgactaccttagtagggtaaccgggngtaaactacggaaaccttccaaccgtaactccgttaaccgggtccggtaccgggggtactaaggggtacccgtaaagggttcctaaggttacgggttacggttttaacgtttttaccgacggttaggttactaaccgaaacgtaaaccgtaaaaacccggttcggaaacctacggtaacccttacgtaacccggtcttaccttcgttaccttaccgttcctcgtcgtttaaccgttnttacgaaccttaagtccggtaaccggtcctcggttaacctccgtactacggcgggtacggtcgttgacgtcggtaatacgtntaccgttnacccgtcacctctaacgtcgacgactaccgacgttcaccgtaccgtagtaacggtntagttacggtaacgttcgtaactcgtaagtacgtattacggtacttcgtnttacgttcgtacgtaccggttacgggggtcggaccgggtaacggtgggtaaactaacggtagtaaccggtaagcggttaggacggtactaccgggtccttaactgtaccg

SEQ ID NO: 186632 - DNA, 857 bp, Homo sapiens
  misc_feature: GYAE6OF02FSVHC.42.2.A02.1.454.CMB.1.raw
  modified_base (172)..(172): a, c, t, g, unknown or other
  misc_feature (172)..(172): n is a, c, g, or t
  modified_base (278)..(278): a, c, t, g, unknown or other
  misc_feature (278)..(278): n is a, c, g, or t
tcagtgacgtatgtcacgaccggtgctcgatttagactcatctacagggggagcttcacataacgaccaccttcctcctctaaagaagcccctgggagcaacagctcatcaccatgactgacctggagttcctcttgtggtggcagcagctacaggtgtccagtcccaggtncagcgtgtgcagtcgagggctggacgtagtaagagccgtcgggttaccgtcggtagaacggttctccgtacgacgtacggtcgttcgacggacggcctacccgttnaaggtacgacctaagtcgtacgttacgtacctaccggttgggtccgaccggtaccgacggttcccgaggtaaccgaaacgggtccgtaccggtaaggtacggtagttaacgggtaaaacttccggtaccgttaccgtacggttaccgttaaccggtaaacgttaaaccgtaaacgtaccggtacgtaacgtaacgttaacggttacggaacggttgaaacgttcgtaacccgtaaccggtaaccgtaccgggtaccgaaacctaccgtaacgttaaccccgtaaccgttaaaccgacttaaccggtacttaacgtacttacggtaacggttacggtacgggttacgtaacccgttagaacgtaaccgttacggtaaccggtaccggtaaccggttaaccggttaaccccgttttaagtaacccgttttaggttacggttacgtacgggttaaacgaccgggtagggttaaaccgggttacctttaaccggtttaacccgtaccccggttaagttaccgggtaaccttttacgggggtaaccgggtacccgggttaaaccgggttacccgttaaccgggg

SEQ ID NO: 186633 - DNA, 925 bp, Homo sapiens
  misc_feature: GYAE6OF02I7H3B.42.2.A02.1.454.CMB.1.raw
  modified_base (168)..(168): a, c, t, g, unknown or other
  misc_feature (168)..(168): n is a, c, g, or t
  modified_base (291)..(291): a, c, t, g, unknown or other
  misc_feature (291)..(291): n is a, c, g, or t
tcagtgacgtatgtcacgaccggtgctcgatttagactcatctacagggggagcttcacataacgaccacccttcctcctctaaagaagcccctgggagcacagctcatcaccattggacgtggacctggaggttccttctttggtggttggcagcagcctacaggtntccagtcccgaggtgcagctggtgactaggtcacggggctagggagggtagaaaggacggtccggtcgggttcccgtgggtacgaacgggttccctccgtaggaccgtaacgggtcttccggnggacggtcctaccgttcgtaggtacggaccaagttcgcgtcgtaccgtaccggtaggggttaccgccggaacgtaccggttacccccggtaggtaaccaacgggtacggtaccgggtaacggtacggggtagggttaacgggtaaaacgttacggttccccgttaccccggttaacggttccccgtaacggtaaacctttaaaaccgtaaaccgtttaaccccggacctaaacggttaaccgggttaaccggttttaaccgggaacgggggtaacccgtaccgggtaaacgttacccctaaacccggttaaaccgttacccggtaaccgggaaccgtaccggtaaccctacccgtaaccttaaccggaacttacggttaacccgtaccgtaagttttaccggtaagtttaacgggtacggttccggtacccggttacgtacgttaactaccggttaggtaaccggtacggttacccggttaactacgtttaactttacggtttaccgacggttagtacggtaggaccggggttacgggtttaacttaccggtttaacccggtaccggtaggtttaccgtacgggtttaccggtttaaccggggaccgggttaacccgggtcccggttacccggg

SEQ ID NO: 186634 - DNA, 1074 bp, Homo sapiens
  misc_feature: GYAE6OF02G6OHF.42.2.A02.1.454.CMB.1.raw
tcagtgacgtatgtcacgaccggtgctcgatttagactcatctacagggggagcttcacataacgaccaccttcctcctctaaaagaagcccctgggagcacagctcatcaccatggactggacctggagttctctttgtgtggcagcagctacaggtgtccagtcccaggtgcagctaggtcgcagtcgaggggctaggaggtagaagaagccgttagggtcctgggtgaaggtcctacgtgacgaacggtcttacgtgggaggacctaccgttacgaagtaacggactaaagtcgacgttacgtacctaaccggtggggttacgaccggtaaccgtacccggggccccggttacgggaaaccgtaaacgggtaaccgttaccggtaaggggttacgggaaacgggtttaaaggggaaaacgtttaaccgggttacccttacccggttaacgtttaccggaaccggttaaaacttaaaacccgtaaaaccgtaaccgtaaccgtaaaccgtaaacggttaaacggttttaccggaaaacggggttaccaaacggggttaacccgttaacccgtaaaaccccgtaaccggggtttaaaccccggaaacccggggtaaacctaaaccccgtaaaccgttaaaccccgtaaacccgtaaaaacccgttaacgtaaaccgtttaccgttaaaacccgtttacgtttaaaccgggttaaggtttacgggttaaccgggttaccgggtaacccgttaaacggttaaccggaacgttttacccggtaaacgggttacccgggttaacccggtttaaccgggtttaacccgggttttaaattttaaacccgggtttttaacggtttaacggggtttaccggaaacgggggttaacgggtaaacggggttaaaccgggggttaaacgggggtttaaaccctttttaaaccgggttaaacccccggtttacccccggttaaacggtttaaccgggttaaacccgttttaaaccgggggggtttaacccggggggtaaaccccgggtttaacccggggggtaaacccccgttttaacccggggg

SEQ ID NO: 186635 - DNA, 782 bp, Homo sapiens
  misc_feature: GYAE6OF02GLY50.42.2.A02.1.454.CMB.1.raw
  modified_base (270)..(270): a, c, t, g, unknown or other
  misc_feature (270)..(270): n is a, c, g, or t
tcagtgacgtatgtcacgaccggtgctcgatttagactcatctacgagggggagcttcacataacgaccaccttcctcctctaaagaagcccctgggagcacagctcatcaccatggactggacctggaggttcctctttggtggtggcagcagctacaggtgtccacgtcccaggtcgcagctggtgcagtcgagggtctggaggtagaaagaaggtccgtgggtcctacgggtgtaacggttcctccgtgacgtaaggtccttacggnggacggtcctaccgtttacgtaaggtaagactaagtcgtacgttacgtaccgtaccggtggggttaccgaccggtaccggtaccgggtcccccgttagggaaccggtaacgggtaccgttaccgggaggttacgggtaaggttaaacggggttaaaacttccgggttacccgttaccccgttaaacgggttccgttaaccggttaaactttaaaccgaaaaccgtttaccgacgtaaacgtaacggtaaacggttttacggaacggggtactacggtaacgtaccctaaccgttaacgtacccggtacgaacctaacgtacctaaccaaacgtaacctacgtaacgttacctatacgttacgtagttcgtaacgtcgtactacgtactactcgtacggacgtcgtcgtacttagttattacgttagcggacgtaggagacgggtacggtactttacgtacccgtaccgtgtacgttacgttacggcgggtaacgtaccggtacccgttacgg

SEQ ID NO: 186636 - DNA, 769 bp, Homo sapiens
  misc_feature: GYAE6OF02HR13S.42.2.A02.1.454.CMB.1.raw
tcagtgacgtatgtcacgaccggtgctcgatttagactcatctacagggggagcttcacataacgaccaccttcctcctctaaaagaagcccctgggagcacagctcatcaccatggactggacctggaggttcctctttggtggtggcagcagctacgaggtgtccagtcccaggtgcagcgtggtgcaggtcgaggggctggaggtggaaagacgtccgtgggtcctacgggtagaacggttctccgtgcgtaaggtcctttacggtagggacggtcctaacccttttcgaacggttacggactaatcggaccgttgtcccgtaaccggttggggtacgaccggaaccgaccgggtcccccgtagggaaccgaacggtaaccgtcggaacggttcgggaaggtaagggtaaacgttaccgtaccgttaccgtacggtaccgtaacggttaaacttaaaaccgtaaaccgtacgaactaacggttaaagttacggttaacggacggtacgtaagaccgtaccaaccgtaaccgttaccggaacgacctactacgtaccaactaaccactacgtactacgtaagttacgttacgttgacggtccgcgtacgtactagttcggtaggaccgtacgtccggtacgtttaagttagtttacgtcggttaggcgtagggtaggacggggtaacggttacgttaacgttaacccgtcgtacgttacggttacgttacgggttaccgggtacccggtaaccgggttacctccggg

SEQ ID NO: 186637 - DNA, 809 bp, Homo sapiens
  misc_feature: GYAE6OF02I5WW7.42.2.A02.1.454.CMB.1.raw
  modified_base (169)..(169): a, c, t, g, unknown or other
  misc_feature (169)..(169): n is a, c, g, or t
  modified_base (184)..(184): a, c, t, g, unknown or other
  misc_feature (184)..(184): n is a, c, g, or t
  modified_base (728)..(728): a, c, t, g, unknown or other
  misc_feature (728)..(728): n is a, c, g, or t
  modified_base (738)..(738): a, c, t, g, unknown or other
  misc_feature (738)..(738): n is a, c, g, or t
tcagtgacgtatgtcacgaccggtgctcgatttagactcatctacagggggagcttcacataacgaccaaccttcctcctctaaagaagcccctgggacgcacagctcatcaccatggactggacctggacgttcctctttgtacggtggctagcacgcctacgaggtntccagtcccaggtcncagcgtggtacgcgtaagtcgagggtcgtaggaggtacgaacggaacggtccgtcggggttcctcggggttacgtaaacggttccttaccggtacggtacgtaaaccgggcgttttcggaacgggtacgggtaccccttacccgtttaaacggacggtaacggtaaccaaaggtttcgaccgttaccggtaccgttacccgggtacgggtaccggtaccgtaaccggacccggttacccggtaaggaaccgaacgggttaaccccgtggtaacggggaaccgggtaatacggggaaaagttcgggttaccttacccgtagggtttaccgtaacggtaaactttaaaccgggaactttaccgagaacctaagggttactacggacgggactacgtaacgttaaccgacgtaacgtccggacgtaccgtaactacctacgaactaacgactaacgtacctacgtcgtagtagttacgacgttcgactacgtacgtactgttaacgaggtaccgtacggtacttacgtttaccgttacttaacgggnttaccggganggaacggtaggtaacgttacgtaccgttacgtacttcggacttacgggacgtttaccgaccggtcgtacgg

SEQ ID NO: 186638 - DNA, 790 bp, Homo sapiens
  misc_feature: GYAE6OF02G3U24.42.2.A02.1.454.CMB.1.raw
  modified_base (620)..(620): a, c, t, g, unknown or other
  misc_feature (620)..(620): n is a, c, g, or t
tcagtgacgtatgtcacgaccggtgctcgatttagactcatctacagggggagcttcacataacgaccaccttcctcctctaaagaagccccgtgggagcacagctcatcaccatggactggacctggagttctctttgtggtggcagcagctacgaggtgtccagtcccaggtgcagctggtgctagtcgaggggctggaggtacgaaggaacgtccgtaggggtcctcgggtagtaacggttcctaccgtgacgtaacggttcttcgagggacggacctacctttacgaggtacgactaacgtcgcgttacgcccaccggttgggggtacaccggtacgacccgggtcccgtaggaaacgacggtaccgtaggacggttgggaagtaagggtaaacttcgtccgtaccccgtaagtccggtaacggtaaaacttaaaccgtaacgtcaaccgtaaacgaacggttaacgttaccggaggggtaacctaaggtaccggtaccaacccgtaacggttacccggaaccgaaccgtaaccgaaccttaacccgaacgttaaccaacgtaacttcgtaaaccgtgttaacggtgtttaccgggtacggttacgtacccgttanaaccggttagtccgttaacgggacggtccggttaccgggtacttaaggtttaactaggtttccgagggttccaagggaggtaagggtaacgggtaacttaccggtttaaccgcgttaacgtacgttaaccgttgggttaccgggaccggtaccggggttcccttaccggg

SEQ ID NO: 186639 - DNA, 496 bp, Homo sapiens
  misc_feature: GYAE6OF01BM2NP.22.87.H10.1.454.CMB.1.raw
  modified_base (444)..(444): a, c, t, g, unknown or other
  misc_feature (444)..(444): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcggggcatataatgatgtccactggtaccagcaacttccagaaacagcccccaaactcctcatctatggtaacaacaatcggccctcaggggtccctgaccgattctctggctccaagtctggcatgtcagcctccctggccatcactggctccaggctgagatgagctgattatttctgccagtcctatcgacaacncgcctgggtcgccgttggtcgttcgggcggaggaccagctgccgtcgtacgg

SEQ ID NO: 186640 - DNA, 385 bp, Homo sapiens
  misc_feature: GYAE6OF01ARKJL.22.87.H10.1.454.CMB.1.raw
  modified_base (380)..(385): a, c, t, g, unknown or other
  misc_feature (380)..(385): n is a, c, g, or t
tcagacatacgcgtcacgaccggtgctcgatttagcagtactgcgttgggtttggggcatataatgatgtccactggtaccagcaacttccagaaacagccccaaactcctcatctatggtaacaacaatcggccctcaggggtccctgaccgattctctggctccaagtctggcatgtcagcctccctggccatcactgggctccaggctgaggatgatgctgattattctgccagtcctatgacaacagcctgggtgccgtggtattcggcggagggaccaagctgaccgtcctaggtcagcccaaggctgccccctcggtcactctcgttcccgcctcctcacgcgtatgtctgagcgggctggcaaggcgcatagnnnnnn

SEQ ID NO: 186641 - DNA, 384 bp, Homo sapiens
  misc_feature: GYAE6OF01DL64Y.22.87.H10.1.454.CMB.1.raw
  modified_base (375)..(375): a, c, t, g, unknown or other
  misc_feature (375)..(375): n is a, c, g, or t
  modified_base (381)..(384): a, c, t, g, unknown or other
  misc_feature (381)..(384): n is a, c, g, or t
tcagacatacgcgtcacgaccggtgctcgatttagcagtactgcgttgggtttgggggcatataatgatgtccactggtaccagcaacttccagaaacagcccccaaactcctcatctatggtaacaacaatcggccctcaggggtccctgaccgattctctggctccaagtctggcatgtcagcctccctggccatcactgggctccaggctgaggatgaggctgatttattctgccagtcctatgacaacagcctgggtgccgtggtattcggcggagggaccaagctgaccgtcctaggtcagcccaaggctgccccctggtcactctgttcccaccctcctcacgcgtatgtctgagcggctggcaaggcncatagnnnn

SEQ ID NO: 186642 - DNA, 382 bp, Homo sapiens
  misc_feature: GYAE6OF01AC77N.22.87.H10.1.454.CMB.1.raw
  modified_base (377)..(382): a, c, t, g, unknown or other
  misc_feature (377)..(382): n is a, c, g, or t
tcagacatacgcgtcacgaccggtgctcgatttagcagtactgcgttgggtttgggggcatataatgatgtccactggtaccagcaacttccagaaacagccccaaactcctcatctatggtaacaacaatcggccctcaggggtccctgaccgattctctggctccaagtctggcatgtcagcctccctggccatcactgggctccaggctgaggatgaggctgattattactgctactcatatgcaggcggcaactcttgggtgttcggcggagggaccaagctgaccgtcctaggtcagcccaaggctgcccctggtcactctgttcccaccctcctcacgcgtatgtctgagcgggctggcaaggcgcatagnnnnnn

SEQ ID NO: 186643 - DNA, 509 bp, Homo sapiens
  misc_feature: GYAE6OF01DZX0T.22.87.H10.1.454.CMB.1.raw
tcagacatacgcgtcacgaccggtgctcgatttagcagtactgcgttgggtttgggggctttgcctgggctctgctcctcctcagcctcctcactcagggcacaggatcctgggctcagtctgccctgactcagcctcgctcagtgtccgggtcttctggacagtcagtcaccatctcctacactggaaccagcagtgatgttggtgttataactatgtctcctggtaccaacagcacccaggcaaagccccagactcatcatttatgctgtcaataagcggccctcaggggtccctgatcgcttctctggctccaagtctggcaacacggcctccctgaccatctctgggctccaggctgaagatgagctgattattactgctgctcatttgctaggccgtcctactacgttgggtgttcgggcggagggaccaagctcgaccgtccgtaggtcacgcccaaggcctcgcccctcggtccacgtctcgttcccgccctcctcgcgtcg

SEQ ID NO: 186644 - DNA, 385 bp, Homo sapiens
  misc_feature: GYAE6OF01AOAJH.22.87.H10.1.454.CMB.1.raw
  modified_base (373)..(385): a, c, t, g, unknown or other
  misc_feature (373)..(385): n is a, c, g, or t
tcagacatacgcgtcacgaccggtgctcgatttagcagtactgcgttgggtttggggcatataatgatgtccactggtaccagcaacttccagaaacagccccaaactcctcatctatggtaacaacaatcggccctcaggggtccctgaccgattctctggctccaagtctggcatgtcagcctccctggccatctctgggctccaggctgaagatgaggctgattattactgctgctcatttgcaggcgcctacacttgggtgttcggcgagggaccaagctgaccgtctaggtcagcccaaggctgcccctggtcactctgttcccacctcctcacgcgtatgtctgagcgggctggcaaggcgcatagnnnnnnnnnnnnn

SEQ ID NO: 186645 - DNA, 510 bp, Homo sapiens
  misc_feature: GYAE6OF01ED39M.22.87.H10.1.454.CMB.1.raw
  modified_base (307)..(307): a, c, t, g, unknown or other
  misc_feature (307)..(307): n is a, c, g, or t
  modified_base (357)..(357): a, c, t, g, unknown or other
  misc_feature (357)..(357): n is a, c, g, or t
  modified_base (450)..(450): a, c, t, g, unknown or other
  misc_feature (450)..(450): n is a, c, g, or t
  modified_base (477)..(477): a, c, t, g, unknown or other
  misc_feature (477)..(477): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcggggcatataatgatgtccactggtaccagcaacttccaagaaacagcccccaaactccncatctataggtacaacaatcggccctcgacggggtcccctgaccgattcnctggctccaagtctggcatgtcagcctccctggcccatcactgggctccaggctgagatgagctgattattcgtgcctagtcctatgacaacngcctgggtcgccgttggtacttcgggnggtacgggaccaagctcggacccgtctaccggg

SEQ ID NO: 186646 - DNA, 538 bp, Homo sapiens
  misc_feature: GYAE6OF01AOMMH.22.87.H10.1.454.CMB.1.raw
  modified_base (435)..(435): a, c, t, g, unknown or other
  misc_feature (435)..(435): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatcgtcggggccccaggacagaaggtcaccatctcctgcactggtacaactccaacagtcggggcatataatgatgtccactggtaccagcaacttccagaaaccacgacccccaaactcctacatctataggtaacaacaactcggccctcgacggggtccctagaccgtattctctggcctccaagtctggctatcgtcacgtccctcctcggcctatccacgtcggcctccgaggctggaggntgaggctgtatttacttcgtgtcctagtcctatcgacaacgtcgcgtgggtcgtccgttggtcgttcgggacggacggtaccgagcgtcgaccgtcgtacggg

SEQ ID NO: 186647 - DNA, 591 bp, Homo sapiens
  misc_feature: GYAE6OF01DVSRI.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatcgtggggccccaggacagaagtcaccatctcctgcacgtggtacaactccaacagtcggggacatataatgatgtccacgtggtaccagcaacttccaagaaaccacgacccccaaactcctacactactataggtaaaccaaacaatccggaccctacgacggggttcccctacggaccgtacttcgtcgtggacctaccgaagtcgtggctatcgtccacgtccctaccccgtggaccctatccacgtcgggcctccgacggcgtggaggagtaggagcttagtaatttacgtttcctagtacctagttcctagtcgaaccaacgcgccgttcgggtcgtccggttcggtacgttcgggacgggacggaccacggcgttacggcccgttcgtaccggg

SEQ ID NO: 186648 - DNA, 520 bp, Homo sapiens
  misc_feature: GYAE6OF01C0SXJ.22.87.H10.1.454.CMB.1.raw
  modified_base (424)..(424): a, c, t, g, unknown or other
  misc_feature (424)..(424): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcggggcatataatgatgtccactggtaccagcaacttccagaaacacgcccccaaatcctacatctatgtaacaacaatccgcctcagggtccctgaccgattctctggctccaagtctggcatgtcagcctacctgccatcacgtggcctccgagctgagatgagctgattatttcngaccagtccctatgaactaacgcgacctgggtcgcccgttggtacgtttccgggacggacgggaacctaagccgtcggtaacccgtcgttaacggg

SEQ ID NO: 186649 - DNA, 626 bp, Homo sapiens
  misc_feature: GYAE6OF01EEFKW.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacaggtcctgggcccagtctatgctgacacagccgccctcaatatctgggccccaggacagaaggtcaccatctcctgcactgggtacaactccaacatcgggcatataatgatgtccactggtaccagcaacttccaagaaaccacgacccccaaactcctcatctatgtaaacaacaatcgacctcgacggggtccctgaccgtattctcgtggctccgaagtctggctatgtacacgtccctacctggccctatccacgtggcctacccgaggccttgaggataggaggtctaggtaatttactttcgtcgtaccctaagttcccgtaagttacggaaacctaaaccgtacgtacccggttggggttccggttacccggttacgggttaacggttcccggggaccgggggtaaaccggggtaaacccctaacggggaccccgtttacgggtaacccccggttccggttaaacccgggg

SEQ ID NO: 186650 - DNA, 555 bp, Homo sapiens
  misc_feature: GYAE6OF01CBH3Y.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcggggcatataatgatgtccactggtaccagcaacttccagaaaccacgcccccaaactcctcatctatggtaacaacaactccggccctcgacggggtccctgacccgtattctctcggcctccgaagtctggcagtcgtcacgccctcccgtggcccatccgacgtcgggcctccgagggtcctggaggattggagggtctagtatttacgttcgtcgcctagttccctatcgacaacgcgtccgtgggtcgtccggttaggtcttcgggcggacgggaccaaggtccgtacggcccgtccgtacgg

SEQ ID NO: 186651 - DNA, 390 bp, Homo sapiens
  misc_feature: GYAE6OF01BV0JO.22.87.H10.1.454.CMB.1.raw
  modified_base (275)..(275): a, c, t, g, unknown or other
  misc_feature (275)..(275): n is a, c, g, or t
  modified_base (382)..(390): a, c, t, g, unknown or other
  misc_feature (382)..(390): n is a, c, g, or t
tcagacatacgcgtcacgaccggtgctcgatttagcagtactgcgttgggtttgggggcatataatgatgtccactggtaccagcaacttccagaaacagcccccaaactcctcatctatggtaacaacaatcggccctcaggggtcctgaccgattctctggctccaagtctggcatgtcagcctccctggccatcactgggctccaggctgaggatgaggctgattatttctgccagtcctatgacaacagcctgggtgccgtggtattcggnggaggaccagctgaccgtctaggtcacgcccgaaggctcgcccctggtcactctcgttccccgccctcctcacgcgtatgtctgagcgggctgggcaaggcgcatgnnnnnnnnn

SEQ ID NO: 186652 - DNA, 545 bp, Homo sapiens
  misc_feature: GYAE6OF01A6YTJ.22.87.H10.1.454.CMB.1.raw
tcagacatacgcgtcacgaccggtgctcgatttagcagtactgcgttgggtttggggcttcagctgtgggcacaagaggcagcactcaggacaatctccagcatggcctggtctcctctcctcctcactctcctcgctcactgcacagggtcctgggcccagtctgtgctgacacagccgccctcaatatctgggccccaggacagaagtcaccatctcctgcactgggtacaactccaacatcggggcatataatgatgtccactggtaccagcaacttccagaaaccacgacccccaaactccctacactctataggtaacaacaactcggccctacgacggggtccctagaccgtacttctctggctaccaagtctggctatgtcagtcctcctggtcactcactggctccgaggctgaggtatgagtctagtattacgttctcgtacctagtcctatcgactaacgacgtccgtgggtcgcccggtaggttcgttcgggcgggacgggtaccgaaggccgtacggtacccgtcgtaacggg

SEQ ID NO: 186653 - DNA, 614 bp, Homo sapiens
  misc_feature: GYAE6OF01AG4YO.22.87.H10.1.454.CMB.1.raw
  modified_base (579)..(579): a, c, t, g, unknown or other
  misc_feature (579)..(579): n is a, c, g, or t
  modified_base (582)..(584): a, c, t, g, unknown or other
  misc_feature (582)..(584): n is a, c, g, or t
  modified_base (586)..(587): a, c, t, g, unknown or other
  misc_feature (586)..(587): n is a, c, g, or t
  modified_base (589)..(614): a, c, t, g, unknown or other
  misc_feature (589)..(614): n is a, c, g, or t
tcagacatacgcgtcacgaccggtgctcgatttagcagtactgcgttgggtttgggggcgatataatgatgtccactggtaccagcaacttccagaaacagccccaaactcctcatctatgtaacaacaatccggcctcagggtccctgaccgattctctgctccaagtctggcatgtcagcctcctggccatcactgggctccaggctgaggatggaggctgatttattctgccagttccctatgacaaacgtcgaccttggggtcgcccggttgggttaactttccggggcgggtaacggggacccctaaaggggtccttacgggaaccccgggtttcccgttaacggggttccgaacgggccccgaaaggggtccttccggtccccccccggttgggtacccgaaccgttttcccgttccgggtttacccccaacccccggtttccctttcccgaaacccgggttccgtttaacgttcccggtttcctacgggtaacccgggtccgggggtcgttacccggggcttaaaaccgggggcccgaccgtaacggttacggcgtacgctcgtgcaaagcncgnnncnncnnnnnnnnnnnnnnnnnnnnnnnnnn

SEQ ID NO: 186654 - DNA, 391 bp, Homo sapiens
  misc_feature: GYAE6OF01A5UKW.22.87.H10.1.454.CMB.1.raw
  modified_base (385)..(391): a, c, t, g, unknown or other
  misc_feature (385)..(391): n is a, c, g, or t
tcagacatacgcgtcacgaccggtgctcgatttagcagtactgcgttgggtttgggggcatataatgatgtccactggtaccagcaacttccagaaacagcccccaaactcctcatctatggtaacaacaatcggccctcaggggtccctgaccgattctctggctccaagtctggcatgtcagcctccctggccatcactgggctccaggctgaggatgaggctgattatttctgccagtcctatgacaacagcctgggtgccgtggtattcggcggagggaccaagctgaccgtctaggtcagcccaaggctcgcccctcggtcactctcgttcccgccctcctcatcacgtgtactgacgcgggctggcaaggcgacatagnnnnnnn

SEQ ID NO: 186655 - DNA, 546 bp, Homo sapiens
  misc_feature: GYAE6OF01B1KD3.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcggggcatataatgatgtccactggtaccagcaacttccagaaacacgcccccaaactcctcactctatggtaacaacaatccggccctcgacggggtccctgaccgattctctggctccaagtctggcatgtcagcctcccgtggcccatcactggctccgaggctgaggatgacggtctgtatttactttcgtcgcctagttcctatcgaacaacgacgtccgttggggtcgtcccggttagggtacgttccggggacggacgggtaccaggccgtcggtacccggttccgtaccggg

SEQ ID NO: 186656 - DNA, 644 bp, Homo sapiens
  misc_feature: GYAE6OF01CUF43.22.87.H10.1.454.CMB.1.raw
  modified_base (361)..(361): a, c, t, g, unknown or other
  misc_feature (361)..(361): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatcgtcgggccccaggacagaaggtcaccatctcctgcacgtgggtacaactccaacatcggggcatataatgatgtcactggtaccagcaacttcagaaacacgaccccaaactcctcatctaatggtaacaacaatccgccctacgacggggtccctagaccgtattccnctcggcctaccgaagtctgggcagtcgtaccacgtccctccccgtggccctaagtccgaaccgtcgggacccttaccgacgggtcctaggacggtagtcggacggtcttacggtaattttacttttccgacgtacccttaagttccccttaagtccgtaaaccgtaaccgtacggtacccggttggggtaccgtccgggttagggtttaccggttaccgggaccggggtacgggtaaacccgaaggtcccgttaggtaacccccggttccggttaaaccgggg

SEQ ID NO: 186657 - DNA, 674 bp, Homo sapiens
  misc_feature: GYAE6OF01CAWZ7.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatcgtggggccccaggacagaaggtcaccatcctcctgcacgtgggtacaactccaacagtcgggcataataatgatcgtccactcggtaccagacaaccttaccaacgaaaccacgacccccaaactcctacactctaatacggtaaacaaacaatccggccctacgacggggtccctacgtaccgtattctcgtgcctaccgtaagtccgtgacattcgtcacgtccctccgtcggcccatccacgtgggccctccgaacggtctaggacggtagtacgggtaggcgttagtaacttttacgtttaccgtacgtacccgttaacggttacccttaagtaccgaaacctaaccgacggttcccgggtaggggttccggtaccgggttagggttaacccgggttccgggggtaaccggggtaacggggtaacccctaaacgggtccgttaacccgggtaccccgggttcccggttaaacccgggg

SEQ ID NO: 186658 - DNA, 550 bp, Homo sapiens
  misc_feature: GYAE6OF01EE1JD.22.87.H10.1.454.CMB.1.raw
  modified_base (447)..(447): a, c, t, g, unknown or other
  misc_feature (447)..(447): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcggggcatataatgatgtccactggtaccagcaacttccaagaaaccacgacccccaaactcctcactctaatacggtaaacaacaactccggccctcgacggggtccctgaccgtattctctgctaccaagtctggctatcgtcacgccctccgtcggcccatcacgtcggctccgagcgtgagagtgagtctgtatttnttcgtgtcctagttcctatcgacaactcggtccgttgggtcgtccggttaggtacgttccgggacgggaacggaccgtaagccgtcggtcccgtccgtacggg

SEQ ID NO: 186659 - DNA, 527 bp, Homo sapiens
  misc_feature: GYAE6OF01B1PI4.22.87.H10.1.454.CMB.1.raw
  modified_base (430)..(430): a, c, t, g, unknown or other
  misc_feature (430)..(430): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagcccgccctcaatatcgtggggccccaggacagaaggtccaccatctcctgcacgtggtacaactccaacatcggggcatataatgatgtccactggtaccagcaacttccagaaacacgacccccaaactcctacatctaataggtaacaacaatccggccctcgacggggtcccctgacccgattcctctggctaccaagtctggcatgtcacgcctccctggcccatcactcggcctccgaggctgaggntgagctgattattctgcctagtcctatgaaccagcgtccgtgggtcgtcggttggtgtccgggacggacgggaccaagctacggcccgtcgtaacgg

SEQ ID NO: 186660 - DNA, 603 bp, Homo sapiens
  misc_feature: GYAE6OF01D1XI4.22.87.H10.1.454.CMB.1.raw
  modified_base (418)..(418): a, c, t, g, unknown or other
  misc_feature (418)..(418): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacacgcccgccctcaatatcgtcggggccccaggacagaaggtcaccatctcctgcacgtgggtacaacctccaacacgtcgggcagtataatgatcgtaccacgtcggtaccacgacctaacttaccgaacgaaaccaccgacccccaaactcctacactctatacgtaacaacaagtccgacctacgacgggtccctagaccgtattcctcgtcgtctaccgaagtctgactatctcgtacnccctaccgtcgacccataccacgtcggaccttccgaggtcctaggagtacgtaggaggtctagttaatttaccgtttcgtacgtacctagtcctagtaccgaactacgtacgtccgttcgggtcgtaccggttggtacggttccgggagggaccggtacgacgcgtacggtcccgtcgtaaccgg

SEQ ID NO: 186661 - DNA, 385 bp, Homo sapiens
  misc_feature: GYAE6OF01AYLHN.22.87.H10.1.454.CMB.1.raw
  modified_base (261)..(261): a, c, t, g, unknown or other
  misc_feature (261)..(261): n is a, c, g, or t
  modified_base (373)..(373): a, c, t, g, unknown or other
  misc_feature (373)..(373): n is a, c, g, or t
  modified_base (379)..(385): a, c, t, g, unknown or other
  misc_feature (379)..(385): n is a, c, g, or t
tcagacatacgcgtcacgaccggtgctcgatttagcagtactgcgttgggtttgggggcatataatgatgtccactggtaccagcaacttccagaaacagccccaaactcctcatctatggtaacaacaatcggccctcaggggtccctgaccgattctctggctccaagtctggcatgtcagcctccctggccatcactgggctccaggctgaggatgaggctgattatttctgccagtcctatgacaacagcctgggtnccgtggtattcggcggagggaccaagctgaccgtctaggtcagcccaaggctcgccccctggtcactctcgttcccacctcctcacgcgtatgtctgagcggctggcaggcncatagnnnnnnn

SEQ ID NO: 186662 - DNA, 646 bp, Homo sapiens
  misc_feature: GYAE6OF01EJB9C.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagcccgccctcaatatcgtcgggccccaggacagaaggtcaccatctcctgcactggtacaactccaacatcgggcatataatgatgtccactgtaccagcaacttccaagaaaccacgacccccaaactcctcatctataggtaaaccaactaacgtccgaccctacgacgggtccctacgaccgtattcctctcgggtcctaccgtaacgtcgtacggctaacgttgtaccacgtccctcccgtcggccctagtccgacgtcgggtcctcccgaaggcctaggaggtacgtaggacggtacttagtaacttttacgtttcgtacggtacccttacgttacctagttacgaacctaacgtacggtacccgttaggggtccggtccggttacgggttaccggttccggggaacggggaacgggtaacccgaacggtcccgtaccggtaacccggttcccgtaaaccgggg

SEQ ID NO: 186663 - DNA, 631 bp, Homo sapiens
  misc_feature: GYAE6OF01B7TGW.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatcgtggggccccaggacagaaggtcaccatctctgcacgtgggtacaactccaacagtcggggcatataatgatgtcactggtaccagactaacttccgagaaaccacgacccccaaaactcctacatctataggtaaaccaacaattccggaccctcgacggggtccctagaccgtattctctcggtcctaccaagttcctggcatcgtacacgccctacccgtcggacctactccaacgtcggcctccgaaggcgtaggaggagtggaacgggtcttagtattttacttacgtcgaccgttaacttcctagtacggaaaccaacgtccggtccggttcggggtccgtcccgggttaggttacggtttcccgggggacgggaacggggtaacccgaacgggtacccgttaccgggtaaccccgttcccggttaaaccggg

SEQ ID NO: 186664 - DNA, 615 bp, Homo sapiens
  misc_feature: GYAE6OF01D6CAW.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatactcgtcgggccccaggacagaacggtcaccatcctcctgcacgtcgggtaacaactccaacagtcgggacataataatgatcgtccacgtcggtacagactaacttacaacgaaaccacgacccccaaactcctacactactatacgtaaacaacaacgtccgaccctacgaccgggtccctacgaccgtattacctcgtacgtactaccgtaagtcgtcgactagtcgtacaccgtcccgtacccgtcgacctacgtccgtacgtccgggtacctaccgacggtcgaggtacggtagtacggaggtacttaggtatttacgtttcgtacgccttagtaccctagtacgaacacgtcgaccggttgggtacgtcggttaggtcgtcggggacggacggaaccacggctacggtccgtcgtaacgg

SEQ ID NO: 186665 - DNA, 598 bp, Homo sapiens
  misc_feature: GYAE6OF01B7Z30.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcgggcatataatgatgtcactggtaccagcaacttccagaaacacgaccccaaactcctacatctatgtaaacaacaatccggaccctcgaggggtccctagacccgattctctcggctaccaagtctggacctatcgtcacgcctcccgtggccactcaaccgttgggcctccgaggtcctggaacggataggacgctgtaatttagtttctacgccctagttccctaatacggaaccaaacgtaccggtacgttcggggtacgtaccgggttagggttacgtttacccggggacgggacgggtaacccgaacggtacggttaccggtacccggttcccggttaaaccggg

SEQ ID NO: 186666 - DNA, 414 bp, Homo sapiens
  misc_feature: GYAE6OF01BXP7O.22.87.H10.1.454.CMB.1.raw
  modified_base (257)..(257): a, c, t, g, unknown or other
  misc_feature (257)..(257): n is a, c, g, or t
  modified_base (264)..(264): a, c, t, g, unknown or other
  misc_feature (264)..(264): n is a, c, g, or t
  modified_base (272)..(272): a, c, t, g, unknown or other
  misc_feature (272)..(272): n is a, c, g, or t
  modified_base (387)..(387): a, c, t, g, unknown or other
  misc_feature (387)..(387): n is a, c, g, or t
  modified_base (407)..(414): a, c, t, g, unknown or other
  misc_feature (407)..(414): n is a, c, g, or t
tcagacatacgcgtcacgaccggtgctcgatttagcagtactgcgttgggtttggggcatataatgatgtccactggtaccagcaacttccaagaaacacgccccaaactcctcatctatggtaacaacaatccggccctcgaggggtccctgaccgattcctcgtggcctccaagtctggcatgtcagccctccctggccatcacgtgggcctccgaggctgaggatggaggctagatttattctgccagtcctangacaacngccgtggngcgtgtatcggcggaggacctaagctcgaccgtctaggtcacgcccaaggcctcgcccctgtccacgttctacgttcccaccttcctcacgtcgtatcgtctggacgtcggtcgnggccaaggtcgactagtagnnnnnnnn

SEQ ID NO: 186667 - DNA, 393 bp, Homo sapiens
  misc_feature: GYAE6OF01CY8V3.22.87.H10.1.454.CMB.1.raw
  modified_base (381)..(381): a, c, t, g, unknown or other
  misc_feature (381)..(381): n is a, c, g, or t
  modified_base (388)..(393): a, c, t, g, unknown or other
  misc_feature (388)..(393): n is a, c, g, or t
tcagacatacgcgtcacgaccggtgctcgatttagcagtactgcgttgggtttgggggcatataatgatgtccactggtaccagcaacttccagaaacagcccccaaactcctcatctatggtaacaacaatcggccctcaggggtccctgaccgattctctggctccaagtctggcatgtcagcctccctggcccatcactgggctccaggctgagatgagctgattatttctgccagtcctatgaacaaacagcctggggtgccgtggtattcggcggagggaccaagctgaccgtctaggtcagcccaaggcctgccccctggtccactctcgttccccgcctcctcacgcgtatgtctgacgcgggctggcaaggcncagtagnnnnnn

SEQ ID NO: 186668 - DNA, 577 bp, Homo sapiens
  misc_feature: GYAE6OF01AJXII.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaggtcaccatctcctgcactgggtacaactccaacatcggggcatataatgatgtccactggtaccagccaacttccagaacacgcccccaaactcctcatctatagtaacaacaatccggccctcgacggggtccctgaccgtattctcgtggctccaagtctggcatgtcacgccctcccgtcggcccagtccacgtcgggcctccgagggctggaggtagtggacggtcttagtactttacgtttccgtcgtacctacgttcctacgtacgaacctaacgacggtccgtggggttcgccggtttgggtacgttccggggacgggacgggaccctaaggcccgtacggtcccggttccgttaacggg

SEQ ID NO: 186669 - DNA, 586 bp, Homo sapiens
  misc_feature: GYAE6OF01CK5KO.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctcggggccccaggacagaaggtcaccatctcctgcactgggtacaactccaacatcggggcatataatgatgtccactggtaccagcaaccttccagaaacacgacccccaaactcctcatctatagtaacaacaactccgccctacgacgggtccctgaccgtattctctcggctccaagtctggcatcgtcacgtccctccccgtcggccctactccgacgtcgggcctccgaggtccgtaggaggtactggaggtcgttagtatttacgtttccgtacgtcctacgttaccctagtacgaacaaccgtacggtccgttgggtcgtccggttaggttcggttccgggacgggtacgggacccgaggtccgtacggtacccgttccgtacggg

SEQ ID NO: 186670 - DNA, 701 bp, Homo sapiens
  misc_feature: GYAE6OF01CJLZX.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacacgcccgccctacaatatcgtcggggccccaggacaggaacggtcacatcctcctgcacgtggtacaacaccaacacgtcgggcataatatgatcgtccactggtaccagcctaactccaacgaaacaccgacccccaaactcctcaactactagtacggtaaacaactacaccggtccctacggtacgggtccctacgaccgtacttcctaccgtcgcctaccgaagtcgtggctagtcgtcacgtcccctccgtcgaccctacgtaccgtacgtcgggtccctaccgtacggtcctagggacggtcgttacgggacgtaccggttaggttacttttaacgtttccgttacgtacccgttaacgttcccgttaataccggaaccgtaaacgtaccggtccgggttaacgggggtccgtaccggggtttacgggttacgggttaccgggggtaccggggtaaaccgggtaacccggtaacgtcccgggtttaaccgggtaccccggttcccgggttaaacccggg

SEQ ID NO: 186671 - DNA, 702 bp, Homo sapiens
  misc_feature: GYAE6OF01DHU09.22.87.H10.1.454.CMB.1.raw
  modified_base (554)..(554): a, c, t, g, unknown or other
  misc_feature (554)..(554): n is a, c, g, or t
  modified_base (608)..(608): a, c, t, g, unknown or other
  misc_feature (608)..(608): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacgacggtccgtcggcctagtctgtcgctgaccacgacgccctccctacaatacgtcggtccgggacccgaaggacaaggaacggtccaacctactcctcctcgacctacgtacgggtaacctaacctaaccaaacctacgggtaccggggactaattaaataagtgacttcggtaccctacgttacggtaacccacgtacctaaaccttaccgaaacgaaaacctacccgaaccccctaaacctccctactacttactagtaacgtaaaaccaactaacgtccggtccctacggtaccgggtccctagtactcgtcttctcgcgtcctacgtacgtcgtacgaccaaccgcccgtccctccgtacgaccttcgtcgcgtcctaccgcgtcgtaggagagtcggacgtntagttaacttacgttacgtcgtacgtacgtcttacgtagtacggtagggaccgngtacggaccgtaacgtttagggtttcgggtacgggttcgggacggggtaacggaaccgtacgtccgtaccggtacccgtccggttcgaacccgg

SEQ ID NO: 186672 - DNA, 598 bp, Homo sapiens
  misc_feature: GYAE6OF01AP1WH.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctgggccccaggacagaaggtcaccatctcctgcactgggtacaactccaacatcggggcatataatgatgtccactggtaccagcaacttccagaaaccacgcccccaaactcctcatctataggtaaacaacaactccggaccctcgacggggtccctgaccgtattcctctcggcctaccgaagtccgtggctagttcgtccacgccccttcccgtcggacccatccgacgtcgggaccctccgaggccgtaggaggtatggacggtcgtagtactttacttcgtcgtacctacgtcctagtacgaaccaacgtacggtccgttaggggtccgtaccggttagggttacgttccggggacgggacgggtacccaagtccgtacggtaccccgttcgtaaccggg

SEQ ID NO: 186673 - DNA, 602 bp, Homo sapiens
  misc_feature: GYAE6OF01DC4QR.22.87.H10.1.454.CMB.1.raw
  modified_base (248)..(248): a, c, t, g, unknown or other
  misc_feature (248)..(248): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacacgcccgccctcaatatctcggggccccaggacagaaggtccaccatctcctgcactgggtacactccaacngtcggggcatataatgatgtccactggtaccagcaaccttcacgaacacgacccccaactcctcatctaatacggtaacaacatccggccctacgacggggtccctcgaccgtactttcctcgtcgccttaccaacgttctggctatcgtcacgtccctcccgtcggccctagtccacgtcgggtcctccgacggtcgtggaggtacgttcgggagtcgtagtaatttacgtttcgtcgtccgtacgttaccctagtacgtaacctaaccgacgttcccggtggggtccgtccggttggttacggtccgggacgggtacggaccaaggtccgtacggacccgttcgtaaccggg

SEQ ID NO: 186674 - DNA, 578 bp, Homo sapiens
  misc_feature: GYAE6OF01BXYFD.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactggtacaactccaacatcggggcatataatgatgtccactggtaccagcaacttccagaaacacgcccccaaactcctcatctatggtaacaacaatcgccctcacgggtccctgaccgattctctcggctccaagtctggcatgtcacgccctcccgtggcccactcacgtgggcctccgaggcctggaggatggagcgtgtatttactttctcgtcctacgtcctacgtacgaccaaccgtacgtcccggttggggtcgtcccgggttagggttacgttccggggaccggggaacggggtaccccgaagggtacccgttaccggacccggttcccggttaaaccgggg

SEQ ID NO: 186675 - DNA, 808 bp, Homo sapiens
  misc_feature: GYAE6OF01D3JWC.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagcccgccctcaatatcgtcggggccccaggacagaaggtcaccatctcctgcactgggtacaactccaacagtcggggcatataatgatgtccatggtaccagcaacttcaagaaaccacgacccccaaactcctacatctatagtaaacaacaactccgccctcgacggggtccctagacctattcctcgtcggctaccctaagtccgtggctaacgttcgtacctacggtccccttccccgtacgggtcccctacgtaccgaccggttcgggtccccgttacccggacgggtaccgttagggaaacgggtagttacggggtacggggtactttacggttaacgtttttaacgttttcccgtacggttaccccgttaaaccggtttaccccttaagttaccggtaaaacctaaaacccggtaaacccgggttccccgggtttaagggggggtttaccccgggttacccggggggttttaagggttttaaccccgggggtttaccccgggggggtaaacccgggggggtaaaacccgggggttaaacccccgggtaaaaccggggttacccccggttttaaaccggggtaaaccccccccggggttttaccggttaaaacccccggggggg

SEQ ID NO: 186676 - DNA, 809 bp, Homo sapiens
  misc_feature: GYAE6OF01DCBS8.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacgagggtcctgggcccagtctgtgctgacacacgcccgccctcaatactcgtcggggccccaggacagaacggtccaccatcctcctgcacgtgggtacactaccaacagtccggggacataataatgatcgtccacgtcggtaccagtaccaaccttaccgaacgaaaaccaccgacccccctaaaactccctactaactacctaatacggtaaaaccaaacaacgtccggacccctacggtaccggggtccctgtaacttccggtccttccgtcgtcgggtacctaccgttaaacgttccgtacggtacccgaaaccgtcccggtaccccttaccccgtacggtacccgttccgttccgtccggggtcctacccggtacgggtaccgtacgggtaacggtacttacggggtaacggtcgttaacgggtttaattttaccgttacgttacggtaccgtacggtaccttaacgttaagttacgggttacgggtaaccggacgtaaacgtaaccgggtaaaccgttttaaacgggttttcgggggttaccggggtttacccgggggaaccggggttaaacccgggaaccccggttaaaacgggttcccgggttaacccggggttaaaccccgggtttcccggttaacggggttaaacccccggg

SEQ ID NO: 186677 - DNA, 775 bp, Homo sapiens
  misc_feature: GYAE6OF01ECL32.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatgcctggtctcctctcctctcactctcctcgctcactgcacagggtcctgggcccagtctgtgctgacacacgccgccctcaatatcgtcgggccccaggacagaaggtcacatctcctgcacgtacggtacaactccaacagtcggggcatataatgatgtaccacgtggtaccagacaaccttaccaagaaaccacgacccccaaactccctacacttactaatacggtaaacaaacgtaacgtccggaccctacggtaccggggtccctacggtaacccgtactttaccgtccgttacgggtacccttacccgtaaacggttccgtacggtacctaagttcgtaccgtaaccgttcccccttaccccgtagggtaacccctacgttacccgtacggtttacccgggacccgttaccggacgggtaccgtttacgggaacgggtacggttacggaacgggttacgttaggtttaaacttttaccgttttcgtaccggtacccgttaacgttacccgttaacgtaccggaaacctaaacggtacccggttccgggttaccggggttacggtaccggggttacgggtttacggttacccgggggaccgggaaaccggggacccgtaaacggtcccggttaaccgggttacccgttaccgggtaaacccggg

SEQ ID NO: 186678 - DNA, 613 bp, Homo sapiens
  misc_feature: GYAE6OF01EJ1N8.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagcccgccctcaatatcgtcgggccccaggacagaacggtcaccatctcctgcacgtggtacaactccaacagtcggggcatactaatgatcgtccacgtcggtaccagactaaccttaccaagtaaaccacgacccccaaactcctactactctaatacggtaaacaacaacgtccgtccctacggacggggtccctacgtaccttacttcctcgtcggtacctaccgtaacggtccgtaggactacgttcgtacgaccgtcccttcccgtcggtaccctacgtccgtacggtcggcctcgacggtcgtaggacggtagtcggacggcttagttatttacgttcgtcgtacctacgtcctatacgaacacgtacggtcgtcgggtcgtcggttaggtcgtcgggacgggacgacacgtcgtcgtaccgtcgtacgg

SEQ ID NO: 186679 - DNA, 625 bp, Homo sapiens
  misc_feature: GYAE6OF01CVTZF.22.87.H10.1.454.CMB.1.raw
  modified_base (417)..(417): a, c, t, g, unknown or other
  misc_feature (417)..(417): n is a, c, g, or t
  modified_base (429)..(429): a, c, t, g, unknown or other
  misc_feature (429)..(429): n is a, c, g, or t
  modified_base (472)..(472): a, c, t, g, unknown or other
  misc_feature (472)..(472): n is a, c, g, or t
tcagacatacgcgtcacgaccggtgctcgatttagcagtactgcgttgggtttgggggcttcagctgtgggcacaagaggcagcactcaggacaatctccagcatgcctggtctcctctcctcctcactctcctcgctcactgcacagggtcctgggcccagtctgtgctgacacacgcccgccctcaaatagtccgtcggggccccccaaggaccaaggaacggtccaacccatcctccctgccaccgtgggtaaccaacctaccaaacacgtcggggacatataatgatgtccatcgtaccagcaaccttaccagaaaccacgacccccaaactcctcactctaatcgtaaacaacaacgtccgccctacgacgggtccctacgacccgtattcctctcggcctaccgaagttcnggctattcgtcncgtcctccgtcgccactcacgtcggctccgaggctggaggtancgagtctagtactttagttctcgcctacgttctacttacggaacctaacgtaccgccggtggggtacgtccgggttaggttaacgggtcccggggtacgggaaaccgggtacccgaacggtcccgtaaccggtcccggttcggtaaacccggg

SEQ ID NO: 186680 - DNA, 685 bp, Homo sapiens
  misc_feature: GYAE6OF01DE04Y.22.87.H10.1.454.CMB.1.raw
  modified_base (164)..(164): a, c, t, g, unknown or other
  misc_feature (164)..(164): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacgagggtcctcgggcccngtctgtgctgacacacgcccgccctacaatactcgtcggggcccccaggaccaggaacggtcaccatcctccgtgcacgtcggtaacactaccaacgagtcgggacatataatgatcgtacacgtcgacagctaactcaacgaacaccgaccccaactccactatactaagtacgtaaacactaacgtccggccctaacggtaccgggtccctacgaccgttacttcctacgtcgtacccttaccggaagttccgtaggtactacgttacgtaccgaccgtcccgtccccgttcgaccctaatccgtaccgtccggtacctccggacggtcgtacggaaggttcgtagggacgttacgttaacgttatttacgtttccgacggtaccctagtttaccctagtaaccgtaccgaaacgtccgggtaccggttcggtacggtccgggtttacgtccggggttaccggacggggtaaacccgttaccggagttcccggttaaccggtaccgttcggtaaccggg

SEQ ID NO: 186681 - DNA, 1165 bp, Homo sapiens
  misc_feature: GYAE6OF01DU90B.22.87.H10.1.454.CMB.1.raw
  modified_base (225)..(225): a, c, t, g, unknown or other
  misc_feature (225)..(225): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcacagttctgtgctgacacacgccgccctcaatactcgtcgggcccaggacagaagtcacatctctncacgtggacaactccaacagtcgggactatataatgatcgtaccacgtacgtaccagtacaacttaccaacgtaaaccaccgaaccccctaaactccctacgtaacttacgttacgtaacggtaaaacctaaacgtaaaccgttacccggtaccccgttaaccgggtaacccgggggttacccccgttaacggtaaaccccggttaaaccgttttacccgtttcccgtttaccggggtacccctttaaaccccggttaaccgggtttacccggttaccggggtacccgtttaaacgtttcccgggtttaacccgtaacccccgggttccccccgttttaccccccgggttaaccccgggtacccccgtttaaacggttacccccggtttaaacccggggtttaccccggggttaacccccggttaacccccgggttaaaaccggggggttccccggtttttaacggggggaaaaacccgggggtttaaccggggttttaaacgggggtaaaccccggggttttacccgggtttttaaaacgggggttttttaaaacccttttttttttaaaccccggggttttttccccgggttaacccccggggtttaaaccccccgtttttaaaaccccggggttttttaacccccgttaaaaacccgggtttaaccccggttaaaaaccccggttaaaacccccggggttaaaacccggggtttccccggggtttttaccccgggggggttttaacccggggtttaaccccggggggtttttaaacccgggggttttaaccggggggttttaacccccgggggggtaaaacccgggggggttaaaaccccgggggttaaaacccccggtttaaaacccgggggtttacccccccggttttaaccccggggtttaaaaccccccgggggtttttaaaacccccggggg

SEQ ID NO: 186682 - DNA, 457 bp, Homo sapiens
  misc_feature: GYAE6OF01DY1M5.22.87.H10.1.454.CMB.1.raw
  modified_base (234)..(234): a, c, t, g, unknown or other
  misc_feature (234)..(234): n is a, c, g, or t
  modified_base (443)..(457): a, c, t, g, unknown or other
  misc_feature (443)..(457): n is a, c, g, or t
tcagacatacgcgtcacgaccggtgctcgatttagcagtactgcgttgggtttgggggcatataatgatgtccactggtaccagcaacttccagaaacagccccaaactcctcatctatggtaacaacaatcggccctcaggggtcccctgaccgattctctggctccaagtctggcatgtcagcctccctggccatcactgggctccaggctgagatgaggctgtattattcngcctagtcctatagaacaacgacgccgtggggtcgtccggttaggtacgttcgggacgggacgggaaccaagcgtacggaccgtacgtacggtcaacggcccgaagggcctcccggcccccgtcggtaccaccttccgttccgtcccctaccctccgtcaccgtctagtcgtcgtggacggtcggcgtgggacgacggtcacaacgtgnnnnnnnnnnnnnnn

SEQ ID NO: 186683 - DNA, 593 bp, Homo sapiens
  misc_feature: GYAE6OF01AS1A3.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacacgcccgccctcaatactcgtcggggccccaggacagaaggtcaccatctcctgcactggtacaactccaacagtcgggacatataatgatcgtccacgtggtaccacgactaaccttaccaacgaaaccaccgaccccaaactcctacatctatacgtaaacaacaacgtccggaccctcgacgggtccctcgaaccgtcttccgtcgtcggcctaccgtaaggttcgtcggctagtcgtcaccgtccctcccgtggccctatccacgtcggcctccgacggcgtagaggagtggacggtcttagttaatttcgttcgtcgacctagttacctatacgactaacgcgtccggtggtccgtcggttggttacgtcggggacggacggaccgtacggaccgtacgcccgttcgtacgg

SEQ ID NO: 186684 - DNA, 742 bp, Homo sapiens
  misc_feature: GYAE6OF01EKVAX.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatcgtcggggccccaggaccagaacggtcaccatctcctgcacgtggtacaactccaacagtcgggcaatataatgatcgtccactggtaccagcaaccttccaagaaaccacgaccccaaactcctacatctatagtaaacaactactccgcctacgacggggtccctacgaccgtattccgtcgtcggtcctaccgtaacgttccgtagggacctacgttcgtacctaccggtcccctacccgttcgggacccctaacgtccgtaaccggtcgggtacccttacccggaacgggtcccgtagggtaacgggtacgttcgggaacggtacgtttaggttaaacttttaccgtttacgtaccgtacccgttacgttacccgttagtaccggtaaacctaaaccgtccgggtaacccgggtttcgggggtaccggttacccggggtttacgggtttaaccgggtacccggggtaacccggggtaacccggggtaacccgaaacgggttccccggttaacccggggtaaccccggttacccgggtaaacccgggg

SEQ ID NO: 186685 - DNA, 735 bp, Homo sapiens
  misc_feature: GYAE6OF01C5MCE.22.87.H10.1.454.CMB.1.raw
  modified_base (247)..(247): a, c, t, g, unknown or other
  misc_feature (247)..(247): n is a, c, g, or t
  modified_base (507)..(507): a, c, t, g, unknown or other
  misc_feature (507)..(507): n is a, c, g, or t
tcagacatacgcgtcacgaccggtgctcgatttagcagtactgcggttgggtttggggggcttcagctgtgggcacaagagggcagcactcaggacaatctccagcatcggcctcggtctcctctcctctcactctcctcgctcactgcacgacgggtcctcgggccagtctcgtcgctacgacacacgccgtcctacaatacgtcggtcggggcccaggacaaggtacggaccaactactctccgngtacctacgtacggtaactaactaccaacgtacggtcgggactaagtaataacgtacgactcgtacctactacggtacctacgtacctaacttaccgaaacgtaaaccacccgtaaccctaaacttcccgtaactacgttacgtaacgtaacgtaaacaactaacgtccgtaccgtaccggtaaccgggtccctacggtacctacttccgtcgtacgtctaaccgtaacggtcgtacggacctaaccgcccggttacccncctacgaccttacgtcgtacgtcggtacctacggacgtacgtaagaacgtagtacggtacggtcttaacgttaacgtttacttaaccggtcgtacgtacgttactacggttacttacggacgtcgggtacctaccgttacggttcggttccggggtagggttaccgggacgggtaaccggacgtacggtacgtacggttacccggtccggtaacgtcggtaaacccgg

SEQ ID NO: 186686 - DNA, 737 bp, Homo sapiens
  misc_feature: GYAE6OF01C3WHS.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatgcctggtctcctctcctctcactctcctcgctcactgcacagggtcctggggcccagtctgtgctgacacacgccgccctcaatatccgtcggggccccaggacaaggaaggtccaccaagtcctcctcgccacgtgggtaccaactaccaactagtcggggacagtaataatgaatgtacccacgtcggtaaccagacaaccttccaacgaaccaccgaccccaaactcctacactactatacggtaacaactaactccggcctcggacgggttcccacgtaccgtacttccgtcgtcggtctaccgtaacgtcgtggtactactcggtcacgtccccgttcctcgggtaccctactccgtacggttccgggacccttacccggaacgggtccgtaggtaacgggtacgtacgggtacggtacggtttacttaacgttttaacgttttccggtaccgtaccggttaaccgtttacccggttattaacgggtaaaccccaaacggttaaccggtcccgggttagggggttacccgtacccgggttttagggttaaccgggtttacccggggaccgggaacgggtaaccgtaaacggtccgtttaaccgggacccggttcccggtaaaccggg

SEQ ID NO: 186687 - DNA, 850 bp, Homo sapiens
  misc_feature: GYAE6OF01B4BBN.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctctcactctcctcgctcactgcacgagggtcctcgggcccagtctgtgctagacacgacgccgccctacaatactcgtcggggccccaggacaggaacggtccaaccatcctccgtgaccgtacgtacgggtaaccaacctaccaaacgacggttccggggactaattaagttaaagtcgtaacttccgtaccgtaccgttacggaaccaacggtacctaaaccttaccaaacgaaacccgacccaccccctaaacgtcctactaactacgtaactacggtaaacaaccaacggtccccgaccgttacggtaccgggtaccctacggtaacccgtacgttccgtcgtaccggtacccgttaccgtaaacggttccgtacggtacctaagttccggtaccaccggtcccctacccggtacggaccctaacgtaccggtaccggttcgggaccctaccgggtacggtaccggttagggaacggtacggttaggggtaccggttacgtttacgtttaaacggtttttccgtttaccgtaccggggttaccctttaacggttaacccgttaacggtaacccgtaaaacgtacccggttaaccgggtccgggtttacggggacccggttacggggttaaccgggttacgggtacccgggggaaccggggttaaaccgggtaacccgtaacgggttacccggttacccggtaccggtacccgggtaaacccggg

SEQ ID NO: 186688 - DNA, 856 bp, Homo sapiens
  misc_feature: GYAE6OF01C0J58.22.87.H10.1.454.CMB.1.raw
  modified_base (199)..(199): a, c, t, g, unknown or other
  misc_feature (199)..(199): n is a, c, g, or t
  modified_base (589)..(589): a, c, t, g, unknown or other
  misc_feature (589)..(589): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctctcactctcctcgctcactgcacgcggtccgtcgggcccagtctgtcgctacgacacgacgcccgccctacaatcncggtcgggaccccaggacaaggacggtccacctactcctctcgcctacgtacgggtaaccaacctaccaaacgtacggtacggggactaagttaaacttaacgtagtaacgttccgtaccgtaaccgtttacggaaaccctacgtaacctaaaccctttaaccggaaaaccggtaaaacccaacccggtaaacccccctaaaccttaccgtaaccttaacttaacccgttaaattaaccgggtaaaaccaaaaccgtaaccggttaccccgggtacccgttaaccgggtacccgggggtttaacccctaacggtaaccgtttacgtttccgttaccggttaccggtaccctacgtaaacggttcgttcgggaccttacggtcgtaacccnccgttacccgtcccgacggtacccctacgtccgtaaccggttcggaccttcggaacggtccgtagggtaggtacgttaccgggagttaccgtttaagtttaacttttaccggttcgtaccggtaaccgttacgttaccgtaagttaccgaccgtaaacgggtcggtcccggttagggtaccgttacgggttacgggttaccggtaccggggtaaccggacggtacccggtaaccgtcggttacccggtaaccggtttccggaaccgg

SEQ ID NO: 186689 - DNA, 660 bp, Homo sapiens
  misc_feature: GYAE6OF01AF94X.22.87.H10.1.454.CMB.1.raw
  modified_base (413)..(413): a, c, t, g, unknown or other
  misc_feature (413)..(413): n is a, c, g, or t
  modified_base (429)..(429): a, c, t, g, unknown or other
  misc_feature (429)..(429): n is a, c, g, or t
tcagacatacgcgtcacgaccggtgctcgatttagcagtactgcgttgggtttgggggcgttcagctgtgggcacaagaggcagcactcaggacaatctccagcatggcctggtctcctctcctcctcactctcctcgctcactgcacacgggtcctcgggcccagtcgtgtcggcttacggacacgacgcccgccctacaagtactcgtcggggacccaggacagacggtccaccactctcctgccacgtcgggtaacacctaccgaactacgtcgggacacttagtaactgtacttacgtccacgtcggtaccaacgtcctaaccgttaccgaacgtaaaccaccgacccccgtaaatcctacctagttctaagtacgtaacaacacgtccgtcccgtagaccgggtaccncgtaccgtactttacnccgtacgcctacgtaacgtccgtacgtctagtcgtaccctacggtcccttcccgggacgtcccctaattcccgaacggttcggccttacgacggcgtaggacgtcgtacggacgtgtaccgttattaccgttcctacgccgtaactccgtataaccggctaaccgtcgtacgtcgggtcgcgttacgggtctcggaggtaggaactcggtacacggtaccgtgtaaccggg

SEQ ID NO: 186690 - DNA, 675 bp, Homo sapiens
  misc_feature: GYAE6OF01ESAT8.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatcgtcggggccccaggacagaaggtcaccatctcctgcactgggtacaactaccaacagtcgggcatataatgatgtcctactggtaccagctaaccttccaagaaaccacgacccccaaactcctacacgtactacgtacggtaaacaacaactccgaccctcgacgggtccctagaccgtacttcgtcgcgtcctacgaacgtcgtagctagtcgacctacgtccccgtccgtcgggccctagtcccgtacggtccggtccgtacccgacgggtaccgtgggacgggtacgtacggtacgggtacttacggttaacttttacgttccgtaccgtaccgtaaggttccctagtacgtaaccctaagtaccggtccggttacggggtccggttaccgggttaagggttccggttcggggaaccgggaacggggttaacccgaacggtaccgttacccgggtacccggttaacccggttaccgggg

SEQ ID NO: 186691 - DNA, 560 bp, Homo sapiens
  misc_feature: GYAE6OF01CIT5G.22.87.H10.1.454.CMB.1.raw
  modified_base (450)..(450): a, c, t, g, unknown or other
  misc_feature (450)..(450): n is a, c, g, or t
tcagacatacgcgtcacgaccggtgctcgatttagcagtactgcgttagggtttgggggcttcagctgtgggcacaagaggcagcactcaggacaatctccagcatggcctggtctcctctcctcctcactctcctcgctcactgcacagggtcctgggcccagtctgtgctgacacagcccgccctcaatatcgtcggggccccaggacagaaggtcaccatcctcctgcacgtgggtacaactccaacatcggggcatataactgatgtccacgtggtaccagcaacttccagaacacgaccccaactcctcatctatacggtaacaacaatccggcctacgacggggtccctagacccgtattcctctcggctaccaagtcgtcggctagtgtccacgtccctaccgtcggcctatcacgtcggcctccgagctgagtatggagtcngtatttacgttctgcctacgttcctagtataccgaactcggtccgtaggggtcgtcggtagggttcgtcgggacgggtacgtaccgacgcgttacgccggtcgtaacggg

SEQ ID NO: 186692 - DNA, 832 bp, Homo sapiens
  misc_feature: GYAE6OF01BYONS.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacaggtcctggcccagtctgtgctgacacagcccgccctcaatatcgtcgggccccaggacagaacggtcaccgatctcctgcacgtggtacaactccaacacgtcggggacatataagtgatcgtaccacgtcgtaccaggacctaaccttccaacgtaaaaccacgtaccccccaaactccctacacttacctaagttacggtaaaccaaccgtaaacgtcccggtacccctaccggtaccggggttaccccctacggtaacccggtactttcccgtaccgttacggggtacccttacccgtaaacggttccgtacgggtacccgtaagtttaccggtaccgtaaccgggtcccccctttacccccggtcggggttaacccccctaacgtttacccgtaacgggtttcccggggtacccttacccggacggggtcccgttagggaaccgggtaacgtacggggtaccgtacgttacggttaatttttacccgtttccgtacggtaccccgtacggtttaacccgtaacgtaccgtaaacccggaaccgtaccggttaccccgggtttggggtacccggttcccggggttaagggttacccggttcccggggaaacggggtaacccgggtaacccggtaaccggtaccgtcccgggttaaaccccggttcccggttaaacccgggg

SEQ ID NO: 186693 - DNA, 753 bp, Homo sapiens
  misc_feature: GYAE6OF01CDBFY.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagcccgccctcaatatcgtcgggccccaggacagaaggtcaccatctcctgcactgggtacaactccaacagtcggggcataataatgatgtccactggtaccagcaaccttccaacgaaacaccgaccccaaactcctcactctatacggtaaacaacaacgtccggaccctcggtacggggtaccctcggaccgtacttcctcgtcggacctaccgtaaacgttccgtacgggtacctacgttcgtaccgtaacccggtccccgttacccccggttcgggccccttaacgtcccgttaacccggttccggggtaccctaccccggtaacgggtcccgttagggtaacggtacgtacgggaacgggttcccgttaaggtttaacttttaaccgtttttccgtaccgttacccgttaacggtttaccctacgttaacgaaaccctaaaccgtaccggtccgggttacggggttaccgggtccgggtttacgggttaccggtttccgggggaacgggtaacccggggaacccgtaacgggtaccgttacccgggtaccccgtttacgggtaacccggg

SEQ ID NO: 186694 - DNA, 704 bp, Homo sapiens
  misc_feature: GYAE6OF01C9499.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacacgggtcctgggcccagtctgtgctgacacagcccgccctacaatatcgtccggggccccaaggacaggaacggtcaaccactcctcctgccacgtacgggtacaacctaccaaacgacgtacggggacaattataatgactcgtaccacgtacggtaccacgaccgtaaccttaccgaacgaaaccacccgaacccccaactcctacaactactaagtacggaaaacctaacgaacgtccgcctaccgggtacggtacccgtaccgtactacttcctacgtcggtccttaccaacgttcgtcgacgtacgtcgtacccgaccgtccctcccgtacggccctaacgtccgtaaccggtcgggaccctcggacgggtctaggtaggtacgtacgggcgtacgttagttaactttccgtttacgtacgccttacgttacttacacgtaaaccgtaacgcggttccggtacggggtaccggtcggttacgggttacgggtacggggtacccgggaacgggtaaccgacggtccgtttaaccggcccgttacgtaaccggg

SEQ ID NO: 186695 - DNA, 773 bp, Homo sapiens
  misc_feature: GYAE6OF01CXM5V.22.87.H10.1.454.CMB.1.raw
  modified_base (172)..(172): a, c, t, g, unknown or other
  misc_feature (172)..(172): n is a, c, g, or t
  modified_base (205)..(205): a, c, t, g, unknown or other
  misc_feature (205)..(205): n is a, c, g, or t
  modified_base (317)..(317): a, c, t, g, unknown or other
  misc_feature (317)..(317): n is a, c, g, or t
  modified_base (395)..(395): a, c, t, g, unknown or other
  misc_feature (395)..(395): n is a, c, g, or t
tcagacatacgcgtcacgaccggtgctcgatttagcagtactgcggttgggtttgggggcttcagctgtgggcacaagaggcagcactcaggacaatctccagcatggcctggtcctcctctcctcctcactcctcctcgctcgactcgctacgacgggtcctcgggacccngtctggtcgctacgacacacgcccgtaccctanaactcgtccggtcgggaccccaaggaacgtaacggaacggtaccaaacctactcctccgtacgtaccgtaacgttaccgggtaacaacctaccgaacggtacggaccgggtntaataagtaagtcggtattccgtaacctacggttacggaacctacggtaacctaaccgttaaccgaaacgtaaaaccncccaaaccccgtaactcccgtaataacttaacgtacgttaaaccggaaactaacaccggtccgtaaccgtccggtaaccggtctacgtaccggttatccgtaggtccgtacacggtatacgtcgacgaacgttcgaccgttaccggtcctaaccgggtcgtacctacgtaccgtacgtaccgggtacttacccggacggtaccgtaggaacggtcgggtacgtacgggtacttaagtaactttcgtaccggtctaacgtcgttaacgtacacggtaacaggtaaccggtacgtccgggtggttacgggacccggtttaggtaccgggtaccgggaacggtaaccggaacgtacccgggattcccggccggttaaacgg

SEQ ID NO: 186696 - DNA, 854 bp, Homo sapiens
  misc_feature: GYAE6OF01BD7S8.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacgacgggtcctcgggcccagtctgtgctgacacacgcccgccctacaaattatccgtccgggggacccccaagggaaccaaggaaaccggtccaacccgtacttccctacccgtcgacccgtaacggtttacggggtaaacccaaaccttaccccgaaaaccgtaacggttacccggggggactaaacgttaaacttaaaagttaggtaacgttaccggttaccccgtaaccgttacgggtaaccccgtaacggtacccttaaaacccgtttaacccgaaaccggtaaaaaccaaccccggtaaccccccctaaaccttccctaccgtaactaccttaacggttacggtaaaacctaaacctaaaccgttcccggaccccgtaccgggtaccgggggtacccgttacgtaccgtccgttaccgtttcctaccggtacggtacccttaccgtaacggttccgtacgggtacccgaccgtacccggtccccttacccgtccgtacccgttcgtaccggtcggaccgtccggtacggtacgtagggtacggtagtcggtacgtcgttagttaactttcgttaacgtcgtcgtacgtcttacgtagttcgacggtacgtccgtaccgttacgtacgggtttggtaccgggttacgggacgggtaaccggacgtaccgtcggtacgtaaccggtccttacggccgtaacccgg

SEQ ID NO: 186697 - DNA, 746 bp, Homo sapiens
  misc_feature: GYAE6OF01C8UCZ.22.87.H10.1.454.CMB.1.raw
tcagacatacgcgtcacgaccggtgctcgatttagcagtactgcgttgggtttgggggcttcagctgtggggcacaagaggcagcactcaggacaatctccagcatggcctggtctcctctcctctcactctcctcgtctcactgcacgagggtcctcgggcccagtctgtgctgacacacgccccgccctacaattacgtcgtccggggcccccaagggaacaaggaacggtccaaccacttcctcctgctacgtacgggtaccaacctccaaacacgtccgggggactaataagtaacgtgaacttcgtaccacgttaggaccaagactaaccttaccgaacgaaaccacccgaacccctaacctccactacttactaatacggtaaacaaccgtaactccggtaccctaccggtacggggtcccctacgacccgtagtttccgtcgtacggtcccgtaacgaacgttcggtacgacttacgtacgtaccgtacccgtccccgttccgtacggcccttaacgtccgtaccgtcgggttccctaccggtcgggtacgtcgggaagggtctagggacgttacgtgttaacttttacgtttccgtacggttaccacggtttacctacgttacgaaaccgaaccgtacgtccgggttacgggtaccgtcgggtttaggttcggtacccggggaccggggtaaccgggaccttaacggcccgtaacggtacccggttcgttaaaccggg

SEQ ID NO: 186698 - DNA, 685 bp, Homo sapiens
  misc_feature: GYAE6OF01E2HNQ.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagcccgccctcaatatcgtcgggccccaggacagaaggtcaccatcctcctgcacgtgggtaaccaactccaacagtcggggcatataatgatgtaccactcggtaccagactaacttccaagaaaccaccgacccccaaactccctacactctaatacggtaaacaacaacgtccggtaccctcggtacgggtccccgtacgaccgtaactttccgtccgtcggtaccctaccgtaaacggtccgtacggactaagttcgtacctaccggaccccttccccgtcggaccctacgttaccgaaccgtcgggtacccgtacccgtaacgggtcgtaacgggaggtacgtcggacgggtcgttagtttaactttcgtttccgtacgtacccgtacgttccgttaacgtacggaacaccgtacgtccgttcgggtcgttccggttacgggttcggtaccggggacgggaacgggtaaccacggtaccgccggtacccggtccgttaaccggg

SEQ ID NO: 186699 - DNA, 717 bp, Homo sapiens
  misc_feature: GYAE6OF01EAH2G.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacacgccgccctcaatactcgtcggggcccaggacagaacggtcaccatctcctgcacgtggtaaccactaccaacacgtcgggactataataatgatcgtccacgtacggtaccagactaacttaccgaacgaaaccaccgaccccaactcctactactactagtacgtaaaccaacgtacgtccggacccgtaccggtaccgggtaccctacggaccgttacttccgtcgtcggtaccttaccgtaacgtcgtcggtactagttcgtccaccgtcccctccgtacggtccctacgtccgtacgtcgggaccctacggtacggtccgtaggtaacgggtacgtacgggtacgtacgttgtttaaccttttacgtttccgtacgtacccgttaacgttaccgttagtaaccgtaaaccgtaaccgtacgggtcccgggttacggggtcccggttacgggtttacgggttacgggttaccggggtacgggaaacgggtacccgaacgggttccggttaccggtacccggttccggttaaccggg

SEQ ID NO: 186700 - DNA, 738 bp, Homo sapiens
  misc_feature: GYAE6OF01DJAKH.22.87.H10.1.454.CMB.1.raw
  modified_base (192)..(192): a, c, t, g, unknown or other
  misc_feature (192)..(192): n is a, c, g, or t
  modified_base (239)..(239): a, c, t, g, unknown or other
  misc_feature (239)..(239): n is a, c, g, or t
  modified_base (602)..(602): a, c, t, g, unknown or other
  misc_feature (602)..(602): n is a, c, g, or t
tcagacatacgcgtcacgaccggtgctcgatttagcagtactgcgttgggtttgggggcttcagctgtgggcacaagaggcagcactcaggacaatctccagcatgcctggtctcctctcctcctcactctcctcgctcactgcacgacgggtcctcgggcccagtctgtgctgacacgacgcccgccctanaatactccgtcggggccccaggacaggaaggtccaccatcctccgtncgtacgtcgggaaccacctaccaacagtcgggacatataatgatcgtaccagtcggtaccagtacctaaccttacgaacgtaaaccaccgaccccctaaactccctactactactaacgtacgaaaactaaccgaacgtccggtcccgtacggtaccgggtaccctacgaccgtattccgtcgtacggcctacgaacgtcgtcggacttagcgtacgaccgtaccctccgtacgccctaacgtccgtacgtcgggtaccctacccggtacggtaccgtagggaacggtcgtacggtacgtaccttaggttaacttttacgtttcgtacgtaccgtacgttaccgttacgacgtaaaccgtacnccgggttaccggttgggtacccggttaccgggtttacggggtttaaaccggtcccgggggtaacgggggaacccggtaaaccggtaaacccgggtcccggttaaacccgggtcccggttacccggtaaacccgggg

SEQ ID NO: 186701 - DNA, 770 bp, Homo sapiens
  misc_feature: GYAE6OF01EDT5E.22.87.H10.1.454.CMB.1.raw
  modified_base (255)..(255): a, c, t, g, unknown or other
  misc_feature (255)..(255): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacacgcccgccctacaatatcgtcggggccccaggacagaacggtcaccatcctcctgcacgtagggtacaacctccaacncgtcgggacatactaatgatcgtaccacgtcggtaccagacctaaccttaccgaagaaaccaccgacccccaaacgttcctactactactaagtacggtaaaccaacaacgtccggccctacggtacggggtccctacgaccgtacgtttcctcgtcggtaccctaccgtaaacggttccgtaggtactagttcgtacctacccggtccccttccccggtcgggtacccctaacgttcccgaccggtcgggtccctaccggtacggcgtttaagggaacggtacgtagggtaccggtagttacgttaacttttacgtttccgtacgtacccgttacgttccgttaacgttacgaaaccgtaacggtaccggttaccgggtttcggggttccggttacccgggtttagggttttccggggtaaccccggggggtaagggggaaccccggggttaaacgtaaccgggtacccgggtttaaccggtacccccggggtttacgtttaaaccccgggggg

SEQ ID NO: 186702 - DNA, 795 bp, Homo sapiens
  misc_feature: GYAE6OF01BMIDE.22.87.H10.1.454.CMB.1.raw
  modified_base (565)..(565): a, c, t, g, unknown or other
  misc_feature (565)..(565): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactcctcctcgctcactgcacgagggtcctgggcccagtctgtcgctagacacacgcccgccctacaattactccggtcggggaccccaaggtacgaaggtaacggtccaacctacttccctacctcggaccgacggttacggggtaacctaaaccgtaccctaaacgtacgggtaccggggtacctaaattaacgtaaagttcgtaacttccggtaccctaacggttaccgggtaaccaacgtacccgtaaaccttaccccgaaaagtaaaccccgtacccgaacccccttaaactccctactacttaccttaagtacggtaaaaccaaccgtaacgtccggcccgtacggtacccgggtcctacggaccttcgttccgtcggtcgtaccctacggtaacgttccgcggtacttagtccgtaactccccgttacccnccccggttaggcccttaaacgcccgtacgggttacccggccttacccgggtaggtcccgtagggtaacggtcggtacggacgtttcgtaacgttattttacctcggtaacctccggttaacttaccgtatacggaaccgttacgcggtaccgggttcgtccggttaggtcgggtacggtacgggaccggtaaccgggactacggtaccgtccgttacccgggctaccggg

SEQ ID NO: 186703 - DNA, 768 bp, Homo sapiens
  misc_feature: GYAE6OF01B80BF.22.87.H10.1.454.CMB.1.raw
tcagacatacgcgtcacgaccggtgctcgatttagcagtactgcgttgggtttgggggcttcagctgtcgggcacaaggaggcagcgactcagtacaatctccagcatgccgtggtcctcctctcctcctcctactcctctcgtctcactagctacgtacgggtccgtcggcctaggtctgtgcgtacgacacgtacgccggtacctacaaagtacgtaccggtaccggggccccgtaagggaacgaacggtaacggtaccaacctacttcccgtccgtaggacgtacggttacgggtaaccaaccgttaccaacggtcgtaccgggaactaacgttaagtaacgtcggtaacgttccggtaccgtacgtaacggtaccgaacggaaccgtaaccggttaaccgaacgtaaaaccgacccgaaccctaaacgtccgtactaacttactaacgtaaccggtaaactaacctacgtccgtaccgtacggaacgggttacctacggacgttctaccgtacgttaccggacccttacgtacggtgtaccgtacttacgtcgtacctacccgtcctaccgtacacctgtaaccgaccgtcggccctacggtcggacgttaggaggttaacggtcgaacgttacgtacgttacgtttacggtccgtacgtactcgttaagtactacgacgtaaccgcggtcggtaggtaccgttggtacggtaccggtcgggaacgacggtaaccggctaccggtacgttcggtaaccgtacgg

SEQ ID NO: 186704 - DNA, 725 bp, Homo sapiens
  misc_feature: GYAE6OF01C1GZU.22.87.H10.1.454.CMB.1.raw
  modified_base (179)..(179): a, c, t, g, unknown or other
  misc_feature (179)..(179): n is a, c, g, or t
tcagacatacgcgtcacgaccggtgctcgatttagcagtactgcgttgggtttgggggcttcagctgtgggcacaagaggcagcactcaggacaatctccagcatgcctggtctcctctcctcctcactcctctcgctcactgcacgagggtcctcgggccctagtctgtgctgacacncgcccgcctacaatcgtccgtcgggccccaggacacggacgtccacctactcctcgtcgacgtacggtaccggtacctaacccgtaccaaaccgtacggtccggggaactaattaacgttaagttacgtacgttaccgttacccgtaacgtaccgggtaacccaacggtaaccttaaaccccgttaaccgaaaaccgtaaaacccacccccgaacccccctaaactttccctaacgtaacttacgtaacgtaaccggtaaaacctaaaccgtacgtacccggtacccgtaacgggtcccggttaacccgtaccgtaaccgtactttacgtcgtaccgtccttaacgtaacgtcgtacgcttacgtcgtacctaccggtacccttccgcgtaccctacgtcgacgtccggtcctacgacggtcgaggtacgagtcgtgtcttagtacttaccgttcacgtcttaacgtctaacggtctaacgaccgtgtccggtaggtcggtcgtaggtcggtacgacgggactaccgagtcgtcgccgtgtaccgg

SEQ ID NO: 186705 - DNA, 863 bp, Homo sapiens
  misc_feature: GYAE6OF01C5EHA.22.87.H10.1.454.CMB.1.raw
  modified_base (128)..(128): a, c, t, g, unknown or other
  misc_feature (128)..(128): n is a, c, g, or t
  modified_base (138)..(138): a, c, t, g, unknown or other
  misc_feature (138)..(138): n is a, c, g, or t
  modified_base (197)..(197): a, c, t, g, unknown or other
  misc_feature (197)..(197): n is a, c, g, or t
tcagacatacgcgtcacgaccggtgctcgatttagcagtactgcgttgggtttgggggcttcagctgtgggcacaagaggcagcactcaggacaatctccagcagtggcctggtctcctctcctctcnctctccgtcnctcactgcacgacgggtcctcgggcccagtctgtcgctgaaccacgacgcccgccctanaatacgtccgtaccggggacccccaaggtaccgaaggtaaccggtcctaacctacttccctaccgtcgaccgtacggttaccgggtaacctaacccgtaccaaacgtacggtaccggggaactaattaaataagtacggtacttaccgtacccgtaacgtacggtacccgagtaacctaaccttaccgaaacgaaaaccgaccccgtaaccccctaacctcctactaacttaccttaaacgtaccggtaaaaccaaccgtacgttaccccggtacccgtaaccggtacccgggggttacccctacggtaaccgtttacctttccgtaccggtaccggtacccgttaaccgtaacggtttccgtacggtcctacggttaccggtacccgtacccgggtttcccctaccccggttacgggacccccttaaacggtaccggtaacccggttccgggtacccgttaccggaacccgggttaggtacgggtaacgggtaccgtcgggtacgttaggttacgtaactttacgtacgtacgaccgttacgacttagaacgttaggaggtacgtccgtaacggtacgttaaggttaggttttaccgggacggtttacggggaaccgggttaccggaacgttaccggtaccggtcccggtaacccggttaaccgg

SEQ ID NO: 186706 - DNA, 686 bp, Homo sapiens
  misc_feature: GYAE6OF01AY8LS.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatcggcctggtctcctctcctcctcactctcctcgctcactcgcacgagggtcctgggcccagtctgtgctgacacacggcccgaccctacaactatccggtcggggaccccaggaccgaggaacggtccacctactcctccgtcgccacgtacgggtaaccaacctaccaacacgtccggggacaattaataacgtagacgtcgtaccacgtgtaccgagacctaacttccgaacgaaaccaccgacccctaacctcctacacttctaactacgtaaaccaactaacgtccggtaccgtacgtacgggtccctacgtaccgtactacttcgtcgtccgtacctaacggttcctacggactagtcgtcctacgtaccctcccgttcggacctactcgaaccgttcggccgtacgtcggtacgtaggagtcggtagacgtagttacgtacttttacgttctccggtacctacgtttaccgatacggtaactacgcgtacgggttcggcggttaccgggttaggttccggttccgggagggtaccggtacgtacggtccggttaccgccggtacccggttacggg

SEQ ID NO: 186707 - DNA, 739 bp, Homo sapiens
  misc_feature: GYAE6OF01EA3AH.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactcgcacgacgggtcctcgggcccagtctggtcgctgacacacgcccgcctcaatacgtccggtcggggaccccaggacaggaaacggtccacctatcctcctgacctacgttacgggtaactaaaccctaccgaaccgtacgtcggggacctaagttaataagtagtatcgtacctacgtacggtaccacacctaacttaccgaacgaaaccaccgaaccccctaactcctactacttactaagtacgtaaacaactaccgtaccggtaccgtaccggtaccgggtaccgtacgaccgttaacttccgtcgtacgggtacctaccgtaacggttcgtaccgggactagtccgacgtaccgtcccctcgtacgctacctcggtacggcggtcctacgtaggctgggacggtacgtagggacgtacggtacgtttagtttaccgtcgtaccgttaccgtacttaccggttaacgaccggtaaacctacgggtccgttaccgggttgggtccgttacggggttcggttaccgggttacggggacgggtaacgggtaacccggacggttacccgaccggttaccggttccgtaaacccggg

SEQ ID NO: 186708 - DNA, 641 bp, Homo sapiens
  misc_feature: GYAE6OF01BPJ8F.22.87.H10.1.454.CMB.1.raw
  modified_base (191)..(191): a, c, t, g, unknown or other
  misc_feature (191)..(191): n is a, c, g, or t
  modified_base (197)..(197): a, c, t, g, unknown or other
  misc_feature (197)..(197): n is a, c, g, or t
  modified_base (392)..(392): a, c, t, g, unknown or other
  misc_feature (392)..(392): n is a, c, g, or t
  modified_base (510)..(510): a, c, t, g, unknown or other
  misc_feature (510)..(510): n is a, c, g, or t
  modified_base (535)..(535): a, c, t, g, unknown or other
  misc_feature (535)..(535): n is a, c, g, or t
tcagacatacgcgtcacgaccggtgctcgatttagcagtactgcgttgggtttgggggcttcagctgtgggcacaagaggcagcactcaggacaatctccagcatgtcctggtctcctctcctcctcactctcctcgctcactgcacgacgggtcctcgggcccagtctgtgctgacacgacgccgccctnaaactntcgtcggggaccccaggacgaggtaacggtccaacctatcctccgtcgcacgtacgggtaaccaacctccaaacgacggtacggggacaataataagtacgatcgtaccacgtacggtaaccacgtaacctaacttaccaacgaaaccaccgaaccccaaacttccactactctaacgtacgtaaacaacgtacnccggtacctcggacgggtccacgtacgtcttcgtacgtcgtactaccgtagtctggactagtcgtcactcccgtcgcgtaccactcgtacgtcggcctcggacgtcgtaggaggtcgnggtacgtcgtagtttactttacgtnttaccgacctacgttacgactacggactaacgcggtccggttgggcgtacggtaggtccggtacgggcggaacggccaacggtacgtacggtaccgtcggtaccgg

SEQ ID NO: 186709 - DNA, 496 bp, Homo sapiens
  misc_feature: GYAE6OF01B3OYU.22.87.H10.1.454.CMB.1.raw
  modified_base (461)..(461): a, c, t, g, unknown or other
  misc_feature (461)..(461): n is a, c, g, or t
  modified_base (463)..(496): a, c, t, g, unknown or other
  misc_feature (463)..(496): n is a, c, g, or t
tcagacatacgcgtcacgaccggtgctcgatttagcagtactgcgttgggtttgggggcatataatgatgtccactggtaccagcaacttccagaaacacgcccccaaactcctcatctatggtaacaacaatcggccctcgaggggtccctgaccgattctctggctccaagtctggcatgtcagccctcccgtggcccatccactgggctccgaggctgaggatgaggctgtatttagtttctggcctagtcctatgaacaacgagccgttgggtcccgtggtagttccgggacgggagggaccaaggcctggtacccgtacgtaggtccacgccccaaggccctcgcccccgtggtccacgttcctcggtacccccacccctccgtaccgtaaccggcgttagtcgtccgttacggcggtaccgggcctcggggacaaccggggtcgaccgtataggngnnnnnnnnnnnnnnnnnnnnnnnnnnnnnnnnnn

SEQ ID NO: 186710 - DNA, 727 bp, Homo sapiens
  misc_feature: GYAE6OF01AMQ68.22.87.H10.1.454.CMB.1.raw
  modified_base (323)..(323): a, c, t, g, unknown or other
  misc_feature (323)..(323): n is a, c, g, or t
  modified_base (336)..(336): a, c, t, g, unknown or other
  misc_feature (336)..(336): n is a, c, g, or t
tcagacatacgcgtcacgaccggtgctcgatttagcagtactgcgttgggtttgggggcgttcagctgtgggcacaagaggcagcactcaggacaatctccagcatggcctggtctcctctcctctcactctcctcgctcactgcacagggtcctgggcccagtctgtcgctgacacgagccgccctcaaagttctcgtcgggacccccaaggaccaagaacggtccacctatcctcctggcacgtcggtacaaccctcgaaccagttcgggctataatagtgatgtccacttacggtacacgctaccgttacacggtaaacncgacccctaaacnccttcgactacgtacgtaggtaaaccaaccgaacgtccggtacccgacgtaccggggttacccctcgtaacctcgtttaccttaccgcgggtaccctacccgaaaccgtttcggacggttacccgtagtaccgttaccgtaacggtcccgttacccccgtccgggttccaacttaccgtaccggtacggtacctccggtacgtccgttaaggcggtaccgtagtaccggcttaacggtcttttaacgttcccgtacgttaccgtaccggttaccttaaggccgttaaaaccgtaccggtaacggcccgttaggttccggacccgttagggttaaccgtcggggacccggtaggtaacccaacggtcgtacctacccggggtcgtaacccgg

SEQ ID NO: 186711 - DNA, 800 bp, Homo sapiens
  misc_feature: GYAE6OF01D2PQ8.22.87.H10.1.454.CMB.1.raw
  modified_base (133)..(133): a, c, t, g, unknown or other
  misc_feature (133)..(133): n is a, c, g, or t
  modified_base (135)..(135): a, c, t, g, unknown or other
  misc_feature (135)..(135): n is a, c, g, or t
  modified_base (294)..(294): a, c, t, g, unknown or other
  misc_feature (294)..(294): n is a, c, g, or t
  modified_base (693)..(693): a, c, t, g, unknown or other
  misc_feature (693)..(693): n is a, c, g, or t
  modified_base (774)..(774): a, c, t, g, unknown or other
  misc_feature (774)..(774): n is a, c, g, or t
tcagacatacgcgtcacgaccggtgctcgatttagcagtactgcgttgggtttggggcttcagctgtgggcacaagaggcagcactcaggacaatctccagcagtgctggtctcctctcctcctcactctccncnctcacgtgcacgagggtccgtcggccctagtcgtgtcgctcgacacgacgccgacctactaacttcggttccggaccgggacccccgaaggacgtaacggaacggtccaacctactcctcgtacgctaccggttacggtaaccaaccgtacctaaccgngggacccgggtaactaagttaacgtaacgttgtacgttaccggaaccgttaaccgggttccggaaccgttaacaccgtaaccttaaccgaacggaaaaccccaccccggtacccctaaacgttcctaattaccgttaaccgtacgttaaacggtaaaccaaaacggtcccggtcggaccccgtacgggttacccgggtacctcgtaaccctgttacccgtagtccgaaccgttaacgttacggtccgtttagacgtaccggtttaccgtaccggtacccgtcccgttacccggtaccgtaccgtacgtacccggtaaccggttccggacccgtcgtaacgccgggtaagttaccggtagggacgtcctaacgtttcgtttaactcgttttacccggganacccgtaccgttacacgtaactcccgaagtcccgtcggtacggtccggtacgtacggttacgggccgacgaccgggtaccncgtacccggtactaccgtcgtaccgg

SEQ ID NO: 186712 - DNA, 720 bp, Homo sapiens
  misc_feature: GYAE6OF01BUDZU.22.87.H10.1.454.CMB.1.raw
  modified_base (242)..(242): a, c, t, g, unknown or other
  misc_feature (242)..(242): n is a, c, g, or t
tcagacatacgcgtcacgaccggtgctcgatttagcagtactgcgttgggtttgggggcttcagctgtgggcacaagaggcagcactcaggacaatctccagcatggcctggtctctctcctctcactctcctcgctcactgcacgagggtccctgggcccagtctgtgctgacacacgccgccctcaatatcgtcgggacccaggacagaggtcacatctctgcacgtaggacactccaanacgtcgggactatactaatgatcgtacacgtcggtaccaggaccaacttaccaagaaactacgaccccaaactcctacgtactactacgttacggtaaaacaactaaacgtccggtacccgtacggtaaccggggttaccctacggtaaccggtaacttccgtacgtaccggtacctaccgttaaacggttcaggtacctacgttacggtacgtacgtccccgttacccggtacgacccgtaacgtaccgtaccggtacgggtaccgttaccgtaacgggtacgttacggaaggtacgttacgggaacggttagtcgggttaaatttaccgtttaccggtaccgtaccttaacgggtaccttacggaacgtaaccgtaaacgtccggttaccgtcggggtaccgtccgggtttaagggtccgtacgggtacgggacggtaaccgtacggaccgtacgggtacccgtcggttaaccggg

SEQ ID NO: 186713 - DNA, 958 bp, Homo sapiens
  misc_feature: GYAE6OF01CHWO9.22.87.H10.1.454.CMB.1.raw
  modified_base (155)..(155): a, c, t, g, unknown or other
  misc_feature (155)..(155): n is a, c, g, or t
tcagacatacgcgtcacgaccggtgctcgatttagcagtactgcgttgggtttggggcttcagctgtgggcacaagaggcagcactcaggacaatctccagcatggcctggtctcctctcctcctcactctcctcgctcactgcacgagggtccncgggcccagtcttgtcgctcgacacgacgcccgtccctacaattacgtccggtccgggaccccgaggacaaggaacggtccacctatacctccgtcgacctacgtacggtaacaacctaccaacgtacggtacggggacctaagttaacgtaagtacgtacgttcgtaccctaacggttaccggtaacctaacggtaccttaaacccgttaccgaaaccgtaaaacccgtaaccccgtaaccccctaaacccttccctacgttaacctttaccgtaaaggttaaccgtaaaccgtaaaaccgttaccggtacccggttccccgtaaccggggtaccccggggtttacccttaccggtaacccggtttaacgtttccgttaccggttacccgaccgtttaaacccggtacggtttaccgtacggttaccgtacgttacccggtaccctaccccggttccccgttaccccggtaccggttaccctaccgttacccggtacgggttcccggtaacccgtacgggtaccggtaaccggttaacggtagggttacgggtaaccggtcgttttaaacggttacgttttaaccgttttaccgggtaccgttaacccttaaccgggtttaccgttaaacgacccgggttaaaccttaaccgggtaccgggttaaccggttcgggggttacccggtttaaccggggtttacggtttaaccggggtaccccggggaaccggtaaccggggtaaaccccgtacggttacccgtacccgggttaccccgggttaacggtttacgaacccccgggg

SEQ ID NO: 186714 - DNA, 438 bp, Homo sapiens
  misc_feature: GYAE6OF02JTNGP.22.87.H10.1.454.CMB.1.raw
  modified_base (357)..(357): a, c, t, g, unknown or other
  misc_feature (357)..(357): n is a, c, g, or t
  modified_base (399)..(438): a, c, t, g, unknown or other
  misc_feature (399)..(438): n is a, c, g, or t
tcagacatacgcgtcacgaccggtgctcgatttagcagtactgcgttgggtttgggggcatataatgatgtccactgggtaccagcaacttccagaaacagccccaaactcctcatctatggtaacacaatcggccctcaggggtccctgaccgattcgtcctggctccaagtctggcatgtcagcctccctggccatcactgggcttccaggctgaggatgaggctgattaattctgccagtcctatgaactaacagtcctggggtgcccgttggtaacttcgggcggagggaccaagctgaccgtctaggtcagcccaaggctcgccccctggtcactcgtcgttcccgcctccncacgcgtatgtctggacgcgggctggcaaggccgccatagcnnnnnnnnnnnnnnnnnnnnnnnnnnnnnnnnnnnnnnnn

SEQ ID NO: 186715 - DNA, 644 bp, Homo sapiens
  misc_feature: GYAE6OF02HY691.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctgggccccaggacagagtcacatctcctgcacgtggtacaactaccaacacgtcgggacatataatgatcgtccacgtcggtaaccagactaaccttccaaacgaaacaccgacccccaaactcctactactactagtacggtaaacaacaacgtccggccctacgtacgggtccctacgaccgtacttctcgtcggcctaccaacgttcgtggactattcgtacacgtccctccgtcggccctatccgacgtcgggcctaccgacggtctaggacggtagtggacggtcgtaggttaacttttacgtttccgtacgtaccctacggttacccttaagtacgaaccaaccgtacggtccggttcggggtcgtcccgggttagggttacggttccggggacgggtaacgggaacccgtaaggtccggtacggtaccccggttacggtaccggg

SEQ ID NO: 186716 - DNA, 735 bp, Homo sapiens
  misc_feature: GYAE6OF02ICQZ3.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctctcactctcctcgctcactgcacagggtcctcgggcccagtctgtgctgacacacgccgccctacaatatcgtcgggcccagacagacggtcacatctcctgcacgtggtaccaactaccaacagtcgggactaatataatgatcgtaccacgtacggtaaccagacctaaccttaccaacgaaaccaccgacccctaaacctcctacacttactaagtacggtaacaaacaacgtccggaccctacggtacggggtccctacgaccgtactttctcgttcggacctaccgtaacgttcgtacgggtactacgttcgtaccgtaccgtccccgttcccgtcggtaccctaacgtaccgtaccggttcggggtcccttacccgacgggtccgtaggaacgggtacgtacgggacggtacgttaggtttaactttttacgttttcgttacgacccgttaacgttacccttagtaaccgaaacctaaccgtacggtacccggtttcgggggtaccggtcccgggttaggggttaacggtttacccgggggaacgggtaccggggaacccgtaacggtcccggttaccggtacccccggttaccggttaacccggg

SEQ ID NO: 186717 - DNA, 549 bp, Homo sapiens
  misc_feature: GYAE6OF02H29H7.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcggggcatataatgatgtccactggtaccagcaacttccagaaacacgaccccaaactcctcatctatggtaacaacaatcggccctcacggggtccctgaccgtattctctcggtctccaagtctggcatgtcacgccctccctggccctatccacgtgggcctccgaggctgaggatggaggctgtatttatttctgacctagttccctatcgaacaacagccgtggggtcgtccggttgggttacgttccggggacgggacgggtacccgaaggtccgtacggaccccgtccgtaacggg

SEQ ID NO: 186718 - DNA, 553 bp, Homo sapiens
  misc_feature: GYAE6OF02F9679.22.87.H10.1.454.CMB.1.raw
  modified_base (315)..(315): a, c, t, g, unknown or other
  misc_feature (315)..(315): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctccgcgtccgggtctcctggacagtcagtcaccatctcctgcactggaaccagcagtgacgttggtggttataactatgtctcctggtaccaacaacacccaggacaaacgcccccaaactcatgatttangaggtcactaagccggccctcgacggggtccctgactcgcttctctggctccaagtctggacaacgcggccctccctgacccgtctcgtgggcctccgaggcctggacggtatggacggcttaggtactttacgttacgtgcagtcctacattagtggagcaggcgaacgtaagtttcgggtcgttcgggacggacgggaccaaggtccgtacggacccgtcgtacgggtccaaccgg

SEQ ID NO: 186719 - DNA, 543 bp, Homo sapiens
  misc_feature: GYAE6OF02IJXO1.22.87.H10.1.454.CMB.1.raw
  modified_base (386)..(386): a, c, t, g, unknown or other
  misc_feature (386)..(386): n is a, c, g, or t
  modified_base (425)..(425): a, c, t, g, unknown or other
  misc_feature (425)..(425): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcggggcatataatgatgtccactggtaccagcaacttccagaaacacgcccccaaaactcctcatctatggtaacaacaatcggccctcacggggtccctgaccgattctctggctccaagtctggcatgtcagcctccngccatcactggctcaggctgagatgagctgatttacttntgcctagtcctagtcgaacaacgacgtccgtggggtcgtacccggttgggttaacgttccgggaccgggtaagggaacccgtaaggtccgtacggtaccccggttaccgttaaccggg

SEQ ID NO: 186720 - DNA, 852 bp, Homo sapiens
  misc_feature: GYAE6OF02H9855.22.87.H10.1.454.CMB.1.raw
tcagacatacgcgtcacgaccggtgctcgatttagcagtactgcgttgggtttgggggcttcagctgtgggcacaagaaggcgagcactcaggacaatactccagcatggcctcggtctcctctcctcctcactctcctcgctcactgcacagggtcctcgggcccagtctgtgctgacacagccgccctcaatatcgtcggggccccaggacagaaggtcaccatctcctgcactgggtacaactccaacacgtcggggacatataatgatgtccactggtaccagctaacttccaagaaaacacgacccccaaatcctcatctaagtacggtaaacactaacgtccggaccctacgacggggtccctagaacccgtattcctcgttcgggaccctaccgtaaacggttcgtacgggactaacgttcggttacccgaaccggtccccctttcccccggttagggaccccttaaactcccgtaaccgggttcgggggtacccttaccccgtaaaggggcccgtttagggaaccggggtaaacgttcgggaaaccggggttccctttaggggttaaaaccttttttaccgtttttacccggtcgggaacccccgttttaacgggttacccccggtttaaatttaaccggggtaaaccccaaaaaccgggttaccggggttccccggggtttttaaggggggtcccggttacccccggggtttttaagggggtttacccggttttaacccccgggggggaacggggggttaaacccggggaaaccccgtttaaaccgggtcccgggtttaacccgggtttaacccccgggttaccccggggtttaaaccggggg

SEQ ID NO: 186721 - DNA, 681 bp, Homo sapiens
  misc_feature: GYAE6OF02H9JM3.22.87.H10.1.454.CMB.1.raw
  modified_base (260)..(260): a, c, t, g, unknown or other
  misc_feature (260)..(260): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatcgtcggggccccaggacaggaaggtcaccatctcctgcactgggtacaactcaacatcgggcatataangatgtccacgtggtaccagcaaacttccaagaaacacgacccccaaactcctacactctagtacggtaaacaacaattccggaccctacggacggggtccctagaacccgtattcctcgtggtcctacccaagttccgaggctacgttgtccgaggtccccttccgcggtcccaattccgacggttcggggacctaccgacgggtccgttaggaaacgggtcttcgggaacgggtttcctacgggtttaacttttaacgttttcccgtcgggaaccccttaggtttaccctaaatacccgggtaaacaaacccgtacgggtcccgttcgggggtacgacccgggttaggttacggttcccggggacggtaaccggggtaacccaaaggttccggttaccggaccccgttggttaacccggg

SEQ ID NO: 186722 - DNA, 518 bp, Homo sapiens
  misc_feature: GYAE6OF02FSA2W.22.87.H10.1.454.CMB.1.raw
  modified_base (378)..(378): a, c, t, g, unknown or other
  misc_feature (378)..(378): n is a, c, g, or t
  modified_base (420)..(420): a, c, t, g, unknown or other
  misc_feature (420)..(420): n is a, c, g, or t
  modified_base (423)..(423): a, c, t, g, unknown or other
  misc_feature (423)..(423): n is a, c, g, or t
  modified_base (453)..(453): a, c, t, g, unknown or other
  misc_feature (453)..(453): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcggggcatataatgatgtccactggtaccagcaacttccaagaaacacgcccccaaactcctcatctatggtaacaacaatccggccctcgacggggtccctgaccgtattctctcggctccaagtctggcntgtcagccctccctggccatccactgggctccgagctgaggntgngctgattattctgccagtcctatgacaacngccgtgggtcgtccgtggtaacgttcgggacgggaggaccgaagtcgtacgtacccgtctacggg

SEQ ID NO: 186723 - DNA, 715 bp, Homo sapiens
  misc_feature: GYAE6OF02JYQNY.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatcgtcggggccccaggacagaacggtcaccatctcctgcactgggtacactcaacatcgggcatataatgatgtccatggtaccagccaacgttccacgaacacgacccccaaactcctacacgtactacgtacggtaaaccaaactaaacgtccggtacccctacgtacgggggtaccccttaggaacccgtaagttccgtctacgggtcccttacccgtaaacggttctacgggtaccacgttcgtacaaccgtcccttaccccgtacggtaccctacgttaccgtaaccgttcggggtaccctacccggtaacgggtccgttaacgggacgggacgttacgggtaacgggtccttagggttaaccttttacgtttccgtacgtaccgttacgttaccgttaacgtcgtaaacccgacgtaccggttcgtacggggttcgtaccggtttacgggtacgttacggggaaccgggtacgggtaaccgtaacggccggttaccggtacccggtccggttaaccggg

SEQ ID NO: 186724 - DNA, 394 bp, Homo sapiens
  misc_feature: GYAE6OF02HI09Q.22.87.H10.1.454.CMB.1.raw
  modified_base (234)..(234): a, c, t, g, unknown or other
  misc_feature (234)..(234): n is a, c, g, or t
  modified_base (383)..(394): a, c, t, g, unknown or other
  misc_feature (383)..(394): n is a, c, g, or t
tcagacatacgcgtcacgaccggtgctcgatttagcagtactgcgttgggtttgggggcatataatgatgtccactggtaccagcaacttccagaaacagcccccaaactcctcatctatggtaacaacaatcggccctcaggggtccctgaccgattctctggctccaagtctggcatgtcagcctcctggccatcactgggctccaggctgaggatgaggctgattatttcngccagtcctatgacaacagcctgggtgccgtggtattcggcggagggaccaagctgaccgtctaggtcagcccaaggctcgcccctggtcactctcgtcccgcctcctcacgcgtatgtctgacgcgggctgggacaaggcgcagtagnnnnnnnnnnnn

SEQ ID NO: 186725 - DNA, 640 bp, Homo sapiens
  misc_feature: GYAE6OF02HZ2M9.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactggtacaactccaacatcggggcatataatgatgtccactggtaccagcaacttccagaaacacgcccccaaatcctacatactataggtaacaacaactcggaccctacgacggggtccctgacccgtactttcctacgtcggcctccgtaaacgttccgtagggtctacgttcggtcaacggtccccttccccgtcgggccctacgtccacgtcggggcctcccgaacgggtcctggacgggtatcggagggtcgttggtaactttacgtttttccgacggtcccgtagttcccttaagtacgtaacctaaccgtacggtcccgttaggggtcgtcccggttagggtaacgtttccggggacgggtaacgggacccgaacggtccgtacggtacccggtcgttaaccggg

SEQ ID NO: 186726 - DNA, 497 bp, Homo sapiens
  misc_feature: GYAE6OF02F2MZY.22.87.H10.1.454.CMB.1.raw
  modified_base (425)..(425): a, c, t, g, unknown or other
  misc_feature (425)..(425): n is a, c, g, or t
  modified_base (443)..(443): a, c, t, g, unknown or other
  misc_feature (443)..(443): n is a, c, g, or t
  modified_base (452)..(452): a, c, t, g, unknown or other
  misc_feature (452)..(452): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctggacccagtctgtgctgacacagccgccctcaatatctggggccccaggacagaaggtcaccatctcctgcactgggtacaactccaacatcggggcatataatgatgtccactggtaccagcaacttccagaaacagcccccaaactcctcatctatggtaacaacaatcggccctcagggtccctgaccgattctctggctccaagtctgcatcgtcagcctcccgtgccatcactgggctccagctgagatgaggctgattatttcngccagtcctatgacaacngcctgggtnccgtggtactcggacggaggaccaaggctcggacccgtcgtacgg

SEQ ID NO: 186727 - DNA, 533 bp, Homo sapiens
  misc_feature: GYAE6OF02IBLM6.22.87.H10.1.454.CMB.1.raw
  modified_base (432)..(432): a, c, t, g, unknown or other
  misc_feature (432)..(432): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcggggcatataatgatgtccactggtaccagcaacttccagaaacagccccaaactcctcatctataggtaacaacaactcggccctcgaggggtccctgaccgattctctggctccaagtctgcatgtcacgccctccctggccatccacgtcgggctccgaggctggagatgaggctgtatttntttctgcctagtcctagtcgacaacacgtccgtgggtcgtccggtaggtacgttcgggcgggtacgggaccgaaggccgtacggtaccccgtcgtaccggg

SEQ ID NO: 186728 - DNA, 536 bp, Homo sapiens
  misc_feature: GYAE6OF02FWVA9.22.87.H10.1.454.CMB.1.raw
  modified_base (460)..(460): a, c, t, g, unknown or other
  misc_feature (460)..(460): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcggggcatataatgatgtccactggtaccagcaacttccagaaacacgcccccaaactcctcatctatggtaacaacaatcggccctcacggggtccctgaccgattctctggctccaagtctggcatgtcagccctccctggcccatccactcgggctccgaggcctggaggatgaggtctgatttagtttctgcctagtcctatgaccaacngccgttgggtcgtcccggttagggttacttcggggacggtacgggacctaaggcctacggacccgttcgtaacggg

SEQ ID NO: 186729 - DNA, 611 bp, Homo sapiens
  misc_feature: GYAE6OF02H31F1.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcggggcatataatgatgtccactggtaccagcaacttccagaaacagcccccaaactccctcatctatggtaacaacaatcgccctcacggggtccctgaccgattctctggctccaagtctggcatgtcacgtccctccgtcggcctacgtcctacggtcgggtcctccggtacggtcgtaggaggtagtacgggacggtccgttagttaacttttacgtttccgtcgtacccgttacgttacccgttattacgaacctaactacggtaccggttcggggtcgtaccggttagggttacggttccgggtacggggaacgggaaccgtaacggtccggtacggtaccccggttcgttaacccggg

SEQ ID NO: 186730 - DNA, 398 bp, Homo sapiens
  misc_feature: GYAE6OF02IA0WX.22.87.H10.1.454.CMB.1.raw
  modified_base (382)..(398): a, c, t, g, unknown or other
  misc_feature (382)..(398): n is a, c, g, or t
tcagacatacgcgtcacgaccggtgctcgatttagcagtactgcgttgggtttgggggcatataatgatgtccactggtaccagcaacttccagaaacagccccaaactcctcatctatggtaacaacaatcggccctcaggggtccctgaccgattctctggctccaagtctggcatgtcagcctccctggccatcactgggctccaggctgaggatgaggctgattatttctgccagtcctatgacaacagcctggtgccgtggtattcggcggagggaccaagctgaccgtctaggtcagccaaggcctgccccctggtcactctgtcccacctcctcacgcgttatgtctgagcgggctggacaaggcgtcgataggnnnnnnnnnnnnnnnnn

SEQ ID NO: 186731 - DNA, 630 bp, Homo sapiens
  misc_feature: GYAE6OF02GQUSN.22.87.H10.1.454.CMB.1.raw
tcagacatacgcgtcacgaccggtgctcgatttagcagtactgcgttgggtttggggggcttcagctgtgggcacaagaggcagcactcaggacaatctccagcatggcctggtctcctctcctctcactctcctcgctcactgcacagggtcctgggcccagtctgtgctgacacagccgcctcaatatctgggccccaggacagaaggtcaccatctcctgcacgtggtacaactccaacatcggggcatataactgatgtccactggtaccagactaacttccaagaaactacgaccccaaactcctacagtctataggtaacaacaactcggccctcgacgggtccctgaccgtacttctacgtcggtcctccaacgtcttcggacgaaccgacggtccctcccgtgaaccctacgtccgtcgtcgggtcctccgaggtcttaggaacgtgtagacggctagtatttacttacgtgtacttgccgttactagtttcgacgtacggtccgtcccgttacgtaccggttggggttaccggtttaccggggccgggtaacccgggtaacccgtaacggtcccgttaccggtaaccccggttcccggttaaccggcccgttaaccccggg

SEQ ID NO: 186732 - DNA, 599 bp, Homo sapiens
  misc_feature: GYAE6OF02GEIMG.22.87.H10.1.454.CMB.1.raw
  modified_base (433)..(433): a, c, t, g, unknown or other
  misc_feature (433)..(433): n is a, c, g, or t
  modified_base (442)..(442): a, c, t, g, unknown or other
  misc_feature (442)..(442): n is a, c, g, or t
tcagacatacgcgtcacgaccggtgctcgatttagcagtactgcgttgggtttggggcttcagctgtgggcacaagaggcagcactcaggacaatctccagcatggcctggtctcctctcctcctcactctcctcgctcactgcacagggtcctggcccagtctgtgctgacacagccgccctcaatatctggggccccaggacagaaggtcaccatctcctgcactgggtacaactccaacatcggggcatataaatgatgtccactggtaccagcaacttccagaaacacgccccaaactcctcatctatggtaaacaacaatccggcctcacggggtccctcgaccgtattctctggcctccgtaagtctggctatgtccagcccctcccgtcggccctatccacgtcgggacctccgaggtctggaagngtgacggtntagtatttacgtttctcgcctacgttccttatacgaacctaacgtacgtcccggttaggggttccgcccgggtttaggttaaccggttcggggaccgggtaacggggtacccgaaaagggttcccgtacgggtaccccggttacccggttaaccggg

SEQ ID NO: 186733 - DNA, 535 bp, Homo sapiens
  misc_feature: GYAE6OF02IF0WV.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactggtacaactccaacatcggggcatataatgatgtccactggtaccagcaacttccagaaacagccccaaactcctcatctatggtaacaacaatcgccctcaggggtccctgaccgattctctggctccaagtctggcatgtcacgccctccctcggccatcactcgggctcccgaggctgaggatggaggcttggatttactttctcgaccacgttcctaagtcgaacaacgacgtccgtggggtcgcccggttagggttacgttcgggacgggacgggaccacgcgtcgacccgtcgtaacggg

SEQ ID NO: 186734 - DNA, 553 bp, Homo sapiens
  misc_feature: GYAE6OF02FRP21.22.87.H10.1.454.CMB.1.raw
  modified_base (257)..(257): a, c, t, g, unknown or other
  misc_feature (257)..(257): n is a, c, g, or t
  modified_base (362)..(362): a, c, t, g, unknown or other
  misc_feature (362)..(362): n is a, c, g, or t
  modified_base (436)..(436): a, c, t, g, unknown or other
  misc_feature (436)..(436): n is a, c, g, or t
  modified_base (470)..(470): a, c, t, g, unknown or other
  misc_feature (470)..(470): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacaggtcctgggcccagtctgtgctgacacagccgccctcaatatctggggcccccaggacagaaggtccaccatcctcctgcactgggtacaactccaacatcgggcatanactgatgtccactggtacccagcaacttcaagaaacagcccccaaactcctacatctaatggtaaaccaacaactccggccctcacggggtccctgaccgattcnctgcttccaagtctggcatcgtcacgcctcccgtggcccatccactcgggcctccgaggtctggaggtatgagntgatttacttctgaccagtcctatcgaacaacgngcctggggtcgtcccggtggttacttccgggaccgggtaacgggaacccaacgggtcctaccggacccggttccgttaacggg

SEQ ID NO: 186735 - DNA, 391 bp, Homo sapiens
  misc_feature: GYAE6OF02I49RC.22.87.H10.1.454.CMB.1.raw
  modified_base (383)..(391): a, c, t, g, unknown or other
  misc_feature (383)..(391): n is a, c, g, or t
tcagacatacgcgtcacgaccggtgctcgatttagcagtactgcgttgggtttgggggcatataatgatgtccactggtaccagcaacttccagaaacagccccaaactcctcatctatggtaacaacaatcggccctcaggggtccctgaccgattctctggctccaagtctggcatgtcagcctccctggccatcactgggctccaggctgaggatgaggctgatttatttctgccagtcctatgacaacagcctgggtgccgtggtattcggcggagggaccaagctgaccgtcctaggcagcccaaggctcgccccctggtcactctcgttcccacctcctcacgcgttatgtctgacgcggctggcaaggcgcatagnnnnnnnnn

SEQ ID NO: 186736 - DNA, 655 bp, Homo sapiens
  misc_feature: GYAE6OF02F4O2V.22.87.H10.1.454.CMB.1.raw
  modified_base (308)..(308): a, c, t, g, unknown or other
  misc_feature (308)..(308): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcggggcatataatgatgtccactggtaccagcaacttccagaaacacgacccccaaactccncactctatggtaaacaacaactccggccctcgacggggtccctcgaccgtacttcctctcggcctacccgaagttcgtcggtcagtcgtacacgtcccctcccgtcggaccacgtccgacgtcggggccttcccgaagggcccttagggaacgggagtggtacgggtccttaggtaattttacgtttcgttaccgtaccgtaacgttccttacgtacgacctaaaccgtcggtccggttacggggttacgtcccgggtttagggttaccgttaccgggggtaccgggtaacgggggtaacccgtaacgggtacgttacccgggtacccggttacccgttaaccgggg

SEQ ID NO: 186737 - DNA, 667 bp, Homo sapiens
  misc_feature: GYAE6OF02GEJWJ.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagcccgcccctcaatactcgtcgggggcccccaggacaggaacggtccaccactcctcctgcacgtcgggtacaacctccaacagtcggggcataataatgatgtccactggtaccagcaacttccaagaaacacgacccccaaactcctcactctataggtaaaccaacaactccggcccctacgacggggtccctcgaccgtacttctctcggctacccaaggtctggcatcgtacaccgtcccctcccgtcggccctactccgaccgtcgggtccctcccgaggccgttaggagggtacgtacgggacgggtaccttaggtaactttttaacgtttccgttacgtacccgtaacggttacccttaacgtagaacccgtaaccgtacggtcccgtgggggttaaccgtccgggttacggttacggtttccgggacggggtaaccgggtaacccgacgggtcctacggtacccggttccgttaaccgggg

SEQ ID NO: 186738 - DNA, 565 bp, Homo sapiens
  misc_feature: GYAE6OF02IL10V.22.87.H10.1.454.CMB.1.raw
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactggacaactccaacatcggggcatataatgatgtccactggtaccagcaacttccacgaaacacgacccccaaactcctcactctatagtaacaacaatccggccctcgacgggtccctgacctattctctgctcaagtcnggcatgtcacgcctccncggccatcacgtcgggcctccgacggtctggaggactggaggtcgtgtattttactttaccgtcgtcctagttccctagtacgaaccaacgcgtaccgttcggggtcgtccggttggttacggttcgggaccgggtacggaacccgtaaggccgttacggtacccggttaccgtacggg

SEQ ID NO: 186739 - DNA, 616 bp, Homo sapiens
  misc_feature: GYAE6OF02F7AAG.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcggggcatataatgatcgtccactggtaccagctaacttccaagaaaccacgacccccaaactcctcactctatcggtaacaacaatccggcctcgacgggtcctgaccgtattctctggcctaccagtctggcatcgtcacgtccctcccgtcggcctactcctacggtccggccttaccgaggtccgtacggacgggtagtcggacgggtcttaggtaacttttacgtttcgttcgtaccgtacgttaccttacgtaccgaacgtaacgtacggtaccgttcggggtcggttaccggttacgggttacggttccgggacggggaaccggtaccgaacggtccgtacggtacccgtccggttaaccggg

SEQ ID NO: 186740 - DNA, 513 bp, Homo sapiens
  misc_feature: GYAE6OF02H4B62.22.87.H10.1.454.CMB.1.raw
  modified_base (363)..(363): a, c, t, g, unknown or other
  misc_feature (363)..(363): n is a, c, g, or t
  modified_base (380)..(380): a, c, t, g, unknown or other
  misc_feature (380)..(380): n is a, c, g, or t
  modified_base (396)..(396): a, c, t, g, unknown or other
  misc_feature (396)..(396): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatcgtgggccccaggacagaaggtcaccatctcctgcactggtacactccaacatcggggcatataatgatgtccactggtaccagcaacttccaagaaacacgacccccaaactcctcatctatgaacaacatcgcctcgacgggtccctgaccgtatctctgctcctagtcnggcatgcacgcctccgngccatcactggctcgngcngaganggagctgtattatttctcgcctagttccagtacgacaagcgccgttgggcgtccggtggttacgttcgggcggacgggaccaaggtcgtacggtacccgtccgtaacgg

SEQ ID NO: 186741 - DNA, 681 bp, Homo sapiens
  misc_feature: GYAE6OF02J3AYJ.22.87.H10.1.454.CMB.1.raw
  modified_base (186)..(186): a, c, t, g, unknown or other
  misc_feature (186)..(186): n is a, c, g, or t
  modified_base (561)..(561): a, c, t, g, unknown or other
  misc_feature (561)..(561): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctnaatatcgtcgggccccaggacagacggtcacctatcctcctgcctacgtcgggtaaccaactccgaacaggtccgggacatataagtcgtaatcggtaccacgtggtaccacgacctactacctaaccgaaacgaccaccccgtaacctacctctactactactacggtaaaccaactaacgtaccggacccgtacggtaccgggtaccctacgtaccgtaacgttccgttacctcggtcccttaaccgtaacgttccgtaacggtctaaccgtcgttaccgtaaccgttccccgtaaccccgttcggtaccctaacgtccgttaaccggcggtacctccggacgttacgacggtgaagtcggtaagtccgttanagttttcttacgttccgaccttaacggtcctattacgaccaacggtactcggtaccggtacgtcggttccgttaacggtccgggaggtaaccgcgtaacgtcgtccgtacggtcctaacg

SEQ ID NO: 186742 - DNA, 584 bp, Homo sapiens
  misc_feature: GYAE6OF02GK0CQ.22.87.H10.1.454.CMB.1.raw
  modified_base (449)..(449): a, c, t, g, unknown or other
  misc_feature (449)..(449): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctctcactctcctcgctcactgcacagggtcctgggcccagtctgtgctgacacagccgccctcaatatctgggccccaggacagaaggtcaccatctcctgcactgggtacaactccaacatcgggcatataatgatgtccactggtaccagcaacttccagaaacacgaccccaaactcctcactctatacggtaacaactaatccggccctcgacggggtccctgaccgtattctctggcctaccaagtctcggcatcgtcacgtccctcctggccatcacgtcggcctccgagtcgtgaggtatgaggtctagtatttacgttntcgccgtagttcctagtacgaactacgtacgtccggtaggggtcgtacccggttacgggttacgttccggggaccgggtaaccggggaacccgtaacgggtcccgttacgggtacccggttccggttaacccggg

SEQ ID NO: 186743 - DNA, 598 bp, Homo sapiens
  misc_feature: GYAE6OF02G7MML.22.87.H10.1.454.CMB.1.raw
  modified_base (225)..(225): a, c, t, g, unknown or other
  misc_feature (225)..(225): n is a, c, g, or t
  modified_base (323)..(323): a, c, t, g, unknown or other
  misc_feature (323)..(323): n is a, c, g, or t
  modified_base (357)..(357): a, c, t, g, unknown or other
  misc_feature (357)..(357): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagcctgcctccgtgtctggatcatctggacagtcgatcagctatttccngcacgtcgggaccaacagtgactagttggttctttgactctgtctcctaggtaccaacaccaccgacgacccaaaccccccatcatctatttagtgtntcactcgtccgcctgagctctctcatcgtcttcncgacgtctactagtctagaccacgaccgtccctaccctaactctcctcgtcggtctccgtagtttcgacggtacgtacgttcttaacgtttacttacgtcgtacttaacgtttacctttaaacggtcgtacctaccttacgttcgtttcggtttcgggtttcgggtaccggtacggtccctaaccggtaggttcccggtacccggttccgttccggtaccgtacccggacccgtaaccggg

SEQ ID NO: 186744 - DNA, 578 bp, Homo sapiens
  misc_feature: GYAE6OF02FNNHI.22.87.H10.1.454.CMB.1.raw
  modified_base (356)..(356): a, c, t, g, unknown or other
  misc_feature (356)..(356): n is a, c, g, or t
  modified_base (421)..(421): a, c, t, g, unknown or other
  misc_feature (421)..(421): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcggggcatataaatgatgtccactggtaccagcaacttccagaaacacgacccccaaactcctcatctatgtaacaacaatcgccctcgacggggtcctcgaccgattcnctgctccaacgtctggcatgtcacgccctcccgtgccatcacgtcgggcctcgaggctggacggntgaggtctgtatttagtttcgtcgtaccctacgttccctagtacgaaccgaacgtacgtccgtaggggtcggtccggttagggttaccgtttcgggaccgggtaacggggacccgtaaagggtccgtaccgggtaaccccggttaccttaaccgggg

SEQ ID NO: 186745 - DNA, 527 bp, Homo sapiens
  misc_feature: GYAE6OF02IA7SI.22.87.H10.1.454.CMB.1.raw
  modified_base (163)..(163): a, c, t, g, unknown or other
  misc_feature (163)..(163): n is a, c, g, or t
  modified_base (239)..(239): a, c, t, g, unknown or other
  misc_feature (239)..(239): n is a, c, g, or t
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (262)..(262): a, c, t, g, unknown or other
  misc_feature (262)..(262): n is a, c, g, or t
  modified_base (471)..(471): a, c, t, g, unknown or other
  misc_feature (471)..(471): n is a, c, g, or t
  modified_base (482)..(482): a, c, t, g, unknown or other
  misc_feature (482)..(482): n is a, c, g, or t
  modified_base (489)..(513): a, c, t, g, unknown or other
  misc_feature (489)..(513): n is a, c, g, or t
  modified_base (515)..(527): a, c, t, g, unknown or other
  misc_feature (515)..(527): n is a, c, g, or t
tcagacatacgcgtcacgaccggtgctcgatttagcagtactgcgttgggtttgggggcatataatgatgtccactggtaccagcaacttccagaaacacgcccccaaactcctcatcctatggtaaccaacatccggcctcaggggtccctgacccgattcncgtggcctccaagtctggccatcgtcagccctccctgccatcaccgtggcctcaggctgaggatggagctgatttntccngccagttactntgaacacntccgtggtcgcgtgtagtcggacgggtacggaaccgtaagcctacggtaccccgttccgtaggttccaccggacccgtacggtcctcccgtccccccgttggtaccctacgtcccgttccgtttccccacccttccgtaccgtaccccgtgtaccgtgtccttcgggaaccgtcggggacctagaccgtaacggcccgagtaacccgtngctgctcaagntgctgcnnnnnnnnnnnnnnnnnnnnnnnnngnnnnnnnnnnnnn

SEQ ID NO: 186746 - DNA, 773 bp, Homo sapiens
  misc_feature: GYAE6OF02IDDWE.22.87.H10.1.454.CMB.1.raw
  modified_base (270)..(270): a, c, t, g, unknown or other
  misc_feature (270)..(270): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacacgccgccctcaatatcgtcggggccccaggacaggacggtccaccatctcctgcacgtgggtacaactccaacacgtacggggactatataangtatgtccaacgttcggtaaccctagaccgtaaccttaccgaaacgtaaaccaaccggacccccctaaaacctcccctacgtaacttcttaacgttacgggtaaaacctaacctaaacgtccggtacccctacgggaaccggggttccctacggacccgttactccgtacgttcgggtaccctaccgtaacggttcgtacggaccgtacgtttacgtaccgtaaccgtccccgttacccgttccgggtaccctaacgttaccgtaccggtcgggtaccctcggtaccgggtccgtagggaacggtactacgggtaacggtccgtagtttaaccgttttaagtttcccgtcggtaaccgttacgttccgtaacgtaccgtaaactaccggtacggtaccggttcggggtacggttccgggttacgggttacgggtccgggtaacggggtaccgggtaaccgttacgggtaccccggtacggtaccccggttccgttaacccggg

SEQ ID NO: 186747 - DNA, 630 bp, Homo sapiens
  misc_feature: GYAE6OF02FSETZ.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatcgtggggccccaggacagaaggtcaccatctcctgcactgggtacaactccaacagtcggggcatataatgatgtccactggtaccagcaacttccaagaaacacgacccccaaaactcctacactctaagtacggtaaacaaacaatccggccctacgacggggtccctcgaccgtattctctggcctacaagtctggcatgtacacgtccctcccgtcggcctactctacgtcgggcctccgaggctaggacggtagtcggacggtcgttaggtaacttttacgtttcgtacgtacccgtacgttaccttaagtacgaacctaaccgtacggtacccggttggggtccggtcccgggtttagggttacggtttccggggacgggtacggggtaaccgaacggtccgtaccggtaccccggttaccggttaacccggg

SEQ ID NO: 186748 - DNA, 572 bp, Homo sapiens
  misc_feature: GYAE6OF02FS2V2.22.87.H10.1.454.CMB.1.raw
  modified_base (430)..(430): a, c, t, g, unknown or other
  misc_feature (430)..(430): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcggggcatataatgatgtccactggtaccagcaacttccagaaacacgacccccaaactcctcatctatggtaacaacaatcggccctcgacggggtccctgaccgtattcctctggctccgaagtctcggcatcggtcacgccctccctggcccatcacgtcgggcctccgaggcctgacggntaggcggctgtatttacgtttctacgtccagttcctagtgaacctaacacgtacgtggggttacgccggttacgggttacgttccggggacgggtacggggaacccgtaacggtccgtacggtacccgttccggtaaccggg

SEQ ID NO: 186749 - DNA, 647 bp, Homo sapiens
  misc_feature: GYAE6OF02IND8H.22.87.H10.1.454.CMB.1.raw
  modified_base (454)..(454): a, c, t, g, unknown or other
  misc_feature (454)..(454): n is a, c, g, or t
tcagacatacgcgtcacgaccggtgctcgatttagcagtactgcgttggggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctcggggccccaggacagaaggtccaccatctcctgcactggtacaactccaacagtcggggcataataatcgatgtccaactggtaccagacaacttccaaggaaccacgaccccaaactccctctactctatacggtaaaccaacgtaactccggaccctcgaacggggttcccctacgaaccgtaacttctacgtcggtctacccgtaatccgtggactacgttgtaccaacgtccccttaccccgtcggaccttaacnccgtaacgtccgggacctaccaggcgtaggagtagtagacggcttgtaacttttagtttcgtcgaccttaacgttcctaagttaacactaaccgtacggtccggttacggggtcgttacccgggtggttacgttaccggggaccgggtacgggaaccgtagtacccgacggttacccgtacggttaacccggg

SEQ ID NO: 186750 - DNA, 722 bp, Homo sapiens
  misc_feature: GYAE6OF02G3OEO.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagcccgcccccaatactcgtcggggccccaggacagaaggtcaccactctcctgcacgtgggtacaactccaacagtcgggacataataatgatcgtcctacgtcgggtaaccacgtacctaaacccttaccgaacgaaaaccgaccgaacccccctaaactcccgtactaacttacctaacgttaacggtaaacctaaaccgaacgtcccggtacccgtacgtaccgggggtaccctacggtaccgtactttccgtccgtcggtacctaccgtaacgttcgttacggctaacttcgtacgaccgtcccgttcccgtcggacctactaccgacggtcggtccgtccgaacggtccgtaggacgtagtcggaacggtcgttacgttacttttaccgtttcgtacgtaccgttacgttaccttaacgtacgtaaccgaaccgtacgtccgggttcgggtaccggtccggttacggtacggttccgggacgggtaacggtaccgtacggtacccgttaccggtaacccggttaccggtacggtacccgg

SEQ ID NO: 186751 - DNA, 542 bp, Homo sapiens
  misc_feature: GYAE6OF02GWGCC.22.87.H10.1.454.CMB.1.raw
  modified_base (411)..(411): a, c, t, g, unknown or other
  misc_feature (411)..(411): n is a, c, g, or t
  modified_base (465)..(465): a, c, t, g, unknown or other
  misc_feature (465)..(465): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggcccccaggacagaaggtcaccatctcctgcactgggtacaactccaacatcggggcatataatgatgtccactggtaccagcaacttccagaaacacgccccaaactcctcatctataggtaacaacaatcggccctcgacgggtccctgaccgattctctgctcaagtctgcatgtcacgcctcccgtggcccatccacgtcgggcctaccgnggccgtggaaggatggaggctgtatttatttcctgcctagtctatcgaacaacncgccgtgggtgccggttggtacgttcgggcgggtacgggacccgaacggtccgtacggtacccggtcgttaaccggg

SEQ ID NO: 186752 - DNA, 742 bp, Homo sapiens
  misc_feature: GYAE6OF02IZD83.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacacgggtcctgggcccagtctgtgctcgacacacggcccgtccctcaaactcgtccgtcgggggcccccgaaggaccgaaggaacggtccaccctactcctccgtcgacctacgtacggggttaaccaacctaccaacgacggtcggggactattaataatggactcgtaccacgtcggtaccacgactaaccgtaccgaacgaaaccgaccgacccccaaactcctactactactagttaggaaacctaactacgtaccggtccctacggaccgggttaccctacggacctacgttctcgtccgtaccgttaccgaacgttccgtcgacctagtccgtaccgaccggtaccccgttcccgtaccgggacctacgttaccgtacggttccgggtccgtaccgttacgggtcgtacgggtaacgtaccgtagggtacgtcggttacgtttacgtttacgttcggtaccgtaccgttacgttacgttaaccgtaacgaacgtaacgtcgggtacgggttcggtacggttccggttacggtagttaccggggaggtaaccggaccgtacggtccgacccggttcgtaccggtaaccggg

SEQ ID NO: 186753 - DNA, 775 bp, Homo sapiens
  misc_feature: GYAE6OF02G8RFR.22.87.H10.1.454.CMB.1.raw
  modified_base (626)..(626): a, c, t, g, unknown or other
  misc_feature (626)..(626): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctctcactctcctcgctcactgcacacgggtcctcgggcccagtcctgtcgcgtagaccacacgtcccgccctacaattctcgtccgggcccagaccgtaagaacggccaacctatcctccgtgaccacgtagggaacctaactccaaactacggtccggggactaagttaagtaaatcgtaactcggtacccacgttacgggtacccctaaggacccttaaaccgttaaccgaaacgaaaaccgacccaacccccctaaaactccctactaacgtactaacgttacggaaacaaaccgtacgttcccggaccttacggaccgggtccacggtaccgtattccgtacttcggaccttaccgtaacgttcgacgtaccgtattccggtagtccgtaccccgttaccggtaccggtaccacttacccggaccgtttaccgggccttacggtccggtaactggggtacgtaacggtggtaccgtcgtacgtttaagttaccgttttcncggttacccgtagttccgttaaacgacccgtaacgtaccgtacgggttcgtcggggtaaccgtcgggtttacggttaccggtttacgggggacccgggaacggtacccggtaacggtacccttaccgggacccgttaccgggtaaccgg

SEQ ID NO: 186754 - DNA, 621 bp, Homo sapiens
  misc_feature: GYAE6OF02IZQ83.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctcgggcccagtctgtgctgacacagccgccctcaatagtcgtcggggcccaggacagaacggtcaaccatctcctgcacgtcggtacactcaacagtcgggacatataatgaatcgtacactacggacagacaacgttacacgaaaaccacgaccccaaactcctacgactcctaagtacgtaacaacactccgcctacgacgggtccacgtacgtactctcgtcggctaccgaagtcgtacgacactcgtcacgtccttccgtcggaccactaccgacgtacggccctaccgaacggtcgtacggtaacgagttacggaggtaccttaggttaacttttacgtttcgtaccgtacgttaaccgttctaacgtttacgaacgttacgcgtacgttagggtcgttacggtcgggttacgtacgggtcggtaacggaccggacgtacgtaccggtaccgtccgtaacgg

SEQ ID NO: 186755 - DNA, 620 bp, Homo sapiens
  misc_feature: GYAE6OF02HD8LQ.22.87.H10.1.454.CMB.1.raw
  modified_base (228)..(228): a, c, t, g, unknown or other
  misc_feature (228)..(228): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagcccgccctcaatatcgtcggggccccaggacagaaggtcaccatctcctnccacgtgggtaacaacctccaacacgtcggggacataataatgatcgtccacgtggtaccagacaacttaccaagaaaccacgacccccaaactccctacactctatacgtaaacaacaacgtccgaccctacgacgggtccctcgaccgtacttctctcggtcctacctaacgtccgtcgtctagtcgtcacgtccccttcccgtcgaccactaccaccggtcggccctaccgacggtccgtaggacggtagtggacgtcgtgttactttagtttcgtactcctacgttcctacgacgtaaccacgacgtcggttacgggtcgtccggttagggtaccggttcgggacgggtaacggaccgtaggtccgtacggtacccgtcggtaaccgg

SEQ ID NO: 186756 - DNA, 718 bp, Homo sapiens
  misc_feature: GYAE6OF02GRXQ0.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacactcggggcactaataatgatgtccacgtcggtaaccagacaacttaccaagaaaacaccgaccccaaaactcctacactactaatacggtaaacaaactaaactccggaccctacgacggggtccctagaccgtacttactcgtcggactacctaacgtccgtacggtctagtcgtaccgacgtacccctccccgttggaccctagtacctaccggtcgggtacccttccggaaccgggtactcgggtaaacgggtagtacggaacgggttccttagttaacgttttattttccgtacggttaccctacggttacccttaaacggttaacgtaaccgtaaaccgtaccggtcccggttcgggggttacgttacccggggttacggggttaacgttacccggggaaccggggttaacggggaacccgtaacgggttacccggttacggttaacccggttaccgttaacccgggg

SEQ ID NO: 186757 - DNA, 817 bp, Homo sapiens
  misc_feature: GYAE6OF02H9TPU.22.87.H10.1.454.CMB.1.raw
  modified_base (193)..(193): a, c, t, g, unknown or other
  misc_feature (193)..(193): n is a, c, g, or t
tcagacatacgcgtcacgaccggtgctcgatttagcagtactgcgttgggtttgggggcttcagctgtgggcacaagaggcagcactcaggacaatcgtccagcagtggcctggtctcctctcctcctcactctcctcgctcactgctacgacggtacctcgggcccagtctgtgctgacacacgccgcctanaatactcggtcgggcccaggacagtaacggtcaccgactactcgcgtactacgtggtaaccaactaccaaactacgttcgggactaagttaacgtaagtcggaacttcggtaccgtacgttacgggtaacccgtagtaccgttaaaccgttaccgaaaacgttaaaacccaacccggtaaccccccggtaaaaccgtttaccctaccgttaaacttaccccgtaaggttaaaccgggttaaaacccaaaaccgtaaaccggttccccgggtaacccggttaccgggtaaaccgggggtttacccccgtaaggtaaccccgttaaacgttcccgttaccggttccggggtacccttaacccgtaacgggttccgtacgggtacctaggttcgtaaccgtaccggtaccccgttccgtaccggtaccttacgaccgtaccggtcgggtaccgtaccgacggtcgtaacggaagtcgtaggcggtacgttacgttacgtttctccgtcgaccgttattaccgtacgtacgtaacgtacgcgttaccggtcggtacgtaccgggttgttaacgggcgggtaccgggaacgtcccgaggtaccggtaccgtacccgtacggttaaccgg

SEQ ID NO: 186758 - DNA, 758 bp, Homo sapiens
  misc_feature: GYAE6OF02HM1PZ.22.87.H10.1.454.CMB.1.raw
  modified_base (567)..(567): a, c, t, g, unknown or other
  misc_feature (567)..(567): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacgagggtcctcgggcccagtctgtgctgacacagccgccctcaatatcgtacgggccccaggacagaaggtccaccactctcctgcacgtcgggtacaactccaacagtcgggactaagtactaagtgaactcgtaccctacgtacggtaacctacggacctaaccgttacccgaaacgaaaaccgaacccgtaacccccgtaaaacctcccgtacctactaaccttaagtaacggtaaaaccaaactaaacgtcccggtacccgttaccggacgggggttacccctacggtaaccggtaacctttccgttacgtaccggtacctaccgtaacgtcgtacggtcctagtccgttaccgacgtcccctccccgtggtacctaccgtcctaacggtcggtcccacggtcggtcgtaggtacgnggttacgacgggtcgttagttaacgttttcgttaccgtacgtacccgttagttccgttaacgacgtaaccgaacggttaccgtacccggggttgggtacccgtccggggtttacgtaggggttaccggggagggtaaccgggtaacggaacgttcccggtaaccggttacccgggtaccggttaacccggg

SEQ ID NO: 186759 - DNA, 525 bp, Homo sapiens
  misc_feature: GYAE6OF02IYEUC.22.87.H10.1.454.CMB.1.raw
  modified_base (162)..(162): a, c, t, g, unknown or other
  misc_feature (162)..(162): n is a, c, g, or t
  modified_base (242)..(242): a, c, t, g, unknown or other
  misc_feature (242)..(242): n is a, c, g, or t
  modified_base (273)..(273): a, c, t, g, unknown or other
  misc_feature (273)..(273): n is a, c, g, or t
  modified_base (287)..(287): a, c, t, g, unknown or other
  misc_feature (287)..(287): n is a, c, g, or t
  modified_base (436)..(436): a, c, t, g, unknown or other
  misc_feature (436)..(436): n is a, c, g, or t
  modified_base (441)..(441): a, c, t, g, unknown or other
  misc_feature (441)..(441): n is a, c, g, or t
  modified_base (453)..(454): a, c, t, g, unknown or other
  misc_feature (453)..(454): n is a, c, g, or t
  modified_base (456)..(456): a, c, t, g, unknown or other
  misc_feature (456)..(456): n is a, c, g, or t
  modified_base (459)..(459): a, c, t, g, unknown or other
  misc_feature (459)..(459): n is a, c, g, or t
  modified_base (462)..(462): a, c, t, g, unknown or other
  misc_feature (462)..(462): n is a, c, g, or t
  modified_base (480)..(480): a, c, t, g, unknown or other
  misc_feature (480)..(480): n is a, c, g, or t
  modified_base (491)..(491): a, c, t, g, unknown or other
  misc_feature (491)..(491): n is a, c, g, or t
  modified_base (500)..(500): a, c, t, g, unknown or other
  misc_feature (500)..(500): n is a, c, g, or t
tcagacatacgcgtcacgaccggtgctcgatttagcagtactgcgttgggtttggggacatataatgatgtccactggtaccagcaacttccagaaacagcccccaaactcctcatctatggtaacaacaatcggccctcaggggtcccctgaccgattccnctggctccaagtcctggcatgtcagcctccctggccagtcacgtgggcctccgaggctgaggatgaggctgatttattcngcccagtcctagtgaacaacagcctgggtcnccgtggtattcggnggaggaccaagctgaccgtctaggcacgcccaagcgtcgcccccgtggtacactccgtacgtccccgcctcctacacgtcgtactcgtccttgaggccgggtctacgggacctaaacgggtccgaactacgtacggatgacgtgcagtnatcanagatcatccatnnancgnganagcacgctcgatctgagnacgagtacacncacacgtanacgagcgacatacgtacgagtagtc

SEQ ID NO: 186760 - DNA, 628 bp, Homo sapiens
  misc_feature: GYAE6OF02HLIHQ.22.87.H10.1.454.CMB.1.raw
  modified_base (458)..(458): a, c, t, g, unknown or other
  misc_feature (458)..(458): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatcgtcggggcccagggacagaaggtccaccatcctcctgccactgggtacaacgtccaaacacgtcggggacaataataagtgtaatgtacccaacgtcggtaaccaggactaacttccaagaaaccacgaccccaaacctcctacatctatagtaacaacaacgtacggccctacgacgggtccctagaccgtacttctcgtcgtctaccagtacgtgcgtatcgtacacgtaccctcccgtacggccctaatctacgtcgggtccnccgacggtctaggagtagtaggcggtactagtatttacgtttacgtacgtcgtaacgttcctaagttacgacaacgacggtccgttagggggtcctaccggttgggtaaccgttggggtaccgggaacgggaccgtaacggaccgtacggtacccggttacgttaacggg

SEQ ID NO: 186761 - DNA, 661 bp, Homo sapiens
  misc_feature: GYAE6OF02JTPUP.22.87.H10.1.454.CMB.1.raw
  modified_base (130)..(130): a, c, t, g, unknown or other
  misc_feature (130)..(130): n is a, c, g, or t
  modified_base (192)..(192): a, c, t, g, unknown or other
  misc_feature (192)..(192): n is a, c, g, or t
  modified_base (253)..(253): a, c, t, g, unknown or other
  misc_feature (253)..(253): n is a, c, g, or t
  modified_base (293)..(293): a, c, t, g, unknown or other
  misc_feature (293)..(293): n is a, c, g, or t
  modified_base (295)..(295): a, c, t, g, unknown or other
  misc_feature (295)..(295): n is a, c, g, or t
  modified_base (333)..(333): a, c, t, g, unknown or other
  misc_feature (333)..(333): n is a, c, g, or t
  modified_base (491)..(491): a, c, t, g, unknown or other
  misc_feature (491)..(491): n is a, c, g, or t
  modified_base (507)..(507): a, c, t, g, unknown or other
  misc_feature (507)..(507): n is a, c, g, or t
tcagacatacgcgtcacgaccggtgctcgatttagcagtactgcgttgggtttgggggcttcagctgtgggcacaagaggcagcactcaggacaatctccagcatggcctggtctccctctccctcctcnctctccctgatcactgacacgtacgggtcccgtcgggccccagttcgtgtgcctgaccaccngccccgtccctacaatcgtccgccggggccccagggacaggaacggtccaccactcctccngcacgttacggaccaactccaactaggcgggcatagtaangncgtcagcggtcagtccatacagtaccacgtccccaacnctccagtcgtaactaggaacctaaagccctcggtaccccggtccgtagggtccctacgtaccgtacttcgttcgcgtaccctaccgtaacggtcctagggtaccacgtttcgccgtacccgtcccgtccccgttaaccggtcaaccgtcgtaacccgnggtaccgtacttcggngtacggagaccggtgtagtccgttaagtttcgttacgttccgtaacgtcccgttacgtactaccgtaagacctaacggtcgtaccgtgggtccggttcggttagggtccggttacgggacgtcgggaacgtagtacgtaccgtccgtcgtacgg

SEQ ID NO: 186762 - DNA, 680 bp, Homo sapiens
  misc_feature: GYAE6OF02JT0IM.22.87.H10.1.454.CMB.1.raw
  modified_base (164)..(164): a, c, t, g, unknown or other
  misc_feature (164)..(164): n is a, c, g, or t
  modified_base (656)..(656): a, c, t, g, unknown or other
  misc_feature (656)..(656): n is a, c, g, or t
tcagacatacgcgtcacgaccggtgctcgatttagcagtactgcgttgggtttgggggcgttcagctgtgggcacaagaggcagcactcaggacaatctccagcatggcctggtctcctctcctcctcactctcctcgctcactgcacacgggtcctgggcccngtctgtcgctgacacacgccgccctacaatactcgtcggggccccaggacagaaggtccaccatctcctgacacgtacggtacaacttccaactacgtaccgggctaagtataaatcgatcgtactacgtacggtacacgtactaacttaccaagaaccaaccgacccctaaactcctactacgtactagtacgtaacctaacacgccgtcccgtacgtaaccgggtccctacgtaaccgttcttacgttaccgagtcctaaaccgtacgtcgtcgtactagtcgtcgaccgtaccctcccgtacggtctaacggtccgtaacgtccggtaccggttaccgacggttaccgacggtaagggtcgttacggacggttacttacggttactttacgttacgtccgtacttaccggttacctagtacgtaacgacccgtgtacggtcggaccgggttacgtcggttacggtaggacggtaccggacggttaccgnggtaaccggtccgtaccgtaacgg

SEQ ID NO: 186763 - DNA, 726 bp, Homo sapiens
  misc_feature: GYAE6OF02I98LW.22.87.H10.1.454.CMB.1.raw
  modified_base (135)..(135): a, c, t, g, unknown or other
  misc_feature (135)..(135): n is a, c, g, or t
  modified_base (184)..(184): a, c, t, g, unknown or other
  misc_feature (184)..(184): n is a, c, g, or t
tcagacatacgcgtcacgaccggtgctcgatttagcagtactgcgttgggtttgggggcttcagctgtgggcacaagaggcagcactcaggacaatctcagcatggcctggtctcctctcctctcactctcctcnctcactgcacagggtcctcgggccagtctgtgctgacacagccacctanaatagtccgtcgggacccaggacagtaagtccacactcgtcacgtccacgtacggtaacaacctacaaacgtcggtacggactaatacttaagtagtacgtcgtactacgtacgtaccgaacaacctaacgtacaaacgaaacacctaacccctaaatccaccgtattacgaacgttagaaaaccacaacgttccgaccctaaggtaccggttaccaacgttacctacttccgttacgaccggtaccttaaaccgaacgttccggttacgggaacttaacgtcgtaaccgtacggtacccgtacccgtacggtacctaacgtaccggtacgtaccggtcgtaaccgacgggttacgacgggtaaggttaacgaggaacggtttacgtaacttacggtttacttctaaccggttacctaacgttaactacgtaaacgtacgaaacggttcgggttacgtccgggtaacggtacggtttacggtacggtaccgggtaacggaaaccggtacgtacgtaccggtacgtcccgttaacggacccgg

SEQ ID NO: 186764 - DNA, 840 bp, Homo sapiens
  misc_feature: GYAE6OF02GXJGF.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactcctcctcgctcactgccacgacgggtcctcgggcccagtctgtgctgacacgacgccccgtccctacaactacgttccggtaccgggggcccccaggtaccgaaggtaaccgggtccaacctacttccgtccctcggacctaacggtacggaacccgagtccgtaggttacggtaccggttttagggttaacgtttaacgttaaacttagtttccgttacccgtttaccgttaaccggtaaaccccaaacccgtaacccgaaccccgaaccggtaacccaaaaccccggtaccccctaaactaccgtaattaacggtttaactttaggacggtaccgtacctaacggtaacggccccgtacccggtacccgggtagggttaccccgtagtacgttacccgtctttaccgtcggttcgtaacccttcgtaaacgtcccggttaccggaaccgtaacccgtaccccgggtcccccttacccggtaccgttacccggtccggttccggtccgggtccgtaccgggaccgtcggtaacggtcggtagacggacggttcttacgttaccgtttactcggtacgtactacgtcctaaggtgtacggtaggaacgtcgacggtaaccgttgttaacggttcggggtacggttaccggagggacccgtaacggtacgtaccggttaccggtacccgttggtacccgtcggtaacccgg

SEQ ID NO: 186765 - DNA, 610 bp, Homo sapiens
  misc_feature: GYAE6OF02FU3KT.22.87.H10.1.454.CMB.1.raw
  modified_base (434)..(434): a, c, t, g, unknown or other
  misc_feature (434)..(434): n is a, c, g, or t
  modified_base (478)..(478): a, c, t, g, unknown or other
  misc_feature (478)..(478): n is a, c, g, or t
  modified_base (488)..(488): a, c, t, g, unknown or other
  misc_feature (488)..(488): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacacgcccgccctacaatactcgtcgggggacccccagggaccaggaacggtccaacctactcctccctgccacgtcgggtaaccaacctaccaacagtccggggcatataatgatcgtccagtcgtaccagacctaaccttaccaagaaaccaccgaccccaaactcctactactctagtacggtaaacaacaatccggccctacgacggggtcctcgaccgtacttctcgtcgtctaccagtcgtgactagtcgtacnccgcctccgtcgcctactcacgtcggcctccgaggtctaggagntacggcggtntacgttattcgttcgtcgcgttacgtacgtatagtaccacgacgtcggtacgggttcgccggttagggttacgtccgggtagggacggaaccgtaacggtccgacgtaccggtaccgtacgg

SEQ ID NO: 186766 - DNA, 818 bp, Homo sapiens
  misc_feature: GYAE6OF02G337D.22.87.H10.1.454.CMB.1.raw
  modified_base (175)..(175): a, c, t, g, unknown or other
  misc_feature (175)..(175): n is a, c, g, or t
tcagacatacgcgtcacgaccggtgctcgatttagcagtactgcgttggggtttgggggcttcagctgtgggcacaagaggcagcactcaggacaatctccagcatcggctggtctcctctcctcctcactctcctcgctcactgcacgagggtccgtgggcccagttctggtcnctagaccacgacgccccgcctacaattcgtccgtaccgggggccccaaggacgtaagggtaacggtacccaacctactcccgttccgtagtccaaccggtagggttaaccaaaccgtacccaaactacgggtaccggggaactaagttaacgttaaacgttaggaacttccggtaaccctacggttacggtaaaccaacggacccttaacgtaaccaaacgtaaacccgacctaaaccccccaacttcccacttacctacgtaacgtaacggtaaactaaccgtaaccgtcccggtaccctcgggaaccgggtccgtaccgtaaccgttacgtctaccggtacctaccgtaccgtaacgtcggtacgtacttacgtcgtacgtaccgtccccgtcggtaccgtactcgtaccgtacggttccgtacccgacggacggtacgacgggtacggtacggtcggaaccggttaggttaaccgttaccgtttttactaccggtaccgtccgttaacgttctaccggtacgaacggtaccgtacggttcggtacgggttccggttaacgggttcgttaccgggtaccgggacgggtaacccggttacgtacccgggtacccgttcggttaccccggttacgacccgggg

SEQ ID NO: 186767 - DNA, 749 bp, Homo sapiens
  misc_feature: GYAE6OF02IAY6R.22.87.H10.1.454.CMB.1.raw
  modified_base (190)..(190): a, c, t, g, unknown or other
  misc_feature (190)..(190): n is a, c, g, or t
  modified_base (552)..(552): a, c, t, g, unknown or other
  misc_feature (552)..(552): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgctacggaggtccgtcgggcccagtcgttgtgtacctacgaacgacncggcccgtaccctactaaactacgtccggtcggggacccccagggacacgggtaaacggtccacctacttcctaccgacgtaccgtacggttacgggtaaccctaacctacccgaactacggttccggggtactaagtaattaagtcgtaagttaccggtacctacgttaccggtaaccctaaggtaccctaaacttaccgaaacgaaaccgtacccgtacccccctaactccctactacttacgtaacgtaacgtaaccaacgtaccgtacccggtaccctcgggttaccggtacccgtacgtaccgtagttacccgcggtcggtacccttacggtacgttcggtagtctacgtcgtaccnccgtacccttccggacgtacctagtcccgagtccggtcgccggtacggacgtacgacgtaggtcgacgttcgtattaacgtcttaccgcgaccgttacgcttacgacgtacgtacgacgttaccgggtaggtccggtactaggtcccgttacggtcggggtacggacgtaccggacgttcgtacccggtctaacggg

SEQ ID NO: 186768 - DNA, 870 bp, Homo sapiens
  misc_feature: GYAE6OF02JV1WJ.22.87.H10.1.454.CMB.1.raw
  modified_base (174)..(174): a, c, t, g, unknown or other
  misc_feature (174)..(174): n is a, c, g, or t
tcagacatacgcgtcacgaccggtgctcgatttagcagtactgcgttgggtttgggggcttcagctgtgggcacaagaggcagcactcaggacaatctccagcatgcctggtctcctctcctcctcactctcctcgctcactgcacgaggtcctgggcccagtctgtgctgacncagccgcctacatatcgccgggcccagacagtacggcctaccatcctaccgtgccgtacggttacggaacctaaccgttacccaacacggtaccggggacctaagttaacgttaagtacggttaactacggtacccgtaaccgttaccgggaaccctacggtaaccgttacccgtttacccggtaaacgtaaaacccgaaccccggtaacccccccgtaaacccttacccccgttaacctaacgtttaaccggtaacgttaaccgggtaaaacccgtaaaaccgtaacccggttacccggtacccccgttaccggggttacccggggtttaaccccgtaccggtaacccgttaccgttccgttaccgttaccggtccgtaaccgttaaaccggttccgtacggtacccgtaggtaccggtaccgtaccggtcccctaccccggtccggtccctaacggtcccgtaccggttccggtacctaccgggtaccgtcgttaacgggacgggtacgtcgggtacgtcgtttacgtacgtttacggttacctccgggtaccttacgttacctagtacgaaccgtaaccggtaccgttcgggttaccggtcggggttcccttacggtaccgggttccgggaacggggttaccggtaccggaacggttcccggtaacccgttacccggtttacccggaaccggg

SEQ ID NO: 186769 - DNA, 672 bp, Homo sapiens
  misc_feature: GYAE6OF02HFJ4Q.22.87.H10.1.454.CMB.1.raw
  modified_base (167)..(167): a, c, t, g, unknown or other
  misc_feature (167)..(167): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctcctctcactctcctcgctcactgcacagggtcctggcccagtctgtnctgacacagccgcctacaatatcgtcgggaccccaggtacagaacggtcaacctatcctcctgccacgtagggtaccaactccaacacgtcgggcatagtaatgactcgtaccacgtcgtaaccgagtacctaacttaccaagtaaaccaccgacccctaaactcctacaacttacctaagtacggtaaaccaacgtaacgtccggtaccctacggaccggggttacctacggtaccgtattccgtacgtacggtacctaccgtaacgtcgtcgactagtacgcgtacgtccctaccgtcgacctacgtccgtacgtcgggacctaccgtaggtcctagggtagacgtacggagtaccgtaggttaacctttcgtttaccgtcgtaccgttacgttaccgtacgtaacggaacctacgtacggccgttcgggtccggtacggttacggtacgttaccggggacgtaaccgggactaacgtcgtaccggtacccgtcggtaaccgg

SEQ ID NO: 186770 - DNA, 1020 bp, Homo sapiens
  misc_feature: GYAE6OF02FMFIK.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacgacgggtcctcgggccctaggttctggtcgacgtacgaccaacgacgcccgtaccctacaaattaccgttccggtaccgggggacccccaaagggaacccgtaagggtaaaccggtcccaaccctaacgtttcccttacccgtacggtaccgttaaccggttaaccgggggttaaaccctaaacccgttaaccccgtaaacggtaaccggggttaacccgggggggtaaccttaaaccgttaaaaggtttaaaccgtacggttaaccggttttacccggttaacccggttaaaccggtttacccggggttaaccccgtaacgtaacccgtttaaaacccctttaaaccccggaaaacggtaaaaacccccgaaccccggtaaacccccctaaaaaccggtttcccccgtaacgttaaccgttaacccggtttaaaacggttaaaccggggttaaaaacctaaaacccggttaaacccgttaccccggggttaacccccggtttaacgggggttaaaccccccgggggttccgtttaaaccgggttaaacccggtttaaccgtttacccgttaccgggtacggtacccgtttaaacccgttaccgggttccgtacgggtacctaaccgggttcgtaaccggtacccgttccccgttaccggtccgtaaccacgttacccgtcggtcggtaccttaccgggcgtacgtaacgggtaggacgttaccgggtagtcggttaacttacggtttactccgtacgtaccgtacctctaacggtacaactcgtacggttcgacgggtcgttcggtacggtacggtccgggtaaccggacggtaccgtaccggtacggttaccggaccgttaggtaacccgg

SEQ ID NO: 186771 - DNA, 789 bp, Homo sapiens
  misc_feature: GYAE6OF02GTSBJ.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacgtacgggtcctgggcccagtctgtgctgacacacgcccgccctacaattacgtcgtcggggaccccaggacaaggtaacggtccacctactcctcctgccacgtacgggtaacaacctaccgaaaccgtacggtccgggggacctaaattaacgtaaaacgtggtactaccggttaccctacgttacgggttaaccacggtaacctaacccgttaccgaaacgtaaaccaacccggtaacccccaacttccctacacttactaacgtaacggtaaaccaaacgtaccgaccgtacccggttaccggaccggggtaccctaccgtaaccgggtttacttacccgtacgggtcgtacccgttaccgtaacggttcgtacggacttacgtccgtacctacggtaccccctccggtccgtacctaacctacgtaccgttcccgggtaccttccgggacgggtaccgttacggacggtaccgtaggggtaccggtagttacggttaattttttaccgtcgttacctacggtttacttcgtaacgtacgtaaccaacgttaccgtcggtacgggtcggtacggtttacgggtacggttaccggggacggaacggacgtaccggaccgtcggtacccggtcgtaaccgg

SEQ ID NO: 186772 - DNA, 847 bp, Homo sapiens
  misc_feature: GYAE6OF02FT0RJ.22.87.H10.1.454.CMB.1.raw
  modified_base (753)..(753): a, c, t, g, unknown or other
  misc_feature (753)..(753): n is a, c, g, or t
tcagacatacgcgtcacgaccggtgctcgatttagcagtactgcgttggggtttgggggcttcagctgtgggcacaagaggcagcactcaggacaatctccagcatggcctggtctcctctcctcctcactcctcctcgctcactcaccacgagggtccctcggggccctagtccgtgtcggtctagaccaacgacgcccgtaccctactaaacttcgtccggtaccgggacccccgaaggaaccgaggtaaacgggtcctaacccgtacttcccgtacccgttcggaccgttaaccggtaacggggtaacctaaaccccgttacccgtaaaccgtaccgggttccggggtaacctaagttaattaaacgtaggtaccgttccgtaccgttaccggtaaccggtacccgtaagtaaccccgttaaaccgttaaccgaaaccgaaaacccgtaaccccccggaaccccctaaaaccgttccctaacgttacgttaaccttaacgtaaccgtaaaacctaacgtaccgtccccggtacgtaccggggtaccgggtaccctacggtaaccgtttacgttccgtacgtccggtaccttaccgtacgtccgtacgtcctagttcctaccgccgtacccgtccgtaccgtcctaagtaccggtcccgtaccggtccgaacgggtcgtacggtcggacggtagttaccgggtacgtacgttagttaatttcccggtagtcccgtacgttacgtaccttanaccgtaccgacgtcggtacggcggttagtaccgggttagtccgggtacggaccggacgtaaccggcgttaaccggtccgtacgtaccggtccgg

SEQ ID NO: 186773 - DNA, 779 bp, Homo sapiens
  misc_feature: GYAE6OF02JRORP.22.87.H10.1.454.CMB.1.raw
  modified_base (160)..(160): a, c, t, g, unknown or other
  misc_feature (160)..(160): n is a, c, g, or t
  modified_base (179)..(179): a, c, t, g, unknown or other
  misc_feature (179)..(179): n is a, c, g, or t
  modified_base (193)..(193): a, c, t, g, unknown or other
  misc_feature (193)..(193): n is a, c, g, or t
  modified_base (342)..(342): a, c, t, g, unknown or other
  misc_feature (342)..(342): n is a, c, g, or t
  modified_base (362)..(362): a, c, t, g, unknown or other
  misc_feature (362)..(362): n is a, c, g, or t
  modified_base (629)..(629): a, c, t, g, unknown or other
  misc_feature (629)..(629): n is a, c, g, or t
tcagacatacgcgtcacgaccggtgctcgatttagcagtactgcgttgggtttggggcttcagctgtgggcacaagaggcagcactcaggacaatctccagcatgcctggtctcctctcctctcactctcctcgctcactgcacagggtcctcgggcccngtctgtcggctggacacgngccgtcctacaatntcgcgggacccaggactaggaacggtccaacgtactcctcgtcgccgtacgtcggtaccaacttaccaacgtacgtccggggactagtaacgtaagtggtactcgtacctaacgtcggtaacccagtacctaacttccaacggaaaccnccgacccctaaactcccgtntaactcgtttaacgcggttaaaccaacgtacgttacccgccgtacgggaccgggtttccacgggtaccacgttttccaacgtccggtactaacccggtaacgtcgtaacgggtaccttcgtacggtccctaaggtccccgttccggacccacggtacttcccgcggtacggtccctacggtacggtcgtaacgacgggtaacttcgggaacgtcgttaacggtcttttaaccgtcgtaacccggtccgttaacgttaacccgttacncgttaaaacccgtacgacgggttttccccggtaggggtaacccggttccggttaaacgggtttcccgggtaaaccgggggcccggttaaaacggttacccggacgtttttacccccggaccgggtttacccgtcccggtttaaccccggg

SEQ ID NO: 186774 - DNA, 735 bp, Homo sapiens
  misc_feature: GYAE6OF02G7UNV.22.87.H10.1.454.CMB.1.raw
tcagacatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctggcccagtctgtgctgacacgagcccgccctcaatactcgtcggggcccccagggacaggaacggtccaccactcctccgtacgacctacgtacgggtaaccaaccgtaccaacgaggtcggggacaattaagttaaactggtactcgtaccacgttacggtaaccacgactaacctaccaagaaaccacccgtaccccaactcctactactacgtaacgtacggtaaaccaaacgtacgtccgacccgtacggtacgggtccctacggacctacgttctcgtacgtacctacgtacgtcgtcgactacgtcgtactaccgtcccttccgacgtacctactccgtaccggtaccggtccgtaaccgacgggtcgtaaggtaacgggagttaccggtacggtacgtttacgttaacgttttaccgttacgtccggtaccttacgttaccgttaacgtacgtaacctaccgacgttacgggtccgggtcgttaccggggtttaggttacccgggtccggtaaccggggtaccgggaaccgttacggtcccggttaacgggtacccggttaccggtaacccgg

SEQ ID NO: 186775 - DNA, 728 bp, Homo sapiens
  misc_feature: GYAE6OF02JTAWC.22.87.H10.1.454.CMB.1.raw
  modified_base (193)..(193): a, c, t, g, unknown or other
  misc_feature (193)..(193): n is a, c, g, or t
tcagacatacgcgtcacgaccggtgctcgatttagcagtactgcgttgggtttgggggcttcagctgtgggcacaagaggcagcactcaggacaatctccagcatggcctggtctcctctccgtctcactctcctcgctcactgacacgtagggtcctgggcccagtctgtgactgaccgacggccgccctanaactcgtcgtcgggccccaggacaggtaacggtccaactactcctccgtgacctaccgttgggtaaccaacctccgaacgtacggtcgggactataataagtgtactacgtcctacgttcggaccagtacctaacctaccgaacgaaccaccgaccccgtaaacctcctacctaacgtacttacggtaacgtaaacaacgtaaccgtccgtacccgtacgtacccggggtacctacgtaaccgtctttaccgtaccgtcggtaccttaccgaacggttcctaggtcctacgttacgaccgtaccgtcccgtccgtaccgtaccgtctaccggtaccgtccggtacctacgacggttcgagggtaaccgtagttacgggacttcggttatttacgttacgtttcaccgtaccgttcgtaccttagaccgtaacgtaccgtcgcgggtttcggtccggtacgttagggttaccggtcgggtaaccggaacggtcctaaccggggtcccttagggaccccttcgggtaaccggtaccg

SEQ ID NO: 186776 - DNA, 514 bp, Homo sapiens
  misc_feature: GYAE6OF01A1M9X.10.33.C11.1.454.CMB.1.raw
  modified_base (490)..(490): a, c, t, g, unknown or other
  misc_feature (490)..(490): n is a, c, g, or t
  modified_base (509)..(510): a, c, t, g, unknown or other
  misc_feature (509)..(510): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcagtcaggacatttacaagtctttaaattggtatcagcagaaaccagggaaggcccctaaactcctgatctacgatgcatcgaacttggaaacaggggtcccagtcaaggttcagtggaggtggatcgtgggacagtattttactctcggcatccgcagcctgcagccctgaacgtattttgcgtactattattactgtacaacagtatagaaatcgtcccgctctacgttcgggacgggggaccagggtgagttacaaacgtacgtgnggctgcacactctgtcttnntccg

SEQ ID NO: 186777 - DNA, 559 bp, Homo sapiens
  misc_feature: GYAE6OF01AOJ9Y.10.33.C11.1.454.CMB.1.raw
  modified_base (222)..(222): a, c, t, g, unknown or other
  misc_feature (222)..(222): n is a, c, g, or t
  modified_base (416)..(416): a, c, t, g, unknown or other
  misc_feature (416)..(416): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggnagtcaggacatttacaagtctttaaatggtatcagcagaaaccagggaaggcccctaaactcctgatctacgatgcatcgaacttggaaacagggtccatcaaggttcagtggaggtggatcgtgggactagtattttactctcggcatccgcagctgcagcctgaagtatttgcgacatattactagtacaanagttaatagtaaaatcgtacccgtcttccgtaacgtttcggggacgggggaaccgaagggttcggtaacgttaccgaaaacggtaacgttaggttacggcgtacggacctacctacgtcttagttccttcgtacgtttccccg

SEQ ID NO: 186778 - DNA, 507 bp, Homo sapiens
  misc_feature: GYAE6OF01B5VPF.10.33.C11.1.454.CMB.1.raw
  modified_base (501)..(501): a, c, t, g, unknown or other
  misc_feature (501)..(501): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaatggtatcagcagaaaccagggaaggcccctaaactcctgatctacgatgcatcgaacttggaaacagggtccatcaaggttcagtggaggtggatcgtgggacagtattttactctcggcatccgcagcctgcagcctgaagtattttgcgtacatattactgtcaacagtatgaaatgtcccgctctacgtttcggcgggggaccaagggtggagttacgaaacgacgtgtggctgcaccatctgtcttcnttcccg

SEQ ID NO: 186779 - DNA, 624 bp, Homo sapiens
  misc_feature: GYAE6OF01B7T4Z.10.33.C11.1.454.CMB.1.raw
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatccacttggccgggcgagtcaggactatttacaagttactttaaagttggtatcagacaagaaaccgagggaacgtacccctaaactcctagactcacgatgacatacgaacgttaggaaacgtcgggtaccatacgtaaggttcgaggtgggaggtgatcgtaggactagtactttactcgtcgctactccgcacgcctgctacgtccgtagtaacgtgtttacgacgtaactattacgttactagtaacaacgtaagttataacgtaaacgttccgtacccgtactaccgttacggtttaccgggggaccggggtaacctaaggggttacggtacgttaaccgaaacggttacgttagggtacggtcgtacgacctaaccgtacttcgttacgttccttcgtaccgttccccg

SEQ ID NO: 186780 - DNA, 724 bp, Homo sapiens
  misc_feature: GYAE6OF01C760J.10.33.C11.1.454.CMB.1.raw
  modified_base (319)..(319): a, c, t, g, unknown or other
  misc_feature (319)..(319): n is a, c, g, or t
tcagcatagtagtgcacgaccggtgctcgatttagagtgagctcggttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcagtcaggactattaacagtctttaaatggtatcagcaagaaccgagggaacgtacccctaaactcctgatctacgatcgcatcgaacttggaaacngggtaccatcgaaggttcaggtggaggtggatcgtagggactagtacttttacgcgtcggactacgtccgcgtacgtcctcggacacgtcctacggtaaagttacgtttttacggacggttaactacggtttaactttaaccgttacggttacctaaacggtagttaaagttaacggttaaaaacgttccgggttaacccccgttacgttaacccggttaaccggtttttacccgggggggaccgggggggttaaacccgtaacggggggtttcgggtaaacccggtttaaccgaaaaaccgggttaaccggttacgggttaacgggggtacccttaccgggaacccgttaacccgttaacggtttcccttaggtttaccctttccggtacccttttacccccgg

SEQ ID NO: 186781 - DNA, 611 bp, Homo sapiens
  misc_feature: GYAE6OF01D376Y.10.33.C11.1.454.CMB.1.raw
  modified_base (196)..(196): a, c, t, g, unknown or other
  misc_feature (196)..(196): n is a, c, g, or t
  modified_base (397)..(397): a, c, t, g, unknown or other
  misc_feature (397)..(397): n is a, c, g, or t
tcagcatagtagtgcacgaccggtgctcgatttagagtgagctcgttgggtttgggggagtcagtcccaaccaggacacagcatggacatgagggtccctgctcagctcctgggctcctgctcctctggctctcgggtgtcagatgtgacatccagatcgacccagtctccatcctcctgtatgcatctgtagganacagcgtcacatcacttcggccggcgagtcgaaggtactatttacaagttactttaaagttggtatcagacaagaaaccgagggaacgacccctaaactcctagactctaacgatcgactatacgaacttaggaaacgtcgggtacccaagtaccgtaaggttcaggtaggaggtagagtcgtaggactagttactttacncgtcggactacgtccgcacgccgtagcacgtcctagaagttatttcgacgtatacttagttactagtaactaacgtagtaataacgaaacttcgtaccccgtacgtaccgttacggttccggggacggggtaaccgtaagggttacggtacgttaacgaaaaccggtacgtggtacggtccagccaacgtcttctagttcctctccgttccccg

SEQ ID NO: 186782 - DNA, 515 bp, Homo sapiens
  misc_feature: GYAE6OF01BMCLF.10.33.C11.1.454.CMB.1.raw
  modified_base (488)..(488): a, c, t, g, unknown or other
  misc_feature (488)..(488): n is a, c, g, or t
  modified_base (508)..(509): a, c, t, g, unknown or other
  misc_feature (508)..(509): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcagtcaggacatttacaagtctttaaattggtatcagcagaaaccaggggaaggccccctaaactcctgatctacgatgcatcgaacttggaaacaggggtcccatcaaggttcagtggaggtggatcgtgggacagtattttactctcggcatccgcagcctgcagcctgaagtattttgcgactatattactgtcaacagtatgaaaatcgtacccgcttcacgtttcgggacgggggaccaagggtggagttcgaaacgactgnggctgcacctatctgtcttnnttcccg

SEQ ID NO: 186783 - DNA, 612 bp, Homo sapiens
  misc_feature: GYAE6OF01AVBDG.10.33.C11.1.454.CMB.1.raw
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggactatttacaagtctttaaattggtatcagcagaaaccagggaacggcccctaaactcctgactctacgatgcatacgaacttggaaacgagggtacccatcaaggttcagtggaggtggagtcgtgggactagtattttactcgtcggcagtccgcacgcctgcacgcctagaagtattttgacgtactaagttactttacgtgtacaacgtaagttaatagtaaaagttcgtaccccgtcgttaccgttaccggtttccggggaccggggggtaaccgtaaggggtcgggtaaacggttaaccgaaaaccggttaacgttagggtacggtcgtacggacctaaccgtacttccgttagttcccttcgtacgtttaccccg

SEQ ID NO: 186784 - DNA, 792 bp, Homo sapiens
  misc_feature: GYAE6OF01DOHFL.10.33.C11.1.454.CMB.1.raw
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatcgacccagtcctccatccctccctgtatgcatctgtaggagacagcgtacaccatcacgttcggccgggcgagtcgaggactatttaacaagttacttttaaattggtatcagacaagaaaccgagggaacggacccctaaactcctagactctacgatcgcatcgaacgttacggaaacgacggtaccatacgaaggttcgaggtaggacggtaggactcgtaggactagtatttacgtcgtcgctacgtccgcacgtcctgcgacgtccgtagtaacgttacgttttacgaccgtaacttacgtttaacgtttacgttacgttaaccgtaaaccgtaggttaaacgttaacggttaaaaacgttcccggtttacccccgtacccggtttacccgttaaccccggggtttacccgggggggttaccgggggggtaaaccccgggttaagggggtaaccggggtttaaaccgggtttaaacccgggtaaaaacccggtaaaaccgggtttaccggggtttaccggggttacccggttacgggtacccccgttaaaacccccggttacgttttaccccggttttagggttttacccccgttttaacccgttaacccgtttttaaccccccccgg

SEQ ID NO: 186785 - DNA, 569 bp, Homo sapiens
  misc_feature: GYAE6OF01BQ76V.10.33.C11.1.454.CMB.1.raw
  modified_base (222)..(222): a, c, t, g, unknown or other
  misc_feature (222)..(222): n is a, c, g, or t
  modified_base (352)..(352): a, c, t, g, unknown or other
  misc_feature (352)..(352): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggngagtcaggacatttacaagtctttaatgtatcagcagaacaggaacggccctaaactcctgatctacgatgacatcgaacttaggaaacgacggggtaccagtacaaggttcaggtgggaggtggatcgngggacagtattttacgctcggcagtccgcacgcctgcagcccgtagaagtatttgacgtactattattactgtacaacagttaatagtaaatcgtacccgtcttaccgtacgtttcgggacgggggtaaccgaagggtcggaacggttaccgaaaccgtaacgtaggttacggcgttacgaccgtacctacttctacgttccttcgtacttaccccg

SEQ ID NO: 186786 - DNA, 535 bp, Homo sapiens
  misc_feature: GYAE6OF01ADH3J.10.33.C11.1.454.CMB.1.raw
  modified_base (315)..(315): a, c, t, g, unknown or other
  misc_feature (315)..(315): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcagtcaggacatttacaagtctttaaattggtatcagcagaaaccagggaaggccccctaaactcctgatctacgatgcatcgaacttggaacngggtccatcagtcagtggaggtggatcgtggactagtattttactctcggcactccgcagcctgcagcctgaagtattttgacgactatattactgtacaactagtatagaaacttgtaccccgtctccgtacgtttccgggacgggggtaccaagggtggtacgttacgaaacggtacgtaggtggtcgtcgcacctacgtctagttcttcgcttcccg

SEQ ID NO: 186787 - DNA, 593 bp, Homo sapiens
  misc_feature: GYAE6OF01D4CCM.10.33.C11.1.454.CMB.1.raw
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcaagaaaccagggaacggcccctaaactcctgatctacgatgcatacgaacttggaaacaggggtcccatcaaggttcaggtggaggtggatcgtgggacagtattttactctcggctatccgcacgcctgcagtcctgaagtattttgacgtactaattattactgtacaactagtataagaaaattcgtacccgtctaccgtacggtttcccggggacgggggtaacccgtaagggtcgggtaacggttaacgaaaaccgggtaacgttggtacggtcgtacggacctaacccgtaacttcgttacggtttacctttccgtactttcccccg

SEQ ID NO: 186788 - DNA, 693 bp, Homo sapiens
  misc_feature: GYAE6OF01C2ZKR.10.33.C11.1.454.CMB.1.raw
  modified_base (198)..(198): a, c, t, g, unknown or other
  misc_feature (198)..(198): n is a, c, g, or t
tcagcatagtagtgcacgaccggtgctcgatttagagtgagctcgttgggtttggggagtcagtcccaaccaggacaaagcatggacatgagggtccctgctcagctcctgggctcctgctcctctggctctcgggtgtcagatgtgacatccagatcgacccagtctccatccctccctgtatgcatctggtagganacagcgtacaccatcacgttcggccgggacgagtccgaggactatttaacaagttactttaaagtggtatcagcaacgaaaccgagggaacgacccctaaactccgtagactacgtacgatcgacagtacgaacgttaggaaacgacgggtacccaagtaccgtaaaggttcgaaggttaggaggtagacgttcggtacgggaactagttaacgtttttaccgcgttaccgggactaacgttcccgacgtacgtacccgtagaccgtacgtacccgtaaggtaaagttacgtttaggaactaactagtttaattacgtcgtaactaaacgtagtaacgtaagtaaacgtccgtacccgtacttacggttaccggttacggggaccggggtaactaggggtacgacgttaaaccgaaacggtacgttgggtacgacgtaggaccctaacgttacgttccgttacgtaccctttacgtacgttccccgtttaccccg

SEQ ID NO: 186789 - DNA, 623 bp, Homo sapiens
  misc_feature: GYAE6OF01AI06R.10.33.C11.1.454.CMB.1.raw
tcagcatagtagtgcacgaccggtgctcgatttagagtgagctcgttgggtttgggggagtcagtcccaaccaggacacagcatggacatgagggtccctgctcagctcctgggctcctgctcctctggctctcgggtgtcagatgtgacatccagatgacccagtctccatccctccctgtatgcatctgtaggagacagcgtcaccatcacgttgccgggcagtcaggactatttacaagttctttaaagttggtatcagcaagaaaccgagggaacgacccctaaactcctagatctacgatcgacatacgtaacgttggaaaccgtacgggtacccatacgaaggttcaggtggaggtgagtcgtaggactagtacttttacgcgtcggctacgtccgacacgcctcgctacggtacccgtaggtaacgttacgttttcgacgtaacgtattaacgtttacgtagtactaacgtagttaactaagtaaacttcggtaccccgtagttaccgtacggtttaccggggaccggggtaaccgtaagggtcggtaacggttacgaaacggtaccgtggtacggcgtcgacctacgacgttcttacgttccttcgacttccccg

SEQ ID NO: 186790 - DNA, 601 bp, Homo sapiens
  misc_feature: GYAE6OF01DRTT8.10.33.C11.1.454.CMB.1.raw
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctcctgtatgcatctgtaggagacagcgtcacatcacttgccggcagtcaggactatttacaagtcttaaatggtatcagcaagaaaccagggaacggacccctaaactcctgactctacgatgacatacgaacttaggaaacacggggtccaagtcgtaaggttcaggtggaggttggatcgtaggactagtatttacgtctcggcactccgcacgcctgcacgcctagaagttattttcgacgtactaattagttaactacggtacaaactagttaatagtaaaactcgtacccgtacttaccgtacggttaccggggacgggggtaaccgtaagggtacggtacgttaacgaaacggtaaccgttaggtacggtcgtacgacctaccgtattaccgttagttccgtttactacgtttacccccg

SEQ ID NO: 186791 - DNA, 660 bp, Homo sapiens
  misc_feature: GYAE6OF01ANVJ3.10.33.C11.1.454.CMB.1.raw
  modified_base (229)..(229): a, c, t, g, unknown or other
  misc_feature (229)..(229): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctccctctggctctcgggtgtcagatgtgacatccagatcgacccagtcctcctatccctccctgtatgcatctgtaggagacagcgtccaccatcacttggccgggngagtcgaggactatttacaagttactttaaagttggtatcagacaacgaaaccgagggaacggacccctaaactcctagactctacgatcgactactaccgtaacgttacggaaaccgtacggggtacccaataccgtaaggttacgaggtagggagggtggacgtcggtagggacgtaagttacttttactcgtcggctacgtccgcacgtcctcgcgacgtcccgtagtaacgtagttttacgacgtaactaattacttactacgtactaacgtagttaactaagtaaacttcgtacccgtcttaccgttacggtttaccggggaccggggtaacgtaagggtacggtaacgttaccgaaaccggtacggtaggtacggtccgtacgtaccacccgtacgttacgtaccgttcttccgtacgttccccg

SEQ ID NO: 186792 - DNA, 622 bp, Homo sapiens
  misc_feature: GYAE6OF01CJS5R.10.33.C11.1.454.CMB.1.raw
  modified_base (405)..(405): a, c, t, g, unknown or other
  misc_feature (405)..(405): n is a, c, g, or t
  modified_base (592)..(592): a, c, t, g, unknown or other
  misc_feature (592)..(592): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcagtcaggacatttacaagttactttaaagttggtatcgaagcaacgaaaccgagggaacgacccctaaactcctagatctaacgatcgactatacgaacttagggaaacgtacggggtacccaagtcgtaaacgggttcgaggtacgggagggtaggtatcgtagggactaggtacttttacnccgtcggcacgtcgcacgcctgcgagtcctagtaacgtagtttcgacgactagttattacgtgtacaacgtagtagtaacgtaaactcggtacccgtacttacgttaccggttacggggaccgggggtaacctaggggtacgttacgtaacgaaacggtaaccgtggtcggctacggcctaaccgtnttaccgtagttccttacgtcgtttaccccg

SEQ ID NO: 186793 - DNA, 743 bp, Homo sapiens
  misc_feature: GYAE6OF01C87JL.10.33.C11.1.454.CMB.1.raw
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
tcagcatagtagtgcacgaccggtgctcgatttagagtgagctcgttggggtttgggggagtcagtcccaaccaggacacagcatggacatgagggtccctgctcagctcctggggctcctgctcctctggctcgtcgggtgtcagatgtgacatccagatcgacccagtcctccactccctcctgtatgctatcgtggtaggagacgacgtccgtccaacctntcctacgttcggccgggngagtcgaggactatttaacaagttactttaagttgtatcagacaagaaaccgagggaacgacccccttaactcctagactactacgatcgactacgtacgtaaaccgttacgggaaaccgtacgggtaccctagtacgtaaggttacgagggtgggtaggtacggtagtggtacggggtaacgttacgttacgttttaccgtacgtaccggtactaccgtacccgacgtaccggtcccgtggaccgtacggtaccgttaagtaacggtttactttacggacgtaacttactttaacgttacttaccgtacctaaacgtacgttaagtaacgttaaacgttccggttaccccccgtacgttaccgggttacccggtttacccggggggaccggggaacggtacggggtacggtaaaccggtacgtaaaccggtacgtgggtacggccgttaccgacccgtacctacgttaccgttcgttacccttccgtaccgtttcccccg

SEQ ID NO: 186794 - DNA, 675 bp, Homo sapiens
  misc_feature: GYAE6OF01BLK09.10.33.C11.1.454.CMB.1.raw
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctggtggggacagagtcatcatcacttgccgggccagtcagacgtttaataagttggttggcctggtatcagaagaaaccagggaaacgccccgaaactcctgactccatactcgcctcctacgtttggctaaggtcgggtcccagtcgaaggttcaggcggcaggtcggagcgtgggacagtacgtcactctcgagtactcgagcacgcctcgcacgtcctgattgttaattttcgaccttaaaccttatttactttacgtaactaaactaattaacttacgtaaaccttaccgtttaactttacccctaactttttacccgtttacccgttttacccggggaccccgtttaaccgggggtaaaacccgttaaacgggtttaccgggttaaaccctttaaaccccgggtaaaaacccggttaaccggtttaaccggggtacggttacccgtacggttaacccgaacccttacgttcccgtttacgg

SEQ ID NO: 186795 - DNA, 653 bp, Homo sapiens
  misc_feature: GYAE6OF01D9JY8.10.33.C11.1.454.CMB.1.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (263)..(263): a, c, t, g, unknown or other
  misc_feature (263)..(263): n is a, c, g, or t
  modified_base (292)..(292): a, c, t, g, unknown or other
  misc_feature (292)..(292): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcggggtgtcagatgtgacatccagatcgacccagtctccatccctcctgtatgcatctgtagganacagctcacatcacgttgccgggnagtacagactatttacaagttactttaaagtggtaatcancaagaaccgagggaacgtacccctaatcngactcgagtatgactagtaccgtaagtaaggaaacggtaccggtcctaaaggtcaaacggtttcggaaggttagggaggttcggagtacggttagggaacttacgtactttacgcgtacggtccacgtccgctacgcctagcctagtctagtacgtagtttacgacgtactaacgttactacgtacgtactaacgtagttaaactacgtaaacttcgtacccgtattaccgggttacgggttacgggtacgggggtaacgtaagggttacggtaaacgttaaccgaaacggttacgtacgggttaggtccgacggtaacctaacgtcgttacgttacctacttcccgttaacgttcccccg

SEQ ID NO: 186796 - DNA, 808 bp, Homo sapiens
  misc_feature: GYAE6OF01C3J38.10.33.C11.1.454.CMB.1.raw
  modified_base (223)..(223): a, c, t, g, unknown or other
  misc_feature (223)..(223): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctcgtcgggtgtcagatgtgacatccagatgacccagtctccatcctccctgtatgcatctgtaggagacagcgtcaccatcacttggccggngagtcaggactatttacaagttactttaatggtatcagacaagaaaccgagggaacgacccctaaactcctagactctacgatcgactatacgtaacgttagggaaaaccgcggggtacccaacgttacgtaaacggttacgtaagggtagggtagggtaggtaacgttcggtagggtaacctaagttacgtttttacgcggttacggtcctacgttcccgacgtaacgtcccttggaccgtaacggtccccgttaaggaaaggtttacgtttttcggaccgttaacgttaactttaacgtttaccgttacgtttaacctaaacgtaaggtttaacgttaaacggtaaaaaccgttttcccggttaccccggttacccgttaccggtttaacccggggttttacccgggggggacccgggggggttaaaccggtaaacgggggtttaccgggttaaaccggtttaaccggtaaaaaacccgggttaacgggtttacggggtacggggttcccgttaacgggtacccctaaccgttaccgtttacgttaccggttttacctttacccgttaaccgttttccccccg

SEQ ID NO: 186797 - DNA, 764 bp, Homo sapiens
  misc_feature: GYAE6OF01BUW87.10.33.C11.1.454.CMB.1.raw
  modified_base (203)..(203): a, c, t, g, unknown or other
  misc_feature (203)..(203): n is a, c, g, or t
  modified_base (447)..(447): a, c, t, g, unknown or other
  misc_feature (447)..(447): n is a, c, g, or t
tcagcatagtagtgcacgaccggtgctcgatttagagtgagctcgttgggtttggggagtcagtcccaaccaggacacagcatggacatgagggtccctgctcagctcctggggctcctgctcctctggctcgtcgggtgtcagatgtgacatccagatcgacccagtctccatccctccctgtactgctatctaggtagganacagcgtcaaccatcacgttcggccgggacgagtccaaggtactaatttactaagttactttaaagttggtatacgaagacaagaaaaccgagggaaccgacccctaaactcctagactactacgatcgactatacgtaacgtaggtaaacgcgggtaccagtacgtaaggtcgtaggtgggaacgggtgaacgtacggtaggactaagttacttttacgtcgtacggtactacgtaccgtacncgtaccgtcgacgacgtaccgtaaggtaacgttagttttcgaccgtaaacgttagttaaacgttacgtaacgtaacctaaagtacggtttaaacgtaaaggtaaaacgttcccggttaaccccccggttattaaccccggttacggggtttacccgggggaaccggggggtaaccgttaaacggggtaacggttacccggtttaaaaccgaaaacccgggttaaaccgttggggttaaccgtacccggtaccgtaaacccgtaccgttaaaccttcccggtttacggttaccctttaccgtaacccgtttacccccg

SEQ ID NO: 186798 - DNA, 821 bp, Homo sapiens
  misc_feature: GYAE6OF01A17Y3.10.33.C11.1.454.CMB.1.raw
  modified_base (199)..(199): a, c, t, g, unknown or other
  misc_feature (199)..(199): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatcgacccagtcctccatcctccctgtatgcatctgtagganacagcgtcaccatcacgttcgccgggcgagtcgaggtaactagtttaactaagttactttaaagttggtaactcaagacaagaaaaccgacgggtaaccgtacccccgttaaactcccgtagtacttaccgtaccgtatcgactacgtaccgtaacgtaggaaacgtacgggtacctagtacgtaaggttcgtaggtagggtacggtaggtaacgtcggtaggtactaggttactttttacgtccgtacggacctaacgtcccgacgtacgtccgtcgaccgtacgaccgtaagtaacgttacgttttacgacgttaactaagttaactttaacgttacgtaacgtaaacgtaacgttaacgtaaacgttaaaccgtaccggtttaccccggtaccgtttaacccgggtttaaccgggtttacccggggggtaccggggggtaaacccggttaaacgggggttaccggggttaaaccgggttaaacccggtaaaaccggggtttaaacccgggttacggggtttaaccgggtacccgttaccggtaaccccggttaaacccgttacgtttaacccggtttacccgtttacccggtttacccgttaacccgtttaccccccgg

SEQ ID NO: 186799 - DNA, 635 bp, Homo sapiens
  misc_feature: GYAE6OF01AF12L.10.33.C11.1.454.CMB.1.raw
  modified_base (205)..(205): a, c, t, g, unknown or other
  misc_feature (205)..(205): n is a, c, g, or t
  modified_base (310)..(310): a, c, t, g, unknown or other
  misc_feature (310)..(310): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatcgacccagtcctccactccctccctgtatgcatcgtgtaggagacngcgtcaccatcactggccggcgagtcaggactatttacaagttactttaattggtatcagcaaggaaccgagggaacggacccctaaactcctagactctaacgntgactactacgtaacgttaggaaaccgtcgggtacccatacgtaaggttcgaggtgggaggtggtagtcgtagggactagttacttttacgtcgtcgctacgtccgcacgtcctgtacgtctagtaagttacgttcgacgtactattacttacgtgtaactaacgtagttaataacgtaaacttccgtcccgtacttaccgtacggtttcggggaccggggtaccgtaagggtacggtaacgttaccgaaacgtacggtcggtaggtacgtcgtacccgcgtaacgttccgtacttcccgtaccttacccgttcccgttaccccg

SEQ ID NO: 186800 - DNA, 879 bp, Homo sapiens
  misc_feature: GYAE6OF01C0HHB.10.33.C11.1.454.CMB.1.raw
tcagcatagtagtgcacgaccggtgctcgatttagagtgagctcggttggggtttggggggagtcagtcccaaccaggacacagcatggacatgagggtccctgctcagctccgtggggcctcctgcctcctcgtcggctcgtcgggtgtcagatgtagacactccaagatcgaccctagtcctcctactcccttccctgtactcgacagtcgtaggtaggacgacacggccgtaccaacctatccgtacgtcgggccgggacgtacgtacgacggtacttaagtttaaacgtaagtttaacgttttaaagttggtaactacgaacgaaccgaaacggaaaccggaaacgggtaacccggtaacccctaaaccttacgtacgtaactcgtaacgatacgacgtaacgtaccgtaaacggttacgggaaaccggtacccggggttaacccctaaggttaaccggttaacggggttcgttaaggggttaggggtaacgggttagggtaacgtttacgggttaacgggtaacgttaacgttttacggtttttaacctccggtaccggtaacctaccggtcccggaaccgtacggcccgttacgaccgtacggtaccggttaagtaacgtttacgtttacggacctaactttaacgttacgtttaacgttacgtaaccgtaactaagttaaacgttaacggtaaaccgtttcccggtacccgtaccgttaccgggttaaccggggttaccggggggaacgggggtaaccggtaacggggttacggtaaaccggttaacggaaaccggttacgggtggttaccggtcgtaccggtaacctacgttacgttacgtttccttaccgttaccgttcccgttaccccg

SEQ ID NO: 186801 - DNA, 771 bp, Homo sapiens
  misc_feature: GYAE6OF01DXTTC.10.33.C11.1.454.CMB.1.raw
  modified_base (253)..(253): a, c, t, g, unknown or other
  misc_feature (253)..(253): n is a, c, g, or t
tcagcatagtagtgcacgaccggtgctcgatttagagtgagctcgttggggtttgggggagtcagtcccaaccaggacacagcatggacatgagggtccctgctcagctcctgggctcctgctcctcgtggctcgtcgggtgtcagatgtgacatccagactcgaacccagtcctccactccctccctgtactgctactcgtagtaagggacgacaggccgtaccaccgtactcgtaaccgttcggccggganacggtacaaggactaattttaacgaagttacctttaaagttggtaactcgaacgaccgtaaacggaaaaccgagggtaaaccgacccctaaactcctaggaaccttacgtacgaatcggactaacgtacgtaaacgttacgggaaaaccgtcggggtacccaagtacgtaagggttcaagggttaggaggtacggtataccggtaggaataagttacttttacgccgtcggactctaccgctaccgtactcgaccagtcctaagtacgttatttacggacgtaattaacttaacgttacgtacgtaacgaaatacgttaaacgtaacggtaaaacttcccggtaccccgttacttaacccggttacgggttaacccgggggaacggggggtaaaccctaaggggttaacggtaaccgtttaaacccggaaaaccggtaacgggtttggaccggtcgtacggtaacccaaccgttagtttccccgtaagttttccctacgttacccgtttaacccccgg

SEQ ID NO: 186802 - DNA, 776 bp, Homo sapiens
  misc_feature: GYAE6OF01B3LW6.10.33.C11.1.454.CMB.1.raw
  modified_base (129)..(129): a, c, t, g, unknown or other
  misc_feature (129)..(129): n is a, c, g, or t
  modified_base (627)..(627): a, c, t, g, unknown or other
  misc_feature (627)..(627): n is a, c, g, or t
tcagcatagtagtgcacgaccggtgctcgatttagagtgagctcgttgggtttgggggagtcagtcccaaccaggacacagcatggacatggagggtccctgctcagctccgtggggctcctgctcctntggctcgtcgggtgtcagatgtgacatccagatcgacccagtcctccactccctcctgtatcgctactcgtaggtaggacgacgacggtctaccacctatccgtacgttcgggccgggtagacgtcgaaggtacttaagtttaacgtaacggtttaacttttaaagttggtaactacgaacggtaaccaaaacggtaaaccggacggggtaaacccgtacccccttaaaacgtccgtagtactaccgtaacgatcggactaagtaccgtaaacgtacgggaaacgtcgggtaccaagtcgtaaacggttcgaagggttacgggtaggtagtaacgttcggtaggggtaaccttaaggtttaactttttacccggtacgtccgggaccgttaaccgtcccggaccgtaccgtccggtacgaccggtaacgtccgtaaacggttaagttacgttacggactaaccttaagttacgttaactactaacgtaataagttaanaacgtaacgtcccgtaccgtcgtacggttaccgggttaccggggaccgggtaacgtaggggtacgtacggtaacgtaaacggtacgtaggtcggaccgtcgtacctaaccgttcgttaccttcggttacccttcgttaccttaccccgg

SEQ ID NO: 186803 - DNA, 910 bp, Homo sapiens
  misc_feature: GYAE6OF01CUCNJ.10.33.C11.1.454.CMB.1.raw
tcagcatagtagtgcacgaccggtgctcgatttagagtgagctcgttgggtttgggggagtcagtcccaaccaggacacagcatggacatgagggtccctgctcagctcctggggctcctgctcctctggctcgtcgggtgtcagatgtagacatccagatcgacccagtcctccactcccttccctgtatgtctattccgtaggtaggagaacagccgtaccaccactcacgttcggccggcgtagtacgaggacctatttaacgtaacgttaacttttaaagttggtactcgtagacgaacgaaaccggaacgggaaccggtacccctaactaccgtacgtactacgtacgatgactacgtacgtaaacgtacggtaaacggtacgggtaccctaacgtacgtaacggttacgtagggtacgggtagggtacggtaggttcggtacggggtaacgttaacgtttaccgtttttacgtaccggttaccggtaccgtaacgttcccgtaccgtaccggtcccgtaccggacgtaaccggttacccgtttaagggtaaacgtttaccgttttacgtaaccggttaaacttaacgtttaaacgtttaaccgtttaaccgtaaaccgttaaaccgttaaacgggtttaacgttaaacgttaaaccgtttacccggttacccccggttaaccgtttacccgggttacccgggggtttacccggggggaaccgggggggttaaacccggtaaagggggtttacccggtaaacgggtttaaacccgaaaaccggggttacggttaaccgggttcgggttaacccggtccggtaaaacccccgttacccgttaaccgggtttacccgttttaccggtttaaccgtttcccgttaaccccggttttaccccccccggg

SEQ ID NO: 186804 - DNA, 656 bp, Homo sapiens
  misc_feature: GYAE6OF01DU69H.10.33.C11.1.454.CMB.1.raw
  modified_base (224)..(224): a, c, t, g, unknown or other
  misc_feature (224)..(224): n is a, c, g, or t
  modified_base (308)..(308): a, c, t, g, unknown or other
  misc_feature (308)..(308): n is a, c, g, or t
  modified_base (341)..(341): a, c, t, g, unknown or other
  misc_feature (341)..(341): n is a, c, g, or t
tcagcatagtagtgcacgaccggtgctcgatttagagtgagctcgttgggtttggggagtcagtcccaaccaggacacagcatggacatgaggtccctgctcagctcctggggctcctgctcctctggctctcggtgtcagatgtgacatccagatgacccagtctccatcctcctgtatgcatctgagagacagcgtcaccatcacttgccggcagtcagganattttacaagtctttaaagtgtatcagcagaaaccagggacgcccctaaacgtcctagactctacgatgcatcgaactgaaacngggtccatcgaaggttcagtcggagtggatcgnggacaggtcttttaacgcttccggacacgttcccggctacggcctcgacgacgtacccttagaacggttagttttacggtaccggtaactaacgtttaactttaacgttacgttaacgtaaaccgtaagttaagttaacgtaaaaagttccggttaccccggtaccgttaccgttaccgggtttaccgggtaccgggggtaaccggtaacgggttacggtaacggttaaccgtaaaaccggtaccggtaggttaccggtccttaccggacccaaccgttaactccgttacggttcctttcgtacgtttacccccg

SEQ ID NO: 186805 - DNA, 553 bp, Homo sapiens
  misc_feature: GYAE6OF01BM577.10.33.C11.1.454.CMB.1.raw
  modified_base (196)..(196): a, c, t, g, unknown or other
  misc_feature (196)..(196): n is a, c, g, or t
  modified_base (360)..(360): a, c, t, g, unknown or other
  misc_feature (360)..(360): n is a, c, g, or t
  modified_base (437)..(437): a, c, t, g, unknown or other
  misc_feature (437)..(437): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctcctgtatgcatctgtagganacagcgtcaccatcacttgccgggcgagtcaggactatttacaagtctttaaattggtatcagcagaaaccagggaacggcccctaaactcctagactactacgatgcatcgaacttggaaacaggggtcccatcaaggttcaggtggaggtggatcgtggganacgtattttactcgtcgacatcccgcagccttgcacgccctagaagtattttggcgaactattattactggtacaanaacgttatagtaaatcgtcccgtacttcgtacgtttcggggacgggggtaaccgaagggttcggagttacgaaacgacgtggtacggtctgccactactctgtcttcgtcttcccg

SEQ ID NO: 186806 - DNA, 914 bp, Homo sapiens
  misc_feature: GYAE6OF01B00M2.10.33.C11.1.454.CMB.1.raw
tcagcatagtagtgcacgaccggtgctcgatttagagtgagctcggttggggtttgggggagtcagtcccaaccaggacacagcatggacatgagggtccctgctcagctccgtgggctcctgcctcctctggctcgtcgggtgtcagatgtgacatccagtactcgaccctagtcctcctactcccgttcccttagtactcgacctacgttacgtagggtaacggacaccgaggtccctacctaaccttacgtacccgtaccggttaccggggcccgggggtacgtaacggttaccggaacggttaacctttaaacgttttaaacccgtttaaaggtttttaacctttttaaaaggtttacgggtaacctaccggtaaccggtaaccgaaaaccgggtaaaaccccggggaaccggggtaaacccccgtaaccccctttaaacgtcccgttaacggtaaccttacgtaccgtagtccggtaccgtaacgttaacggtaacgttaacggaaaccgggtccggtacctaagtacggtaacggttggaggggtacggaggtacgtacgtacgggtacggtaacgtagtttacgtttccgtaccggtaccggtacctaccgtcccgacggtcgtaccggtcgtaccgtacggttaccgttaaggtaacgtttacgttaacgtacgtaaactttaagtttaccgttaacgttacgtaaactaacgtttaaacgtaacgttaaccgttaacctcccgggttaccgtttacccggtaccgggttaccggggttaccgggggtaaccgggtaacggttagggtaaccgggttaacgtaacgtaaagggttcccggtaggtcgttccgaccgtacgtaccgttacttccgttaacgttcccttccgtacccggtttaccccg

SEQ ID NO: 186807 - DNA, 834 bp, Homo sapiens
  misc_feature: GYAE6OF01CBTOH.10.33.C11.1.454.CMB.1.raw
  modified_base (126)..(126): a, c, t, g, unknown or other
  misc_feature (126)..(126): n is a, c, g, or t
  modified_base (139)..(139): a, c, t, g, unknown or other
  misc_feature (139)..(139): n is a, c, g, or t
  modified_base (233)..(233): a, c, t, g, unknown or other
  misc_feature (233)..(233): n is a, c, g, or t
tcagcatagtagtgcacgaccggtgctcgatttagagtgagctcgttgggtttgggggagtcagtcccaaccaggacacagcatggacatgagggtccctgctcagctcctgggctcctgctcctntggctctcgggtntcagatgtgacatccagatcgacccagtcctccactccctccctgtatgcatcgtggtaggagacagcgtaccaccatcacgttcggccgggtnagtcgaggtactatttacaagttactttaaagttggtatcgagacgaacgaaaccgagggaaccgacccctaaactccgtagactcgtaacgatcgactaacgtaccggtaacgttaacgggaaaccgttacggggtacccctaagttaaccggttaacgggttcgaaaggggttcggggtaagggttacgggtaacgtttaccgggtaacgggtaacgttaacggttttaaccgttttttaacccgccgggttacccggtacgttacccgttacccggaccgtaaccggtacccggttacggtaaccgttacgggtacccgttaagggtaaacggtttaacggtttttaccggaaccggtttaaccttaaacgtttaacctttaaacggttaccgttaaaccgtaaacgttaaacgggtttaaactaaacggttaaaccgttaccggttaaccccgtacgtttaaccggttacccggggtttaccgggggaccgggggttaaaccggtaacgggtacggttaacgtaaacggtaacggtacggtaggtacggtcgtacgacctacgttacgttcgttacttcgttaccgtacgttccccg

SEQ ID NO: 186808 - DNA, 882 bp, Homo sapiens
  misc_feature: GYAE6OF01C6PC1.10.33.C11.1.454.CMB.1.raw
  modified_base (129)..(129): a, c, t, g, unknown or other
  misc_feature (129)..(129): n is a, c, g, or t
  modified_base (135)..(135): a, c, t, g, unknown or other
  misc_feature (135)..(135): n is a, c, g, or t
  modified_base (150)..(150): a, c, t, g, unknown or other
  misc_feature (150)..(150): n is a, c, g, or t
  modified_base (200)..(200): a, c, t, g, unknown or other
  misc_feature (200)..(200): n is a, c, g, or t
tcagcatagtagtgcacgaccggtgctcgatttagagtgagctcggttggggtttggggggagtcacgtcccaaccaggaccacagcgatggacagtgtaggtcccttgctcagctcctgggctccgtncctccntcggctcctcgggtntcgagattcgtacgaacgacttccaggactccggaaccctagtcctaccncttcccgtccgtgtagtcgacgtagtcgtagggtaggaacgaaccggcgggtcttaccaaccgtagtccgtaaccgttcgggccgggtacggtaggtacaaggtacttaactttactaacgttacgtttaaagtggtagtacgacgacgtaacggaaaccgacgggaaccgtacccgtaaacgtccgtaagtacgtacgtacgtgtacggcgtaactacggaaacgtttacggaacgtcgggtaccaagtacgtaacggttcgacggttagggtaacggtggtactcggtacggtacgtacgttacgtttccgcgtaccgtactaccgttcccgacgaccggtaccgtacgaccgtaacgtcgttaacggtaacgttaccgttacggacccgttaagttaacgtttaccgttacgtacggttaaccaacgggtttaaacgtaacggttaaacgtaaacccgttcccggttaccccggttaacgtacccgggtttaaccgggtttaccggggggaacggttaaaccggtagggttaaccgggttaaccgtttaaaacccggggaaaaccggttacggttacggggttacccgggtaacttacccccggtaacgttaacccgttaaaccggtttccggtttaaccggtttaccccggttaacgttacccgggggttttaacccc

SEQ ID NO: 186809 - DNA, 667 bp, Homo sapiens
  misc_feature: GYAE6OF01AO9MB.10.33.C11.1.454.CMB.1.raw
  modified_base (224)..(224): a, c, t, g, unknown or other
  misc_feature (224)..(224): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatcgacccagtctccatcctcctgtatgcatctgtaggagacagcgtcaccatcacttcggccgggnagtcaggactattacaagttctttaaagtggtatcagcaagaaaccgagggaacgacccctaaactccgtagatctagactgacctagtaccgtaacgttacgggaaaacgtcggggtaccccaagtacgtaacggttcaaggtgggagggtggtaatcggtagggactaggttacttttaccgtccgttcggactacgtacccgacgtacgtcccgtacgccgtacgtacccgtaggtaacgttatttacggacgtaactagttaacttacgtacgtaactaagaagttaacgtaacgtaaacgttccgtaccgtacttccggttaaccggttccgggggacggggtaaccgtagggtacggtaacgtaacgtaaccggtacgttagggacggacgttccgactacccgtgttacgtaccgttacttccgtaccgttccccg

SEQ ID NO: 186810 - DNA, 737 bp, Homo sapiens
  misc_feature: GYAE6OF01C37IX.10.33.C11.1.454.CMB.1.raw
  modified_base (145)..(145): a, c, t, g, unknown or other
  misc_feature (145)..(145): n is a, c, g, or t
  modified_base (241)..(241): a, c, t, g, unknown or other
  misc_feature (241)..(241): n is a, c, g, or t
  modified_base (717)..(717): a, c, t, g, unknown or other
  misc_feature (717)..(717): n is a, c, g, or t
tcagcatagtagtgcacgaccggtgctcgatttagagtgagctcgttgggttgggggagtcagtcccaaccaggacacagcatggacatgagggtccctgctcagctccgtggggcctcctgcctcctcgtggcctcgtcgggtntcgagtactgtgactatccagtatcgacctagtcctccacttccctcctgtatcgctattcgtaggtaacggacacgacgtccgtacctaaccgtntacccgtacgttcgggcccgggtagtaacgtcgaacgttacttaaacgttttaacgtaacgtttaacgttttaaagttacggttaactaccgagtaacaaacggaaaccggtaacgggtaaaccccgtaaccccttaactccgtacgtacttaccgtacgagtcgactacgtacgtaaacgtaacgggaacgtccgggtaaccagtactacggtcgtaagggtcgggaggtgtacgtggtacgtacgttacgttacttttcgtaccgtacgtccgtacgtaccgtccgactcgacgtacgtcggtacttgtaacgttcttacgactaactacgtttactacgttactacgtaagtaacgtaacgtaacgtaaccgttcgaccgttcttacggaccgggtttacggaaccgggtacggtacggtaacgtacgtaacgtaacgtcgtgtacggtactacgaccgtacgtcgttacgtntttacctccgtacgtccccg

SEQ ID NO: 186811 - DNA, 824 bp, Homo sapiens
  misc_feature: GYAE6OF01DH3IF.10.33.C11.1.454.CMB.1.raw
tcagcatagtagtgcacgaccggtgctcgatttagagtgagctcgttgggttgggggagtcagtcccaaccaggacacagcatggacatggagggtccctgctcagctccgtggggctcctgctcctctggctcgtcgggtgtcagatgtagacactccagactcgaccagtcctacctactccctcctgtactcgctatcgtaggtaaggacgacgagtaccgtaccacctactcctacggttcgggcccgggtacgaggtacgacggtaaccttaattttaaccgtaaagttttacttttaaagttggttaactacgaacgaccgtaaacggaaaaccggacgggtaaacccgtaccccttaaaaccgtccgtagtactacgtacgtagtcgactaacgtacgtaacgtacggaacggtaccggtaccacgtacgtaacggtcgaggtacgggtagggtaggtacgtcggtacgggaacttacgtttaacgttttaccgtacggtaccggtctaccggttaccgcgtaccgtccgtacggacgtacggttaccggtaacgtaacgttacgtttacggaaccgtttaactaacgtttacgttaaccgttacggtaacccttaaaggttaagttaaaccgttaacgtaaaaccggttcccggtaacccggttaccgttaccggttaccggggtttacccgggggacccgggggtaaacgttacggggttaacgggtaaaccgttaaaccgaaaacgggtcgttgggaaccgtcgtaaccgaccgttacgtacgttccgtacgtttccttccgtaccgttccccg

SEQ ID NO: 186812 - DNA, 760 bp, Homo sapiens
  misc_feature: GYAE6OF01DBL2G.10.33.C11.1.454.CMB.1.raw
  modified_base (230)..(230): a, c, t, g, unknown or other
  misc_feature (230)..(230): n is a, c, g, or t
  modified_base (384)..(384): a, c, t, g, unknown or other
  misc_feature (384)..(384): n is a, c, g, or t
  modified_base (398)..(398): a, c, t, g, unknown or other
  misc_feature (398)..(398): n is a, c, g, or t
  modified_base (583)..(583): a, c, t, g, unknown or other
  misc_feature (583)..(583): n is a, c, g, or t
tcagcatagtagtgcacgaccggtgctcgatttagagtgagctcgttggggtttggggagtcagtcccaaccaggacacagcatggacagtggacgggtccctgctcagccgtccgtgggggccttcctgccttcctcgtcggtccttcggtcgggtgtcaggtatggtagtacactaccaaggtactaccgacccgtactccctacctaccgttcccctccgtagtacncgtaccgttaggtaggaggacaacgcgacttaccactcgttactccggtacggccggcgtacgacgtacgtactaatttaactagtttaacgtttagtcgacagacgaacgtaacggaaaccggtacggaaccctaccccgttaactccgtaanaccgtttaccgaancggtctaacgtaaccggttacggttaacgaaaccggtacggggtaacgacctacgtaggtaaggttcggaaggggtcggtaaggtcgtaggtagtaaccggtattaccggtttacgtttacgaccgtccggtaactacggtccgagtccggttccgaagcgacgtacgtagttacgttacggtanaaccgtatacgtactagtctaacagtaatacgtaataccgtccggtactccgttacgggtccggaacggggtacggtaacggtaacggttacgtaaccggtaaccggtaacggtcggtacggacgtccgtaacgcctttaacgccgtttagtaccttccgtaccgtccctaacccgg

SEQ ID NO: 186813 - DNA, 893 bp, Homo sapiens
  misc_feature: GYAE6OF01BCNYU.10.33.C11.1.454.CMB.1.raw
tcagcatagtagtgcacgaccggtgctcgatttagagtgagctcgttggggtttgggggagtcagtcccaaccaggacacagcatggacatggacgggtccctgctcagctccgtggggctcctgcctcctcgtggctcgtcgggtgtcagtatgtcgacactccgagtactccgaccctagtcctaccctacttcccctcccttagtactcgctactcgtaggtaaggacgacgtacgtccgtaccaacctacgttccgtaccgttccggggaccgggtaccgtaacggtaccgaaacggtaacttaaacttttaaccgtaaacgttttaaccgttttaaaaggtcggtaactacgaacgacgaaccgtaaaaccggacgggtaaccgtaaccccttaaactccgtacgtacttacgtacgtacgtacgacttaacgtaccggtaaacggttaacgggaaaccgggtcggttaacccaacgttacggtaacggtacgtaggggtacgggtacggtacggttactcgggtagggtaaccttacggtttaacgtttccgtccggtaaccggtacctacggtaccccgacgtaccgccgtacgaccgtacggtaaccgttaggtaagttcgtttaacgaccgtttaaactagtttaaacctttacggtaccgtaaacgtaacgttaacgtaacgtaacgtttaaacctcccgggttaacccgttacggttaacccgggtttaccggggtacggggggaacccgggtaaccgggttaagggttaaaccggtacccggttaaaacgaaccgggttccgtaagggtccggtaccgtaccgtaaacccgtaccgtttacacccggttttgttaaccccgttccttccccggttaacccg

SEQ ID NO: 186814 - DNA, 150 bp, Homo sapiens
  misc_feature: GYAE6OF02HQDCF.10.33.C11.1.454.CMB.1.raw
  modified_base (150)..(150): a, c, t, g, unknown or other
  misc_feature (150)..(150): n is a, c, g, or t
tcagcatagtagtgcacgaccggtgctcgatttagagtgagctcgttgggggaccaaggtggagttcaaacgaactgtggctgcaccatctgtcttcatcttcccgccatctgacactactatgctgagcgggctggcaaggcgcatagn

SEQ ID NO: 186815 - DNA, 153 bp, Homo sapiens
  misc_feature: GYAE6OF02GOZLA.10.33.C11.1.454.CMB.1.raw
  modified_base (152)..(153): a, c, t, g, unknown or other
  misc_feature (152)..(153): n is a, c, g, or t
tcagcatagtagtgcacgaccggtgctcgatttagagtgagctcggttggggggaccaaggtggagttcaaacgaactgtggctgcaccatctgtcttcatcttcccgccatctgacactactatgctgagcgggctggcaaggcgcatagnn

SEQ ID NO: 186816 - DNA, 531 bp, Homo sapiens
  misc_feature: GYAE6OF02H523M.10.33.C11.1.454.CMB.1.raw
  modified_base (318)..(318): a, c, t, g, unknown or other
  misc_feature (318)..(318): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaaattggtatcagcagaaaccagggaaggcccctaaactccctgatctacgatgcatcgaacttggaaacngggtacccatcaaggttcagtggaggtggatcgtgggacagtattttactctcggcatccgcacgcctgcagcctgaagatttgcgatatattactgtacaacagtatagtaaaatcgtacccgtctactacgtttcgggaccgggggtaaccgaagggtggtagttacgaaacgtaacgtcgtggcttgcaccatctcgttcttcattcccg

SEQ ID NO: 186817 - DNA, 579 bp, Homo sapiens
  misc_feature: GYAE6OF02ITQJT.10.33.C11.1.454.CMB.1.raw
  modified_base (199)..(199): a, c, t, g, unknown or other
  misc_feature (199)..(199): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtcctccatccctccctgtatgcatctgtagganacagcgtcaccatcacgttgccgggcaagtcaaggacatttacaagttcttaaatggtatcagcaagaaaccgagggaacgcccctaaatcctagatctacgatgcatcgaattaggaacagggtccatcaaggttcaggtaggaggtggatcgtagggacagttattttactcgcggacagtccgcacgcctgacacgctagaagtatttgacgacattattactgtaactaacagttaatagtaaacgtcgtaccgccttacgtacgtttacggggaccggggtaaccgaagggttcggagttaccgaaaacggtaacgttaggtcgggtactacgggaccaaccgtactacgttcggttacttaccgtacttacccg

SEQ ID NO: 186818 - DNA, 598 bp, Homo sapiens
  misc_feature: GYAE6OF02JUI28.10.33.C11.1.454.CMB.1.raw
  modified_base (360)..(360): a, c, t, g, unknown or other
  misc_feature (360)..(360): n is a, c, g, or t
  modified_base (392)..(392): a, c, t, g, unknown or other
  misc_feature (392)..(392): n is a, c, g, or t
tcagcatagtagtgcacgaccggtgctcgatttagagtgagctcgttgggtttgggggagtcagtcccaaccaggacacagcatggacatgagggtccctgctcagctcctgggctcctgctcctctggctctcgggtgtcagatgtgacatccagatgacccagtctccatcctccctgtatgcatctgtaggagacagcgtcaccatcacttgccgggcagtcaggacatttacaagtcttaaattggtatcagcagaaaccagggaagcccctaaactcctgatctacgatgcatcgaacttggaaacagggtccatcaaggttcaggtggaggtggatcgtgggacagtatttacncgtacgcatccgcagcctgcagcctagaagtntttgacgtatattattactcgtacaaactagttaatagtaaaactcgtacccgtactacctacggtttaccggggacggggtaaccgtaaggggttcggtacgtttaaccgaaaaccgggtaacgttaggttacgggtaccgttacggtacccgtaacccttacggttaccgtttacggtacctttacccgtaacggtttcccccg

SEQ ID NO: 186819 - DNA, 540 bp, Homo sapiens
  misc_feature: GYAE6OF02F66ZR.10.33.C11.1.454.CMB.1.raw
  modified_base (315)..(315): a, c, t, g, unknown or other
  misc_feature (315)..(315): n is a, c, g, or t
  modified_base (347)..(347): a, c, t, g, unknown or other
  misc_feature (347)..(347): n is a, c, g, or t
  modified_base (363)..(363): a, c, t, g, unknown or other
  misc_feature (363)..(363): n is a, c, g, or t
  modified_base (497)..(497): a, c, t, g, unknown or other
  misc_feature (497)..(497): n is a, c, g, or t
tcagcatagtagtgcacgaccggtgctcgatttagagtgagctcggttgggtttgggggagtcagtcccaaccaggacacagcatggacatgagggtccctgctcagctcctgggctcctgctcctctggctctcgggtgtcagatgtgacatccagactgacccagtctccatccctccctgtatgcatctgtaggagacagcgtcaccatcacttgccggcgagtcaggacatttacaagtctttaaatgtatcagcagaaccagggaacgcccctaaatcctagatctacgatgcatcgaacttaggaaacngggtcccatcaaggttcagtggagtggatcgngggacagtattttacncgtcggctagccgcacgcctgcagcctagaatatttgacgtacatacgttactcgtacactagtatagaaatcgtaccgtctacgtacgttccgggacggggtaccgaagggtggtagttaccgaacggtaacnggttacggctcggacaccgtactccgtgtccttcacttacccg

SEQ ID NO: 186820 - DNA, 555 bp, Homo sapiens
  misc_feature: GYAE6OF02IB031.10.33.C11.1.454.CMB.1.raw
tcagcatagtagtgcacgaccggtgctcgatttagagtgagctcgttgggtttggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaatcctgatctacgatgcatcgaacttggaaacagggtcccatcaaggttcaggtggaggtggatcgtgggacagtaattttactctcggcactccgcacgcctgcagcctagaagtatttgcgtactattattactgtacaactagtaatagaaaattcgtacccgctacgtacgtttccgggacgggggtaccgaagggtaggtacgttacgaaacggtaacgtaggtcggcgtacgcgtacctactaccgttcgttccttcctattaccccg

SEQ ID NO: 186821 - DNA, 512 bp, Homo sapiens
  misc_feature: GYAE6OF02HZNJ3.10.33.C11.1.454.CMB.1.raw
  modified_base (497)..(497): a, c, t, g, unknown or other
  misc_feature (497)..(497): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatcgtgggacagtattttactctcggcatcccgcacgcctgcagcctgaagtattttgcgtacattattactgtacaacagtatagaaaatcgtacccgctctacgtttcgggcggggaccaaggtggagtacaacgaactgtggctgcacntctgtcttcattccg

SEQ ID NO: 186822 - DNA, 581 bp, Homo sapiens
  misc_feature: GYAE6OF02HCQEE.10.33.C11.1.454.CMB.1.raw
  modified_base (370)..(370): a, c, t, g, unknown or other
  misc_feature (370)..(370): n is a, c, g, or t
  modified_base (386)..(386): a, c, t, g, unknown or other
  misc_feature (386)..(386): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacattacaagttctttaaattgtatcagcagaaaccgagggaacggacccctaaactcctagactctacgatgacatcgaacttggaaacacgggtccatcaaggttcagtggaggtgatcgtgggactagtattttacncgtcggcactccgacncgcctgcagcctagaagtagtttgacgtactattacttactagtactaacagtaatagtaaactcgtacccgacttaccgtacgtttccggggacggggtaacccgaagggtacggtacggttacgaaacggtaacgttaggtacggtacgtcggaccaccgtacgttaccttcgttccttacgtacttaccccg

SEQ ID NO: 186823 - DNA, 584 bp, Homo sapiens
  misc_feature: GYAE6OF02GMJ39.10.33.C11.1.454.CMB.1.raw
  modified_base (398)..(398): a, c, t, g, unknown or other
  misc_feature (398)..(398): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcagtcaggactatttacaagtctttaaattggtatcagcaagaaaccagggaacgcccctaaactcctgactctacgatgcatcgaacttaggaaacgagggtcccatcaaggttcagtggaggtgatcgtaggacagtattttactcgtcgcatccgacagcctgcagcctgaatntttgcgatattattactgtacaacagtattaagaaacttcgtacccgacttaccgtaccgtttccggggacgggggtaaccgtaaggggttacggtacggttaaccgaaaaccggtaaccgttaggtacgggtactacggacctaccgtacttccgttcggtttacctttccgtacgtttcccccg

SEQ ID NO: 186824 - DNA, 664 bp, Homo sapiens
  misc_feature: GYAE6OF02GJG0H.10.33.C11.1.454.CMB.1.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (649)..(649): a, c, t, g, unknown or other
  misc_feature (649)..(649): n is a, c, g, or t
tcagcatagtagtgcacgaccggtgctcgatttagagtgagctcgttgggtttgggggtagtcgagtcccaaccaggacacagcatggacatgaggtccctgctcagctcctgggctcctgctcctctggctctcggtgtcagatgtgacatccagatgacccagtctccatccctcccgtgtatgccattctgtagganacaggctcaaccatcacttgccgggnagtcaggacatttacagttactttaatgtatctagcaagaaccgagggaacgaccctaaactcctagataccgtagatgactaagtaccgtaacgttaggaaaccgacggggtaccccaataccgtaagggttctaaggtagggaagggtaggtaagttcgtaggggaactaacgttaagtttttacccgttaccggtacacgtcccggaccaaggtccctgagtacccgccgttagaaacgtttcgtttacggaccgtaacttagttacgtttacttcgtaacctaactaggttaaacagtaaaacttccggtaccccgtacttacgttaaccggtttccggggaggggaacccttaaagggtcggtaattaccgaaacggtacttggtcgacgtacgtccgaacctaggtttccacgtttnttacccgattccccg

SEQ ID NO: 186825 - DNA, 515 bp, Homo sapiens
  misc_feature: GYAE6OF02GXC8C.10.33.C11.1.454.CMB.1.raw
  modified_base (197)..(197): a, c, t, g, unknown or other
  misc_feature (197)..(197): n is a, c, g, or t
  modified_base (315)..(315): a, c, t, g, unknown or other
  misc_feature (315)..(315): n is a, c, g, or t
  modified_base (367)..(367): a, c, t, g, unknown or other
  misc_feature (367)..(367): n is a, c, g, or t
  modified_base (444)..(444): a, c, t, g, unknown or other
  misc_feature (444)..(444): n is a, c, g, or t
  modified_base (468)..(468): a, c, t, g, unknown or other
  misc_feature (468)..(468): n is a, c, g, or t
  modified_base (508)..(508): a, c, t, g, unknown or other
  misc_feature (508)..(508): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtagganacagcgtcaccatcacttgccgggcagtcaggacatttacaagtctttaaattggtatcagcagaaaccagggaaggcccctaaactcctgatctacgatgcatcgaacttggaaacnggggtacccatcgaaggttcaggtggaggtggatcgtggactagattttacnctcggcactccgcacgcctgccagcctgtaagtattttgactactatacttactgtcaacagtatagaaatgtcccnctcacgtttcggacgggtacaggnggtagttaaacgactggtagctgacacatctgtctctacncttcccg

SEQ ID NO: 186826 - DNA, 673 bp, Homo sapiens
  misc_feature: GYAE6OF02HPVYF.10.33.C11.1.454.CMB.1.raw
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatcgacccagtctccatccctccctgtatgcatctgtaggagacagcgtcaccatcacttcggccgggcgagtcaggactatttacaagttctttaaattggtatcagcaagaaaccgagggaacggacccctaaactcctagatctacgatgacatacgaacgttaggaaacgtacgggtacccagtacgtaacggttacgaggtgggtaggtggtagttcgtagggaactagtaacgttttactcgttcggactacgtccgactacgcctcgactacgtcctaggtaagtagttttacggacgtaacttaactttaactttaacttaacttaactaaacgtaagttaaataagtaaaacgttcgtacccgtaccgtaccgttaccgggtttaccggggaccggggtaaccgtaaggggttacggtaacggttaaccgtaaaccggtaacgttacggtacggtacgttacgaccgtaccgtacgttaccgttcgttaccttactacgttaccccg

SEQ ID NO: 186827 - DNA, 622 bp, Homo sapiens
  misc_feature: GYAE6OF02IUQ9S.10.33.C11.1.454.CMB.1.raw
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctcatcctcctgtatgcatctgtaggagacagcgtcaccatccacttgccgggcagtcaggacattacagtcttaaatggtatcagcagaacagggaacgaccctaaatcctgatctacgatgcatcgaacttggaaacacggggtacccatacgaaggttcaggtggaggtggatgtagggactagtatttactcgtcggcactccgcacgtccgtgacacggtctagtaaacgtagttttcgacgtactaagttattacgttacgtacctaaataacgtataagtaaaattccggtacccgtaccttaccgtaaccggttttaccgggggaccggggggtaaacccgtaaggggttacgggtacgttaaccggtaaaacggtaaccgttagggttggaccgttaggaccgtaacctagtttacccgtcgtttacctttaccgactttccccgg

SEQ ID NO: 186828 - DNA, 571 bp, Homo sapiens
  misc_feature: GYAE6OF02FU6G3.10.33.C11.1.454.CMB.1.raw
  modified_base (221)..(221): a, c, t, g, unknown or other
  misc_feature (221)..(221): n is a, c, g, or t
  modified_base (277)..(277): a, c, t, g, unknown or other
  misc_feature (277)..(277): n is a, c, g, or t
  modified_base (393)..(393): a, c, t, g, unknown or other
  misc_feature (393)..(393): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctactctggctccgaggtgccagatgtgacatccagatgacccagtctccaccgtccctgtctgcatttgttggagacagagtcaccatctcttgccganaagtcagaacattgacacctattgaattggtatacaaacaaaaacgtggggaaacncccctacactcctgatcaatgcagcgtcctagttacagtaggtcgggtcccctgaaggttcagtggctaggtggatcgtgggactagtactttactcctcaccatcgagtctatcngcacgcctagacgttatttcgacgttacttactactacgtacaaacgtacgttacgtttacccggtaaccccgttttgttacccgggacggtacgggaccgtaagggtcggaagtactaacgaacgtacgtgtcggctgacctacgtacttcgtcgttccttactctttcctccctcc

SEQ ID NO: 186829 - DNA, 703 bp, Homo sapiens
  misc_feature: GYAE6OF02H9RGA.10.33.C11.1.454.CMB.1.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtagganacagcgtcaccatcacttcggccgggngagtcaggactatttacaagttactttaaattggtatcagacaagaaaccgagggaacggaccccctaaaactccctagacttctaacgatcgactactacgtaacgttagggaaaaccgtacggggtacccctaagtacgtaaaggttacgagggttgggagggtggagttcgtaggggaactagttaatttttacgccgttacgggactacgtccgcacggtcccgtcgcacggtccgttaggaagttagttttcggacgtaactaatttacttaacgttgtaactaaacgtaagttaataacggtaaaattccgtacccgtcgttaccgttaccgggttttccgggggaccgggggtaaccgtaaggggttacggtaacggttaaccgaaacggtaacgttacggtacggtaccgttaccgtaccgtaacctacgttaccgtttacggtttacctttaccgtaccgtttacccccg

SEQ ID NO: 186830 - DNA, 597 bp, Homo sapiens
  misc_feature: GYAE6OF02G09FG.10.33.C11.1.454.CMB.1.raw
  modified_base (364)..(364): a, c, t, g, unknown or other
  misc_feature (364)..(364): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttggccgggcagtcaggactatttacaagtctttaaattggtatcagcagaaaccgagggaacgacccctaaactcctagatctacgatgcatacgaacttaggaaacgtacggggtacccagtacgaaggttcaggtggaggtggatcgngggactagtatttactcgtcggcagtccgcgacgcctgcagccgtagaagtattttagcgtaactattaattctaaaagtcaaacgtagttaataagtaaattcgtacccgtacgttaccgtacggtttccggggaccgggggtaaccgtaaggggtcggtacgttaccgaaacggtaacggttgtacggctaggacctaccgtattcgttcggttaccttacgtacttcccg

SEQ ID NO: 186831 - DNA, 607 bp, Homo sapiens
  misc_feature: GYAE6OF02HM9RH.10.33.C11.1.454.CMB.1.raw
  modified_base (220)..(220): a, c, t, g, unknown or other
  misc_feature (220)..(220): n is a, c, g, or t
  modified_base (383)..(383): a, c, t, g, unknown or other
  misc_feature (383)..(383): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctcctgtatgcatctgtaggagacagcgtcaccatcacttgccggngagtcaggactatttacaagtctttaaattggtatcagacagaaacgaggaacgacccctaaactcctgatctacgatgcatacgtaacgttaggaaaacgacggggtaccccagtacgtaacggttcagtgggaggtggatcgtagggactagtattttacncgtcggctacgtccgcacgtcctgcacgctagtaagtactttagcgactattacttactagtacaacagttatagaaacttcgtacccgtctacgtaccgtttaccggggaccgggggtaaccgtaagggttcggtaacgttacggaaaccggtaaacgttcggtaggtaccgtacgacccgtacgtacgtaccgttacgttacctttacctaccgttaccccg

SEQ ID NO: 186832 - DNA, 661 bp, Homo sapiens
  misc_feature: GYAE6OF02IOOD0.10.33.C11.1.454.CMB.1.raw
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctcctgtatgcatctgtaggagacagcgtcaccatcacttcggccgggcgagtcaggactaatttaacaagtacttttaaattggtatcagcaagaaaccaggggaacgacccctaaaactcctagatctagatgcatacgtaacttaggaaaacacggggtacccaagttacgaaggtttcaacggtgggacgggtaggattcgtaggggaactagtaactttttacgcttccggtacacgtcccgacacggtacctcgacacgccgttagaaacgttagttttcggacgtaacttaagttaacttacttagtacaaactaagtaataagtaaaagttccgacctactacgtaaccgtttcggggacggggtaaccgtaagggtacggtaacggttaacgaaaaccggtaacgttacggtacggtaccgtacgaccctaaccgttacgttccgttacggttacctttacctaaccgtttcccccgg

SEQ ID NO: 186833 - DNA, 674 bp, Homo sapiens
  misc_feature: GYAE6OF02IZUMB.10.33.C11.1.454.CMB.1.raw
  modified_base (400)..(400): a, c, t, g, unknown or other
  misc_feature (400)..(400): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatccctccctgtatgcatctggtaggagacagccgtcaccatcacttggccgggcgagtcaggactatttacaagttactttaaattggtatcagacaagaaaccgagggaacggaccccttaaactcctagactctacgatcgacactcgtaacgttacggaaacgtacggggtacccagtacgtaaggttacgaggtgggtaggtggatcgaggactagtatttacncgtcgctacgtccgcacgtcctagcgacgtaccgtagtaacgttagttttacggaccgtaacttaagtttaactttaccgttaggtaacctaaaccgtaaggttaataaaggtaaacttccggtacccgtacttaccgttaccgggtttaccgggggaccgggggtaaacgtaaggggttacggtacggttaaccgtaaaccggtaacgttaggtcggtaacgtacgacccgtaacgtacttaccgttacgtacctttaccgactttacccccg

SEQ ID NO: 186834 - DNA, 636 bp, Homo sapiens
  misc_feature: GYAE6OF02H8RLV.10.33.C11.1.454.CMB.1.raw
  modified_base (226)..(226): a, c, t, g, unknown or other
  misc_feature (226)..(226): n is a, c, g, or t
  modified_base (387)..(387): a, c, t, g, unknown or other
  misc_feature (387)..(387): n is a, c, g, or t
  modified_base (393)..(393): a, c, t, g, unknown or other
  misc_feature (393)..(393): n is a, c, g, or t
tcagcatagtagtgcacgaccggtgctcgatttagagtgagctcgttggggtttggggagtcagtcccaaccaggacacagcatggacatgagggtccctgctcagctcctggggctcctgctcctctggctctcgggtgtcagatgtgacatccagatgacccagtctccatccctcctgtatgcatctggtaggagacagcgtccaccatcacttcggccgggngagtcaggactatttacaagttactttaaattggtatcagcaagaaaccgagggaacggacccctaaatccctagactctacgatgcatcgtaacttaggaaacgacgggtccaagtacgtaaggttcaggtaggaggtggatcgtaggactgtatttacncgtcgntactccgcacgccgtagcacgctagtaagttacttttcgacgtaactaagttacttacgtacgtaacaaacgtagttaagtaacgtaaaactccgtacccgtactaccgttaccggtttacccgggggacggggtaaccgtaagggtacgggtaacgttaaccggtaaacggtaacgtacggttacggtaccgtacgtaccgtaactacgttacgttcgttacctttacgaccgtttaccccg

SEQ ID NO: 186835 - DNA, 648 bp, Homo sapiens
  misc_feature: GYAE6OF02HKHQ7.10.33.C11.1.454.CMB.1.raw
  modified_base (221)..(221): a, c, t, g, unknown or other
  misc_feature (221)..(221): n is a, c, g, or t
  modified_base (378)..(378): a, c, t, g, unknown or other
  misc_feature (378)..(378): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccggngagtcaggactatttaacaagttctttaaatggtatcagcagaaaccgagggaacggaccctaaactcctagatctacgatcgcatcgaacttaggaaacgacgggtcccatcgtaaggttcaggtaggaggtggatcgtaggactagtattttacncgttcggctagtcccgcacgtccgtcgcgacgtacctaggtaaacgttacgttttcgacgtactaattaacttaacgttacgtacgtaaactaacgttaagtaacgtaaaacttcgtaccccgtacgttaccgtaccgggtttaccggggtaccgggggtaaccgtaacgggtagggtacgttaaccggtaaaccggtaacggtacggttacggacgtacggtaccgtaccgtacgttaccgttacgtttaccgttcctaccgttccccg

SEQ ID NO: 186836 - DNA, 536 bp, Homo sapiens
  misc_feature: GYAE6OF02FJORK.10.33.C11.1.454.CMB.1.raw
  modified_base (364)..(364): a, c, t, g, unknown or other
  misc_feature (364)..(364): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaccagggaaggcccctaaactcctgatctacgatgcatcgaacttggaaacaggggtcccatcaaggttcagtggaggtggatctgggacagtattttacnctcggctagtcccgcacgcctgcagcctgaagattttgacgtacatattactgtactaacagttatagaaattgtacccgtctctaccgtttcggccgggggaaccagggtggtagttacgtaaaccggaacgtgtacggtctcgctaaccatccgtgttcttctattcccg

SEQ ID NO: 186837 - DNA, 579 bp, Homo sapiens
  misc_feature: GYAE6OF02FH6SG.10.33.C11.1.454.CMB.1.raw
  modified_base (325)..(325): a, c, t, g, unknown or other
  misc_feature (325)..(325): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttggccgggcagtccaggacatttaacaagttactttaaattggtatcagcaagaaaccgagggaacggacccctaaactcctgatctacgatgcatcgaactaggaaacgngggtacccatacgaaggttcaggtggaggtggatcgtagggacagtattttactcgtcggtcacgtccgctacgcctagcgacgtacctagtaacgttatttagcggtaactaattatttacgtgtaccaactaagtaatagtaaattcgtacccgtactaccgtacgtttcgggaccgggggtacaagggtaggtacgttacgaacgtaacgtaggtacgcgtagacaccgtactcttcgtcttcacttcccg

SEQ ID NO: 186838 - DNA, 721 bp, Homo sapiens
  misc_feature: GYAE6OF02G6BFL.10.33.C11.1.454.CMB.1.raw
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatccctcctgtatgcatctggtaggagacagcgtcaccatcacgttcggccgggcagtcaggactatttaacaagttactttaaattggtatcagcaagaaaccgagggaacgacccctaaactcctgatcaacgatcgacatacgtaacgttacggaaacgacggggtacccaagtacgtaaggttcgaggtgggaggtggacgtgagggaactagtaattttacgcgtaccggtcacgttccgacacgtccgtggaccgacgtccgtagtaaagtcgttttacggaccgtaactaacgttaactttaacgtacgttaaccaaacgtaaggtaaagttaacgtaaaaacgttcccggttaccccgtacgttaccggttaacgggtttacccggggggaccggggtaaaccggtaacgggggttaacggtaaccggttaaccggtaaaacgggtaccggtttaacggggtacggtaaccgttaccggtaaccctaaccgtaccgtttaccgttaccggttttaccctttaccgtaccttttaccccccgg

SEQ ID NO: 186839 - DNA, 781 bp, Homo sapiens
  misc_feature: GYAE6OF02I1WNF.10.33.C11.1.454.CMB.1.raw
tcagcatagtagtgcacgaccggtgctcgatttagagtgagctcgttgggtttgggggagtcagtcccaaccaggacacagcatggacatgagggtccctgctcagctcctgggctcctgctcctctggctctcgggtgtcagatgtgacatccagatcgacccagtctccatcctcctgtatgcatctgtaggagacagcgtcaccatcacgttcgccgggcagtcaggtactatttacaagttactttaaagtggtatcagcaagaaaccgagggaaccgaccctaaactctagactactacgatcgactagtaccgtaaacgttagggaaaaccgtcggggttacccaaggttaccgtaaaacggggtttcctaaagggtacggggtaacgggttacggtaaagtttcccggttaggggaaacctacggttttaacgtttttaaccgtcccggttacggtaccgtaacgttccccggtacgtaaccggtcccgttacggtacccgtaaacgtccggttaacggtaaacggtttaacgttttaccggaaccgtaacgttaactttaacgtttaccgtacggtaaacctaaacgtaagttaagtaacggttaaaacttccggtacccgtacgtttaacccgttaccgggttttaccggggaccgggggttaaaccgaaggggtttacgggtaaccgttaacgtaaaccggtaaacgttggtacggtacgtacgtacgtaaccgtacgttaccttacggttacttaccgtacttaccccgg

SEQ ID NO: 186840 - DNA, 805 bp, Homo sapiens
  misc_feature: GYAE6OF02I4Q8A.10.33.C11.1.454.CMB.1.raw
tcagcatagtagtgcacgaccggtgctcgatttagagtgagctcgttagggtttgggggagtcagtcccaaccaggacacagcatggacatgagggtccctgctcagcgtcctggggctcctgctcctctggctctcgggtgtcagatgtgacatccagatgacccagtctccactcctccctgtatgcatctggtaggagacagcgtcaccatcacgttcggccgggtcgagtcgaggactattacaagttactttaaagttaggtatctagacaacgaaaccgaagggaacggaccctaaacctcctacggtatacgtacgtagtcgactacgtacgtaacgttacgggaaacgtacggggtaccctaacgttaccgtaaacggttacgtaacggtagggtaacgggtagggtacgttacggtaggggtaaccgttaaggttaacgttttaacccgtccggttaccggtccgtaaccgttcccgtaccgtaaccggtcccgttacggaccgtacggacccgttaggtaaacgtttacgttttacggaaccggtaactttaagttaacgttttacctacgttaacctaaacgtagtttaaacgtagtaaaaccgttccggtaaccccgttcgttaacccggttaccgggtttaccggggggacccggggttaaaccgtaacggggttaacgggttaacggttaacccgtaaaacgggtaaccggttacggttacggaccgttacgggtaaccctaccgtaacgtttaccgttaccgtttacctttaccctaacgttttcccccg

SEQ ID NO: 186841 - DNA, 677 bp, Homo sapiens
  misc_feature: GYAE6OF02J1YJC.10.33.C11.1.454.CMB.1.raw
  modified_base (222)..(222): a, c, t, g, unknown or other
  misc_feature (222)..(222): n is a, c, g, or t
tcagcatagtagtgcacgaccggtgctcgatttagagtgagctcgttgggtttgggggagtcagtcccaaccaggacacagcatggacatgagggtccctgctcagctcctgggctcctgctcctctggctctcgggtgtcagatgtgacatccagatgacccagtctccatccctccctgtatgctatctgtaggacacagctacaccatcacgtgccggnagtcagactattacagttacttaatgtatcagcaagaacgaggaacggacccctaaactccagtatacgtacgatcgacacgtacgaacgttaggaaacgtacgggtaccagtacgtaaggttcgagtgggtaggtggtacgtcgtagggtactaagttacgttttaacgcgtccggtactacgttcccggtaacgtacgtcccgtagtaccgtaacggtacccgttaaggttaacgttaacgttttcggaaccgtaattaacgtttaacgttacttcggtaactaacgtaagttaacgttaacggtaaacttccggtacccgtacgttaccggttacccgggtttacggggacccggggtaactaagggttcggtacgttaacgtaacggtacgttggtacgtcgttaccgacgttacgtaacgttccttacgtttaccgttacctcttccccg

SEQ ID NO: 186842 - DNA, 700 bp, Homo sapiens
  misc_feature: GYAE6OF02GJQQR.10.33.C11.1.454.CMB.1.raw
tcagcatagtagtgcacgaccggtgctcgatttagagtgagctcgttgggtttgggggagtcagtcccaaccaggacacagcatggacatgagggtccctgctcagctccgtgggctcctgctcctctggctctcgggtgtcagatgtgacatccagatcgacccagtctccatcctccctgtatcgcatctggtaggagacagcgtcacatcacttgccggcgagtcaggactatttacaagttactttaaattggtaatctagcgaacgaaccgagggaaccgacccctaaacgtccgtacgtactaccgtaacgtacgtgacctaagttaaccggtaacttacgggaaaaccggtcggggttacccaacgtacgtaaacgggttcaacgggtcggggtaaggttacggtaacgtttcgggaacggtaacgtacgtaacgtttttacctacgccggtactacgtacccgaccgtacgccttacggaccctacggtaccgtaaggtaacgttaagtttcgtacgaacttagttaacttacgttacgttaactaaacgtagttaaagtacgtaaagttccgttacccgtcgttaccgttacggttaccgggacggggtaaccgtaagggttacggtacgtaacgaacggtaacgtgtcggacttacgacgtactacgacttccgttctcgtacttacccg

SEQ ID NO: 186843 - DNA, 791 bp, Homo sapiens
  misc_feature: GYAE6OF02IDD3B.10.33.C11.1.454.CMB.1.raw
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtacaccatcacttggccgggcgagtcaggaactatttaacaagttactttaaattggtatcaagacgaacggaaaaccgagggaaccggacccctaaaactccgtagtaacttaccgtaacggattgacctaattacgtaaacgttagggaaaaccgtacggggtacccaagttacgaaacggttcaagggtcgggtaaggcggtatacgtgggaaactaggttaacttttaacgcgtaccggtcgtaaccgtcccggtacaccggtaccgtacggaccgtacgacccgttaacggtaagttaacgttttacggaccggtaaacttacgtttaaactttaacgttacgttaaccgtaaaaccgtaaggttaaacgttaaacgtaaaaacggtttaccggttaccccggtaccgtttaccggttaaaccgggttttacccggggggaaaccggggggttaaccggtaaacggggttacgggtaaccgggtttaaaccgaaaccgggttaacgttccgggttacggtacccgtacgtacccgtaaccgtaacgttccgttacggttaccctttaccgtaacttacccccg

SEQ ID NO: 186844 - DNA, 731 bp, Homo sapiens
  misc_feature: GYAE6OF02GBBKY.10.33.C11.1.454.CMB.1.raw
  modified_base (139)..(139): a, c, t, g, unknown or other
  misc_feature (139)..(139): n is a, c, g, or t
tcagcatagtagtgcacgaccggtgctcgatttagagtgagctcgttgggtttgggggagtcagtcccaaccaggacacagcatggacatgagggtccctgctcagctcctgggctcctgctcctctggctctcgggtntcagatgtgacatccagatcgacccagtcctccatccctcctgtatgctatctagtaggagacagcctcacctatcacgttcggccgggcagtcgaggactatttacaagttactttaattggtatcaagcaagaaaccgagggaacgacccctaactcctagtactctacgagtgactactacgtaacgttaggaaaccgtacgggtacctaacgtacgtaacggttcgaagggtagggagggttacggaagttacggtaggggtaactaagtttacgttttacctcggttaccggtacctaccgttccggacgtaaccggtccctacggaccgtaccggtaccgtaaggtaacgtttacgtttacggaaccttaacgttaagtttaccgtttacgtacgttaacctaaacgtagttaacgtaaacggtaaacgttcccgtacccgtacgttaccggttaccgggttccggggacggggtaaaccgtaggggttaacggttacgttaaccgaaacggttacggttacggtacggtcgtaccgtacctaccgttaacttccggttaccgtttaccttaccgtacttcccccg

SEQ ID NO: 186845 - DNA, 702 bp, Homo sapiens
  misc_feature: GYAE6OF02HVA9M.10.33.C11.1.454.CMB.1.raw
  modified_base (689)..(689): a, c, t, g, unknown or other
  misc_feature (689)..(689): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatcgacccagtctccatccctccctgtatgcatctggtaggagacagcgtaccacctatctacgttcggccgggacgagtcaaggactaatttacaaagttcttttaaaagttggtatacacgacaacgtaaaaccgacggggaaaccggtacccctaaaactccgtagaacttacgtaacgatcgactaacgtacgtaacgttacggaaaccggtacggggtaccctaagtacgtaaggttacgagggttaggaggttagagttacggtaggaactagttactttaccgtcgtacgactacgtccgatacgctacggactacggtctaggtaacttcgttacgacgtaattaattaacttacgtactaacaacgtacgttaataaacggtaaacttcccggtacccgtagttaccgttaccgggttccggggggaaaccggggtaaacttaaggggtcgtaacgtaacccgtaaacggaggttaaccggtggtacctagacctacgtacgttaccgttacgttcctttacncccgtttaccccg

SEQ ID NO: 186846 - DNA, 599 bp, Homo sapiens
  misc_feature: GYAE6OF02IYOPM.10.33.C11.1.454.CMB.1.raw
  modified_base (426)..(426): a, c, t, g, unknown or other
  misc_feature (426)..(426): n is a, c, g, or t
  modified_base (461)..(461): a, c, t, g, unknown or other
  misc_feature (461)..(461): n is a, c, g, or t
  modified_base (582)..(582): a, c, t, g, unknown or other
  misc_feature (582)..(582): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttggccggcgagtcaggactatttacaagttactttaaattggtatcagacagaaccgagggaacggaccctaaactcctagatctacgatgcatacgtaacgttaggaacgtacgggtcccagtacgaaggttacagtgggaggtgtagtgtaggactagtatttacctcgtcgactacgccgacgcgaccgtgcacgtacctagaacgttntttacgcgtaactaattattaccgtacgtactaanaagttataagtaaacttccgtcccgacttaccgtaccggttttccggggacggggaccgtaaggtacggtacgttaacgaaaccgtacggtggtacggcgtcgacctacgtactaccgttnttccttactccttcccg

SEQ ID NO: 186847 - DNA, 760 bp, Homo sapiens
  misc_feature: GYAE6OF02I2LYL.10.33.C11.1.454.CMB.1.raw
tcagcatagtagtgcacgaccggtgctcgatttagagtgagctcgttgggtttgggggagtcagtcccaaccaggacacagcatggacatgagggtccctgctcagctcctgggctcctgctcctctggctcgtcgggtgtcagatgtgacatccagatcgacccagtcctccatccctccctagtatcgcattcctggtaggagacacgtcgtacaccatcctacgttcggcccgggcgtagtccgaaggtactacgttttaacgaagttacttttaaagttggtaactacgagaccaaaggaaacccgaaggggaaccggtacccctaaaaccttccgtacgtaactaccgttacggacttcgacctaagtccgaaacgttacggaaaccggtcggggtaccccagtaccgtaaggttaccgagggtagggtagggtacgtagtaccggtagggaactaggttaactttaccgtcgtaccggtactacgttcccgacgtaccgccgtcgacgtacgtaccgttaggtaagttacgtttagggaacccttaacttaaagttaactttaactaccgttaaactaacgtaagttaagtaaacgtaaacgttcccgtacccgttaaccgttaccggttaccgggttaccgggggaccgggttaaacccgtaagggtccggtaacgtaaccggtaaaccgtcgggtagtcggtacgtcccgaacaccgtacgttccgtaacggtttcttcctaccgttccccg

SEQ ID NO: 186848 - DNA, 695 bp, Homo sapiens
  misc_feature: GYAE6OF02INNHK.10.33.C11.1.454.CMB.1.raw
tcagcatagtagtgcacgaccggtgctcgatttagagtgagctcgttgggtttgggggagtcagtcccaaccaggacacagcatggacatgagggtccctgctcagctcctggggctcctgctcctctggctcgtcgggtgtcagatggtgacatccagatgacccagtcctccatccctccctgtatgcatcgtgtaggagacagccgtaccaccatccgacttcggccgggacgagtcgaggtactatttacaattacttttaaattcggtatacagacgaagaaaccgagggtaaccgaccccttaaacgtcccgtagtacttctacgtatcgactacgtacggtaacttaacgggaacgtacggggtaccagtaccgtaaggttcgaaggtagggtacggtaggactacggtacgggaactaaggttacttttacgtcgtcggtcctacgtcccgacgtacgtaccgtgacgtacgtacgtaggtaacgttatttacggactaactatttaattaccgttagtaacctaaacgattaacgtaagtaaacgttccgtacccgtcttaccgtaccgggttccggggaaccggggtaaccgtaaggggttacggtacgttaaccggtaaacgtcggtaggtccgacgtccgaccgtaccgttacttcgttacgtcccgttactaccttccccgg

SEQ ID NO: 186849 - DNA, 766 bp, Homo sapiens
  misc_feature: GYAE6OF02GVJQ5.10.33.C11.1.454.CMB.1.raw
  modified_base (197)..(197): a, c, t, g, unknown or other
  misc_feature (197)..(197): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatccctcctgtatgcatctgtagganacagcgtcaccatcacttcggccgggcgagtcaaggactaatttaacgaagttacttttaaagtggtatacgagacaacgaaaccgtaacgggaaccggtacccctaaaaccgttccgtagacttactaacggtactcggactactaccggtaaacgttacgggaaaaccggtaccggggtaccctaagtaccggttaaaggtttacctaaggggttacgggtaagggtaggtaacgtttcgggtagggtaactaaggtttactttttaaccgttccggtaccgggtctaaccggttcccgacgtaaccgtcccgtacgcccgtacgtccgtagtaacgttacgtttacggacgtaacaagtttacttacgtagttactaacgtagttaagtaagtaaactccgtcccgtaccgttaccgttaacccgggtttacggggacccgggggtaaacgtacggggttacgggttaacgttaacccgaaggttaaccggttcgggttacggtacccgtacggtaccctaaccgttacgttccgttacgttaccgtttaccgtaccgtttccccg

SEQ ID NO: 186850 - DNA, 667 bp, Homo sapiens
  misc_feature: GYAE6OF02GIQMO.10.33.C11.1.454.CMB.1.raw
  modified_base (221)..(221): a, c, t, g, unknown or other
  misc_feature (221)..(221): n is a, c, g, or t
  modified_base (269)..(269): a, c, t, g, unknown or other
  misc_feature (269)..(269): n is a, c, g, or t
  modified_base (659)..(659): a, c, t, g, unknown or other
  misc_feature (659)..(659): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtagagacagcgtcaccatcacgttgccggngagtcaggactatttacaagttctttaaattggtatcagcagaaaccngggaacgcccctaaactccagtactacacgagtgactacgtacgtaagttacggaaacggtcgggtacctagtacggtaaacggttcgaaggttacgggtagggtacgtagtacggtacgggaacgtaacgtttaacgttttacgtaccgttcgggacctacccggttacccgccgtaacggtcccttacgggactaccgggtacccttaagggtaacgtttagttttccggaacctaagttaacttactttaccgtagtaactaaagtagttaataaagtaaacgttcccggtacctacgtcggttaaccgggtttccgggacgggtaactagggtcgtacgtacgaacgtcgtggactagcgacctaacgtctccgttactcttactnttaccccg

SEQ ID NO: 186851 - DNA, 800 bp, Homo sapiens
  misc_feature: GYAE6OF02G4P6N.10.33.C11.1.454.CMB.1.raw
  modified_base (756)..(756): a, c, t, g, unknown or other
  misc_feature (756)..(756): n is a, c, g, or t
tcagcatagtagtgcacgaccggtgctcgatttagagtgagctcgttgggtttcggggagtcagtcccaaccaggacacgagcagtggacatggacggtcctgctcagctcctgggctcctgctcctctggcctctcggtgtcagatgtgacactccgagatcgacccagtcctccactccctaccctgtactgactactccgttggacggacggacagccgtacacccgtatcacgttcggaccgggacagttaccgacggtacttacgtttaacgaacgtttattttaaacgttggtaactacgagacgaaacgtaaacccggaagggaaccgttaacccccgtaaaagttccccgtaaggtactttaaccctaaggtaaacttcggacctaaacgtacgttaaaaccggttcgggaaaaccgtccggggttaacccctaacggttaccgtaacggggttaaaccctaggggtttaaccgggaacggggttccggaagttttaccggggacgggtaaaagttcgtttaaaaccgtttttcccgaacggttccgttaaccggacttccgaacgcgtaccgttacgccgtacgtaccgtagtaacgttaacgtttcgacgtaactaagttacttacgttacgacgtaaacgtaagtaacgttaacgaaacgttcccgaccgttacctaacgttccgggtttaccgggccggtaaaccggttcggtaagtacgtacctaacggtaacgtcggtaccngtaccgtagccgttaactccggttacttacggtctatcccccgg

SEQ ID NO: 186852 - DNA, 692 bp, Homo sapiens
  misc_feature: GYAE6OF02F6VAV.10.33.C11.1.454.CMB.1.raw
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatcgacccagtcctccactccctccctgtatgcatctgtaggagacagcgtcaccatcacgttcggccgggcgtagtcaggactattacaagttactttaaagttggtatcgagacaagaaacgtagggaaccgacccctaactccgtagtatactacgatcgctacgtcgtaacgttacggaaaccgtacgggtaccagtacgaagttcgaggtgggtaggtggagttcggtaggacgtagtttactttacgcgtacgactacgtccgcgtacgtccgtcgaccgacgtacgtagtaagttcgtttacgaccgttaacttacgtttaacttaccgttagtacgtaaacgtaacgtaattaacggtaaaccgttccgttacccgtacgttaccgttaccgggttaccggggaccggggttaaccgtaagggttcgggttaacgttaacggtaaaccggttacggttacgggtacggttaccgtacggtacctaccgtacgtttccgtccgtttaccgttccttaccgttaccccg

SEQ ID NO: 186853 - DNA, 656 bp, Homo sapiens
  misc_feature: GYAE6OF02JFWIP.10.33.C11.1.454.CMB.1.raw
  modified_base (213)..(213): a, c, t, g, unknown or other
  misc_feature (213)..(213): n is a, c, g, or t
  modified_base (226)..(226): a, c, t, g, unknown or other
  misc_feature (226)..(226): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctcgtcgggtgtcagatgtgacatccagatcgacccagtcctccatccctccctgtatgcatctgtaggagacagcgtcaccntcacgtggccggngagtcaggactatttacaagttctttaaatggtatcagcaagaaaccgagggaacgacccctaaatcctagactctaacgatgacatacgaacgttacgggaaaccgtacgggtccccaagtaccgaaaggtttcaagggtgggagggttcggaagttcggaggggaacctaaggttactttttaaccgcgtacggacctagtcccgcgacgcccttggacctacgtccgttagtaacgttacgttttcgacgtaacttaattactttacgtactacctaaactaggttaactaagtaaacgttccgtacccgttactacgttaaccgggtttacgggggaccggggtaactaggggtacgtacggttacaaacggtaacgttggtacggtctacgtaccactcgtcttacgttacttcgtacttacccg

SEQ ID NO: 186854 - DNA, 656 bp, Homo sapiens
  misc_feature: GYAE6OF02G5Q38.10.33.C11.1.454.CMB.1.raw
  modified_base (355)..(355): a, c, t, g, unknown or other
  misc_feature (355)..(355): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcagtcaggactattacaagtctttaaatggtatcagcagaaaccagggaacggacccctaaactcctaggactctacgatcgcatacgaacttcggaaacaggggtacccagtacgaaggttacagtgggtagnggtatcgtggactagtattttactcgtacggctagtccgcacgccgtacgctagccgtagaagtacttttgaccgtactaagttactttaacgtacgttaacaactaaggttaataaggtaaaaacttcggtaccccgacgttaccttaaccgggtttaccgggggacccgggggtaaccgtaacggggtacgggttacggtttaacgaaaccgggttaaacgttcgggttacggtaccgttacggtacccaacccgttacgttaccgttacgtttcccgtttacgttacctttaaccccg

SEQ ID NO: 186855 - DNA, 719 bp, Homo sapiens
  misc_feature: GYAE6OF02GJAY6.10.33.C11.1.454.CMB.1.raw
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatcgacccagtcctccatccctcctgtatcgcattctggtaggagacagcgtaccacctatctacttcggccggtcttaacgtcgaggactatttactaagttactttaaagttggttatacgagacaagaaaccgagggaacgtacccctaacgtacctagtactactacgtatacgtacacgtacgtaacgtaaggaacggtacggtacccgtactacggtacgttacgtaggtagggaggtaccccggtagtacggtacggtacgtaagttacgtttacgtacgtacggtacgtacgtccgacgtacgtccgtacgcgtacggtaccgtagtaacggttacgtttacgacgttaactaagttacgttacgttacgtaacgtaactaacgttaagtaacgtaaacgttccgtacccgttccgttaaccgttaccgggtacgggtaaccggggtaaccgtaagggtacgttacggttaacggtaaacggtaacggtacgtacggtacgtaccgaaccgtaccgtacgttaccgtacgttccttacgttaccgttacccccg

SEQ ID NO: 186856 - DNA, 797 bp, Homo sapiens
  misc_feature: GYAE6OF02IIZKU.10.33.C11.1.454.CMB.1.raw
  modified_base (164)..(164): a, c, t, g, unknown or other
  misc_feature (164)..(164): n is a, c, g, or t
tcagcatagtagtgcacgaccggtgctcgatttagagtgagctcgttgggtttgggggagtcagtcccaaccaggacacagcatggacatgagggtccctgctcagctcctgggctcctgctcctctggctctcgggtgtcagatgtgacatccagatgacccngtctccatccctccctgtatgctatctggtaggagacagccgtcaacctatcctacgttcggacccgggcgacgttacgagggtacctaagttttacgaaagtttaccttttaaaagtttggtactcgtaagaccaaggaaaaccggaggggaaccggtacccccttaaaacgtccccgtaagtacgttaccgtaacgtagtacgactacgttacggtaaacgtttaacggaaaccgtacgggtaccctagtaccgtaaggttacctaagggtgggtacggtacggtacttcgggtacggtaacgttaggttaacgttttaaccgtcggtaccggtaccttaccggtcccgtacgtaccggtcccgtacgtacgtaccgtcctaaaggtacgtttagtttcggtacgtacttaagtttacttacgttacgtaaccgtaaactaaggttaactaaggtaaaacgttcccgttacccgacgttaccgttaccgggttaccggggaccggggtaacggtaacgggttcggtacgttaacgtaaaccggtacggttaccgggtacggtcccgtaagtacccgttaacccgtacggtttaccgtccgtttaacccgtttccgacccttttacccccgg

SEQ ID NO: 186857 - DNA, 773 bp, Homo sapiens
  misc_feature: GYAE6OF02HXW2V.10.33.C11.1.454.CMB.1.raw
  modified_base (231)..(231): a, c, t, g, unknown or other
  misc_feature (231)..(231): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatcgacccagtctccactccctccctgtactgcatctggtaggagacagcgtacaccatccacttcggccgggngagtcaggactattacaagttactttaaattggtatacgagacaacgaaccgagggaaccgtacccctaaactcctagtactacgtacgtatcgactacgtacggtaacgttacgggaaacgtccggggttaccccaagtaccggtaaaggtttaccgagggttaggggaggtcgggttaacgtcggtaacgggtaacttagttaacgtttttaccgaccgttaccggtaccttaccggtcccgaccgtacgtcccgtcggaccgtacggtacccgtaaggtaacgttcgttttacggaccgttaactaacgtttacgtttaaccgttacgttaaactaacggttaaggttaaacttaacgggtaaaaccgttcccggttaccccgtaaccgttccgtttaccggggtttaccggggggaaccgggtaaccgggttacggggttacggtaaccggttaaccgaaaccgggtacggttcggtaccggtacgtaccgtaaccaccgttacgttcccttacggttaccttcgttacccttccccg

SEQ ID NO: 186858 - DNA, 676 bp, Homo sapiens
  misc_feature: GYAE6OF02JL0JO.10.33.C11.1.454.CMB.1.raw
  modified_base (534)..(534): a, c, t, g, unknown or other
  misc_feature (534)..(534): n is a, c, g, or t
  modified_base (645)..(645): a, c, t, g, unknown or other
  misc_feature (645)..(645): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtcctccatccctcctgtactgacattcgtaggtaggacgtacaggccgtacacctatccaccgttggccggggtacagtcgaggtactaacgttacgtaagttactttaaagttggtactcagcaagaaccgaggaacggaccctaaactcgtacgtactacgtaccgtatcgactactacgaacgttaggaaaccgtaccggggtaccaagtaccgtaaggttaccgagggtagggtaggtcggtaacgtaggtacggaacgaacggtttagtttacgtaccggtccggtaccacgttaccggtccgaaccgtcctggtacccaggttcagttacgtagtttcgaccgtagtaacttaacttaccgngtaacgtaactagtaacggtagtaaactccgtacgtacgtccgttaacgttaccgggggacggtaaccggacgttacggagttaaccaaggtaacgtcggtacgcgaccgngtaacctcgtcgtacgttctacttcctaccg

SEQ ID NO: 186859 - DNA, 632 bp, Homo sapiens
  misc_feature: GYAE6OF02HZJ2S.10.33.C11.1.454.CMB.1.raw
  modified_base (232)..(232): a, c, t, g, unknown or other
  misc_feature (232)..(232): n is a, c, g, or t
  modified_base (324)..(324): a, c, t, g, unknown or other
  misc_feature (324)..(324): n is a, c, g, or t
  modified_base (414)..(414): a, c, t, g, unknown or other
  misc_feature (414)..(414): n is a, c, g, or t
tcagcatagtagtgcacgaccggtgctcgatttagagtgagctcgttggggtttgggggagtcagtcccaaccaggacacagcatggacatgagggtccctgctcagctcctgggctcctgctcctctggctcgtcgggtgtcagatgtgacatccagatcgacccagtcctccatccctacctgtatcgctatcgtgtaggagacagcgtacaccatcacgttggccgganagtcgagacttattaacaagttactttaaagtggtatcagtacaagtaaaccgagggaaccgacccctaaactccgtagtactacgtacgancggtacagtacgtaacgttacgggaaacgtcgggtacccagtacgtaacggtcaggtcgggagtggtatcgtaggactagttactttacncgtcgcacgttcgctacgcctacgctacggtacctagtaacgttcgtttacggactaagttactttacgtacgtactaaccgagtaacgtaatagtaaccgttccgacctcgttaccggtacggttaccgggggacggtaactaaggtcgtaacgttacgaacgtacggtgacgtcgacgtacgtacgtacttcgtcgtttactccgtaaccttcccg

SEQ ID NO: 186860 - DNA, 627 bp, Homo sapiens
  misc_feature: GYAE6OF02GJIGI.10.33.C11.1.454.CMB.1.raw
tcagcatagtagtgcacgaccggtgctcgatttagagtgagctcgttggggtttgggggagtcagtcccaaccaggacacagcatggacatgagggtccctgctcagctcctggggctcctgctcctctggctctcgggtgtcagatgtgacatccagatgacccagtctccatccctcctgtactgcatctgtaggagacagctcaccatccacttggccgggcgagtcaggactatttacaagtctttaaattggtatcagcaagaaaccgagggaacggacccctaaactcctagactctaacggatgacagtacgaacgttaggaaaacgtacggggtacccatacgaacggtttacaggttgggtaaggtggaatcgtagggactaagtacttttacgtacgtcgcagtccgctaacgcctgctacgcctagtaagtattttacgacgtaacttattaactttactacgtacaaacgtagtaattaaggaaaacttcgtacccgtacttaccgtaaccggtttcgggaccgggggtaactaacgggtagggtacgtacgaaacggtactaggtacggtacgtacgtaccacgtataccgttcgtacttacctacttaccccg

SEQ ID NO: 186861 - DNA, 765 bp, Homo sapiens
  misc_feature: GYAE6OF02GM0YD.10.33.C11.1.454.CMB.1.raw
tcagcatagtagtgcacgaccggtgctcgatttagagtgagctcgttgggttggggagtcagtcccaaccaggacacagcatggacatgagggtccctgctcagctcctgggctcctgctcctctggctctcgggtgtcagatgtgacatccagatcgacccagtcctccactccctcctgtactcgcatcgtaggtagagacgagccgtacacctatccgacgttcggccgggacgtaagtcgaacggtactagttttaaccgaaggttaccgtttttaaaagttacgggttactaccgtaacggacctaaacggaaaaacccggtaaggggtaaacccggtaaccccttaaaacctccccgtaggtaaccttaccgtaaccgagtcgacgtacgtacgtaacggttacggaaaccgtacggggtaccctagtaccgtaacggttcaacgggttggtaggtacggtagttaccgggtagggaactaagtttacgttttacccgcggttaccggtaccgtacgtcccgcgtaacggtccgtacggacctacggtaccgtaggtaacgttcgtttaaccgacggtaacttaaggttactttaccgtaggtacctaaacggtattaacggtaagtaaaccgttccggtaccgtaccgttacggttacccgggttacggggaacccggggtaacgtacggtaggtaccgttacgaacgtacggtgtacggactcgaccgtactcttcgtacttcttaccgcttcccgg

SEQ ID NO: 186862 - DNA, 763 bp, Homo sapiens
  misc_feature: GYAE6OF02JW5NI.10.33.C11.1.454.CMB.1.raw
  modified_base (208)..(208): a, c, t, g, unknown or other
  misc_feature (208)..(208): n is a, c, g, or t
tcagcatagtagtgcacgaccggtgctcgatttagagtgagctcgttgggtttgggggagtcagtcccaaccaggacacagcatggacatgagggtccctgctcagctccgtgggctcctgctcctctggctcgtcgggtgtcagatgtgacatccagatcgaccctagtcctccattccctcctagtactgctatcgtaggtagganacgcgcgtaccacctatccacgttcgggcccgggacgtacgtcgtaacgggaaccttactttaaccgtaagtttaaccgttttaaagttacgggttaacttaccgaacgtacgaaaccggtaaaacccggaaaggggtaacccggtacccccttaaactaccgtacggtactaccgtacggatacgctaacgtaccgtaaacggtaacggaaccggtacgggtacccagtaccggtaagggttcctaggtaggggtaggtaggtaacgtcggtacgggtaactacggtttaactttaccggtccgtacggtacctacgtaccgtaccgtaccgtaccgtacgtacccgtacgtaccgtacggtaacgttacgttacgtacgtaacttattacttacgtactacgtaactacgtaagtacgtaaacgtccgttacccgttacgtaccggttacgggttccgggtaccgggaacggtacggtaggtacgttaacgtaacggtacggtagtacggtacgtacgacctacgtacgtcttcgtacttcgtaccttacccg

SEQ ID NO: 186863 - DNA, 746 bp, Homo sapiens
  misc_feature: GYAE6OF02HBRSP.10.33.C11.1.454.CMB.1.raw
  modified_base (204)..(204): a, c, t, g, unknown or other
  misc_feature (204)..(204): n is a, c, g, or t
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
tcagcatagtagtgcacgaccggtgctcgatttagagtgagctcgttgggtttgggggagtcagtcccaaccaggacacagcatggacatgagggtccctgctcagctccgtggggctcctgctcctctggctcgtcgggtgtcagatgtgacatccagatcgacccagtcctccactccctccctgtatgctatctggagganacgngcgtcaccatcncgtcggccgggngagtcaggactagtttacaagttactttaaagttggtatcagacaagaaccgagggaacgaccctaaactcctagactctacgatacgctacgtacggtaaacttacgggaaaccgccggggtaccctacgtacgtaacggttacgtagggtaggggtagggtgtacgtacggtacgggacttaagttacttttacgtccgtacggtacgtaccgtccgaccgtacggtacctcgaccgtacggtaccgtacggtaaaggttgtttaccggacgtaaccttaagtttaaccttacgtacggtaactaacggtaagtaacgttaaagtaaccgttaccgttacccgtccgtttaccggtaccgggttttaccggggggaccggggtaaccgttaacgggggtacgttaccggttaaacgggtaaaccggtccggttacgggtaccggtacgttaccggaccgttaaccgttcgttaccgtttcggtttaccctttacgtacccgtttacccccgg

SEQ ID NO: 186864 - DNA, 744 bp, Homo sapiens
  misc_feature: GYAE6OF02HG86C.10.33.C11.1.454.CMB.1.raw
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatcgacccagtctccatcctccctgtatcgcatctggtaggagacagcgtacaccatccaacgttcggccgggacgacgtacgaacggtaacttaactttaacgaaacggttacttttaaaaacggtttggttaacttaccgaagaccaaacgggtaaaaacccgacggggaaaaccgggtacccccctaaaacgtccctaggtaactacgtacgattcgactacgtacgtaacgtaacgggaaaccgtacggggtccccaagttacgtaaggtctaggtacgggaaggtcggaagtcggtagggactagttacttttactcgacggctacgtccgcacggtcctgacacgtaccgtagtaagttcgtttcgacgtaactattacgttactacgtaccgaaactaagttaagaacgttaaaacgttccgtacccgttacgttaccgttacccggggttacgggggtaccggggaaacgttacggggtaggtaccggttaaccgtaaacgggtaacgtcgggttacggtaccttacgaccgtaaccgttacgtacgttccgtttaaccgttaccgtacgtttcccccg

SEQ ID NO: 186865 - DNA, 818 bp, Homo sapiens
  misc_feature: GYAE6OF02HISGJ.10.33.C11.1.454.CMB.1.raw
  modified_base (145)..(145): a, c, t, g, unknown or other
  misc_feature (145)..(145): n is a, c, g, or t
tcagcatagtagtgcacgaccggtgctcgatttagagtgagctcgttggggtttgggggagtcagtcccaaccaggacacagcatggacatgagggtccctgctcagctccgtggggctcctgcctcctcgtggctcgtcgggtntcagatgtcgacatccaagtatcgaccctagtcctccacttccctcctgtactcgactattcgtggtaaggaacgacagccgtacaacctatcctacgttcggccgggacgtagtacaggtaaccttaacgtttaacgtaacgtttactttaaaagttggtactacgacgaactaaacggaaaccggaacggggaaccgtaaccccgttaaactccgtacgtacttaccgtagtactacgacgtacgtaccgtaacgttaacggaaacccggtaccggggtaacccctaaggtacggtaacggttacggtaagggtacgggtacgggtaggttaacgtacggtaacgggtaagttacgtttacgttttaccgtccggtacgtaccgtaccgtcccgacgtaccgtccgtaggtacccgtacggtacgttaacggttaagtttaccgttacggaacgtaacgttaacgtttacggttaacgttacgtaaacgtaacgtaagttaaaccgttaaagtaaaccgttccggtacccgttacgttaaccggtttaccggggtaccgggggaaccgggttaaccgggtaacggtaccgggttacgtaacgtaaccggtcggtacggtcggtacgtaccgtactacgtacgttccgtacttacgttccgtccgttacccg

SEQ ID NO: 186866 - DNA, 752 bp, Homo sapiens
  misc_feature: GYAE6OF02GUOB0.10.33.C11.1.454.CMB.1.raw
  modified_base (687)..(687): a, c, t, g, unknown or other
  misc_feature (687)..(687): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatcgacccagtctccatcctccctgtatcgcatcgtgtaggagacagcgtcacatcacgttcggccgggcgagtccaggtactaatttaactaagttacttttaaagttggtatcacgacaacgaaaccgagggtaacgacccctaaactcctgactctacgatgacagtacgaacgttacggaaacgtacgggtaccagtacgtaacggttcgaggttacgggtagggtacggtaacttcggtacgggtaacgttaaaggttaaccgtttttaaccgtccggttccgggtacctaaccgttacccggcgtaccgtcccgtttagaccgtaccggtacccggttaaggtaacgttacgttttacgaccggttaacttaacgtttacgttaccgttacgttaacaaccgtttaaggtaaacttaaacgggtaaacttcgggtacccctcgttaacccgttacggggttacccgggggtaacggggtaaccgtagggggttaacgtacggttaacggaaaccgggttaacgnggttccggaacgtctacccggttaacctcgttaccgttactaccgtttaccgtaccgtttacccc

SEQ ID NO: 186867 - DNA, 566 bp, Homo sapiens
  misc_feature: GYAE6OF02G430Y.10.33.C11.1.454.CMB.1.raw
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
  modified_base (371)..(371): a, c, t, g, unknown or other
  misc_feature (371)..(371): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (404)..(404): a, c, t, g, unknown or other
  misc_feature (404)..(404): n is a, c, g, or t
  modified_base (412)..(412): a, c, t, g, unknown or other
  misc_feature (412)..(412): n is a, c, g, or t
  modified_base (422)..(422): a, c, t, g, unknown or other
  misc_feature (422)..(422): n is a, c, g, or t
  modified_base (435)..(435): a, c, t, g, unknown or other
  misc_feature (435)..(435): n is a, c, g, or t
tcagcatagtagtgcacgaccggtgctcgatttagagtgagctcgttgggtttgggggagtcagtcccaaccaggacacagcatggacatgagggtccctgctcagctcctggggctcctgctcctctggctctcgggtgtcagatggtgacatccagatgacccagtctccatcctccctgtatgcatctgtaggagacagcgtcaccatcacttgccgggnagtcaggactatttacaagttntttaaatggtatcagcagaaaccagggaacgcccctaaatcctgatctacgatggcatccgaacttggaaacgagggtcccagtacaaggttcaggtggtaggtgatcgagggacagtattttacnctcggcagtccgnacgccngcagcctagaagtntttgcganattattactntacaactagttanagtaaattcgtaccgtcttaccgtacgtttccggggacgggggtaacgaagggttacgaggtagtaacggtaaacgtaacgtaggtcggtacgtcgacctacgtactccgttaggttaccttacgttaacc

SEQ ID NO: 186868 - DNA, 812 bp, Homo sapiens
  misc_feature: GYAE6OF02HM2Q3.10.33.C11.1.454.CMB.1.raw
tcagcatagtagtgcacgaccggtgctcgatttagagtgagctcggttgggtttgggggagtcagtcccaaccaggacacagcatggacatgagggtccctgctcagctcctggggctcctgctcctctggtctcgtcgggtgtcagatgtgacatccgagatcggacccagtctccatcccgtccctgtatcgacagtcgtaggtacggagacgtagcgttccaacctaagtctaacgttcgggccgggtacgagtacgaagggtacttaatttaacgtaaacgttacttttaaaagttggtaattcgaacgtacgtaaacgaaaaccggtaagggggaaaccgtacccccttaaaaacgttccctaacggtaaacttaccgtaacggtaaccgttcggaaccgtaacgttaaccgggtaaaccgttaaacgggaaaccggtaacccgggggttaccctaacggttaaccggttaaacggggttaaccgtaggggtaccggggtaaggggtaacggtttcgtacccgggtaggggaacttaacgggtttacggttttacccttacggtccggtaccgttaccgtacccgacgtacgtcccgtaaccggtcgtaaaccgtcgttaagtaacggttacgttttaccgaacgttaaattaaccgttaagtttaccttaaggtaactaacgtagtaactaaacgttaacgtacgtaccctacgtccgttacgggttcgggacggtacgtagtacggagttacgagtaacgtggtacgcgtcgtactacgtcgtacttacgcttactcgttacccg

SEQ ID NO: 186869 - DNA, 880 bp, Homo sapiens
  misc_feature: GYAE6OF02HAM2J.10.33.C11.1.454.CMB.1.raw
  modified_base (166)..(166): a, c, t, g, unknown or other
  misc_feature (166)..(166): n is a, c, g, or t
tcagcatagtagtgcacgaccggtgctcgatttagagtgagctcgttgggtttgggggagtcagtcccaaccaggacacagcatggacatgagggtccctgctcagctcctggggctctgctcctctggctcgtcgggtgtcagatgtgacatccagatcgacccngtcctccactcctcctgtactgacagtcgtggtacggacgacgacgacgtaccacctataccgacgttcggccgggacgtacggtacgaaggtaccttaagtttaacgtaacgtttacgttttaaaacgttggttactacgaagaccgtaaacgaaaccggtaacggggaacccgtaacccccttaaacgtcccgtaacgacgttaccgtaacgtacgttcgactacgttaaccggttaaacgtacggggaaaaccggtccggggttacctaacgtacgggttaacggtcggtaaggggtaggggtaacggtacggtacggttcggtacggtaacgttagtttacgttttaccgccggtaccggtaccgttagtaccccgacggtaaccggtcccgtacggtacggtaccgttaccggtaaggttaacgttacggttttaaccggaacgttaacgttaacgtttaaccggtttacgttaacccgtaacgtaaacgttaaacgttaaacgttaaacggttaaccgtttcccgggtaccccttaccggtttaaccggttacccggggggttaccgggggacgggggttaaaccgggtacggggttaacgttaaccggtaaccgttaaccgggtaacggtacggtacgtcccggtaacgtcccgttaaaccggtcgtttaaccgtttcttaccgtttacccgtacccgtttaccccg

SEQ ID NO: 186870 - DNA, 812 bp, Homo sapiens
  misc_feature: GYAE6OF02H883V.10.33.C11.1.454.CMB.1.raw
  modified_base (126)..(126): a, c, t, g, unknown or other
  misc_feature (126)..(126): n is a, c, g, or t
tcagcatagtagtgcacgaccggtgctcgatttagagtgagctcgttgggtttgggggagtcagtcccaaccaggacacagcatggacatgagggtccctgctcagctcctgggctcctgctcctntggctctcgggtgtcagatgtgacatccagatcgaccctagtcctccactccctccctgtatcgtcctatctggtaggacgacaggccgtccaccctatcctaccgttcggccccggggtcacggttcacgggtaacttacgtttaactaacggttactttttaaaagtttcggtacttaccgtaggccgtaaaggaaaacccgtaggggaaacccgggtaacccccttaaaaccgtcccgttacgtaacgtttccctaacggacttcggacctacggttaccggtaacgtttaaacggggaaacccgttaccgggggtacccctaacggttacgtaaaccgggtttcgacgggttacggggtaagttcgggaactttacgggacggggtaaactaccgggttttaaactttcccgtaccgttcggaccgttaaccgtcccggtactacgccgtacggcacgtaccgtagtacgttagtttcgacgtacttattacttacgtcgtacaataccggttaatacggtaaacttcccgtaccgtacccgttacgttaccgggttcgggtacccggggtaacgtagggttcccggttagtaacccgtaacggtaacctcgggttaccgtacgtcggtacccgacgttaccttccggacgttttacccttacccggttactttccccccgg

SEQ ID NO: 186871 - DNA, 791 bp, Homo sapiens
  misc_feature: GYAE6OF02H0IJJ.10.33.C11.1.454.CMB.1.raw
  modified_base (169)..(169): a, c, t, g, unknown or other
  misc_feature (169)..(169): n is a, c, g, or t
tcagcatagtagtgcacgaccggtgctcgatttagagtgagctcgttgggtttgggggagtcagtcccaaccaggacacagcatggacatgagggtccctgctcagctccgtggggctcctgctcctctggctcgtcgggtgtcagatgtgacatccagactcgacccngtctccatccctcctgtatgctatcgtggtaggagacagcgtaccacctatctaggtcggccgggacgtaggacacggtacttagttttaacgaagttttacttttaaagttggtatctaacgacaaaggaaaccggacgggaaccgtaccccttaaacgtcctacgtaacttccgtaagtactcgaccgtaacgtaaccgtaaacgttaacggaaaccggtacgggtaccctagtaccggtaaggttcgtaggggtggtaacggtgtacgtaacggtgggtaacttagtttaaccgtttcgaccggtactccggtaacgtcccgtacgtacgtccgtacgcgtacggtaccgttaaaggtaacgtttcgtttaacggccgtaatttaacgttacgttaacgttacgtaacaaacgttaggtaaacgttaacgtaaaccgttcccggttaccgtaccggttaaccgggttaccgggtttaccggggggaaacgggtaaaccgttaacgggacgggttaccgttaaccggaacggttacggtaaccgggttcggaaccgttacggtacccgtaaccgttacgttacctttacggtttacccttaccgtacccgtttaaccccg

SEQ ID NO: 186872 - DNA, 540 bp, Homo sapiens
  misc_feature: GYAE6OF01CPG5R.25.71.G05.1.454.CMB.1.raw
  modified_base (328)..(328): a, c, t, g, unknown or other
  misc_feature (328)..(328): n is a, c, g, or t
  modified_base (352)..(352): a, c, t, g, unknown or other
  misc_feature (352)..(352): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggagcctggtcaagcctggggggtcccaagactctcttgtgcagcctctggattcaacttcaaaggctacagcatgaactggatccgccaggctccggggaaggtctgcagtgatttcatccattagnggtcttaagctgactaaattttangcagactcggtgaacggccgttcaccatctccagacgacaacgccgacgtactttctctttctgtcaaatgaacagcctcagacgccgagacacggcttgtttattctgtgcgagaggagtgggacgaaaacgtggctacgtacgggaggtgaagttgtcttttgatttcgtggggtcctaaacgggg

SEQ ID NO: 186873 - DNA, 563 bp, Homo sapiens
  misc_feature: GYAE6OF01E3GC5.25.71.G05.1.454.CMB.1.raw
  modified_base (358)..(358): a, c, t, g, unknown or other
  misc_feature (358)..(358): n is a, c, g, or t
  modified_base (495)..(495): a, c, t, g, unknown or other
  misc_feature (495)..(495): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaaggcctggggggtcccaagactctcttgtgcacggcctcgtggattcaacttcaaaggctacagcatgaactggatccgcaggctccggggaaggtctgcagtggatttcatccattagtggtcttaagcgtgactaaattttangcagactcgggtgaaccggtccgttacacctatcctccagagacaacgccgacgtactttctctttctgacaatagaacacgcctcgagacgccgacggacgacggtacttcgtttatttcgtgtgacggaggaggnggtagggacgaaaacgtcggcgtagtacgggtaggtgattcgtctttagatttcggtgggcgtaaggg

SEQ ID NO: 186874 - DNA, 576 bp, Homo sapiens
  misc_feature: GYAE6OF01DQU3Q.25.71.G05.1.454.CMB.1.raw
  modified_base (360)..(360): a, c, t, g, unknown or other
  misc_feature (360)..(360): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaaggccgtggggggtcccaagactctcttgtgcagcctctggattcaacttcaaaggctacagcatgaactggactccgccaggcgtccggggaaggtctgcagtgtattcatccattagtggtcttaagcgtagaactaaaatttngcagactcggagaaccggcgttacaccgatcctaccagacgacaacgccgacgtactttactcttctgtacaaatagaacacgcctacacgacgaccggagacacggtctcgtttattctgttgacgtaggaggtggtaggacgaaaacgtggtccgtacgtacgggaggttagagttgtccgttttaggtagtttcggtgggaccgtaaacgggg

SEQ ID NO: 186875 - DNA, 556 bp, Homo sapiens
  misc_feature: GYAE6OF01AH48S.25.71.G05.1.454.CMB.1.raw
  modified_base (354)..(354): a, c, t, g, unknown or other
  misc_feature (354)..(354): n is a, c, g, or t
  modified_base (436)..(436): a, c, t, g, unknown or other
  misc_feature (436)..(436): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctggggggtcccgaagactctcttgtgcagcctctggattcaacttcaaaggctacagcatgaactggatccgccaggctccggggaggtctgcagtggatttcatccattgtggtcttaagcgtgactaaattttangcagactcggtgaacggccgttcaccatctccagacgacaacgccgacgtactttctctttctgacaaatcgaacagcctanagacgcgaggacacggtcttgtttacttctgtgacgagaggaggtgggacgtaaacgtggtctacgtacgggtgtagagttggtacgttttaggattttcggtcggggtccgtaaagggg

SEQ ID NO: 186876 - DNA, 622 bp, Homo sapiens
  misc_feature: GYAE6OF01AS7YY.25.71.G05.1.454.CMB.1.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctatttagaaggtgtccagtgtgaggtgcagttggaggagtcgtgggggaggcttggtccgaggcccgggggggtccctgagactctcctgtgcagcctctggattcagttttagcagtattttggatggagtcgtggggtcccgccacgggccccgaggggacgggcgtgggtggtggggtagccaacatacacggaagagtgggaggtagaagaaatacgtagtcggacggtactcgtggtacggaagggcccgtaattccaaccatcctaccgaagggaccaacctacccaaacaacctacaagtattactctagacaaatgaagtggtactaggagacggaccggacggaacgtaccggtcttaggttagttacgtttcgtggtcgacggtaggtacggtcccgaccccgaagttcccaacgtaaccgtacccgttatcggttaccttttgagttggtacggggg

SEQ ID NO: 186877 - DNA, 588 bp, Homo sapiens
  misc_feature: GYAE6OF01DIIBS.25.71.G05.1.454.CMB.1.raw
  modified_base (359)..(359): a, c, t, g, unknown or other
  misc_feature (359)..(359): n is a, c, g, or t
  modified_base (428)..(428): a, c, t, g, unknown or other
  misc_feature (428)..(428): n is a, c, g, or t
  modified_base (441)..(441): a, c, t, g, unknown or other
  misc_feature (441)..(441): n is a, c, g, or t
  modified_base (572)..(572): a, c, t, g, unknown or other
  misc_feature (572)..(572): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgaagactctcttgtgcagcctctggattcaacttcaaaggatacagcatgaactggatccgcaggctcggggaaggtctgcagtggtatttcatcctattagtggtctaagcgtagaactaaattttangcagactcggtagaaccggtccgttcaccatctaccagacgaacaacgcccgacgtactttctctttcngactaatcgaacncgcctacgagacgaccgaggacaacggtcttagttttattcgtggtgacggtaggagggtagtggggaaaccgtaaacgtgggtacctcggtacgggtggtagtagttggtcctttttagaggttttcggnggggtccgtaaacggg

SEQ ID NO: 186878 - DNA, 595 bp, Homo sapiens
  misc_feature: GYAE6OF01DAUU7.25.71.G05.1.454.CMB.1.raw
  modified_base (353)..(353): a, c, t, g, unknown or other
  misc_feature (353)..(353): n is a, c, g, or t
  modified_base (578)..(578): a, c, t, g, unknown or other
  misc_feature (578)..(578): n is a, c, g, or t
tcagactgtacagtcacgaccggtgctcgatttagtgtcgtcgcaagagagaggagccttagccctggattccaaggcctttccacttggtgatcagcactgagcaccgagattcaccatggaagtggggctccgctgggttttccttgtcgctattttagaaggtgtccagtgtgaggtggtgctggtggagtcgtggggggaggcctggtcaaggccgtggggggtccccgaagactctcttgtgcagcctctggattcaacttcaaaaggctacagcatgaactggatccgcaggctcggggaaggtctgcagtgattcatccattgtggtctaagctgactaattttangcgagactcggtacgaaccggtccgttcaaccatcctacagacgaacaaccgccgacgtactttctctttctgacaaagtgaaactacgccctacgacgaacgccggaaggaccgaacgggtccttagttttattcgtgtcgtacggaggtaggaggttacgggacgtaaacgtcggtctacggtacgggaggttggtaagtcgttacgttttagtacgtttcgnggggtccgtaaacgggg

SEQ ID NO: 186879 - DNA, 561 bp, Homo sapiens
  misc_feature: GYAE6OF01DYGOS.25.71.G05.1.454.CMB.1.raw
  modified_base (357)..(357): a, c, t, g, unknown or other
  misc_feature (357)..(357): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccaagactctcttgtgcagcctctggattcaacttcaaaggctacagcatgaactggactccgcaggctccggggaggtctgcagtggatttcatccattagtggtcttaagcgtagactaaattttangcagacgtcgggtagaaccggccggttcaccatcctcagagacaacgccgacgtactttcttctttctgacaaatgaacacgcctcaagacgaccggaggacacggtcttgtttatttcgtgtgcggagaggaggtgggacgaaacgtggcgtacgtacgggaggtaggattgtcttttagtagtttcggtgggccgtaacggg

SEQ ID NO: 186880 - DNA, 677 bp, Homo sapiens
  misc_feature: GYAE6OF01BCA0U.25.71.G05.1.454.CMB.1.raw
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaagtgtccagtgtgaggtggtgctggtggagtcgtgggggaggcctggtcaagccgtggggggtcccgaagactctcttgtgcagcctcgtggattcaacttcgaaaaggctaacagcatagaactggactccgcgaggccgtaccgggggaaggtctgcgtaggtggtatttcgactcctagtttaggtgttacttaagcgtagtaacttaaattttgagacagtacgtcggtaggaaccggtccgttacacctatcctacagaacgaccgaacgccgtaacttacgtttcttacttcgtacgaactaaatacgaaccacgtaccctagacgaccggaccggaacggtaccgtacggttactttagttttaaccgtttcggttacggttacgaacgggtaggtaacgggtaggtacgggaaaccgtaaaacggtcggtaacgttacggaacgggtaggtaggtacttaggtttacgtttaggttacgttttcgggacggggtacgtaaacgggg

SEQ ID NO: 186881 - DNA, 748 bp, Homo sapiens
  misc_feature: GYAE6OF01D9UO2.25.71.G05.1.454.CMB.1.raw
  modified_base (371)..(371): a, c, t, g, unknown or other
  misc_feature (371)..(371): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccaagactctcttgtgcagcctctggattcaacttcaaaggctacagcatgaactggactccgccgaggcgtaccgggggaaggtctgctaggtgtatttcatcctatttaggtggtacttaagcgtagtaactaaattttgngactagtacgtcgggtacggaaccggtccggttaccacctactcctaccaaggacgtaaccgaacccggtacccgtaaccggttaccttttccttaccttttacgtacgtaacctaaaacgtacgaaacccgtacgtacccttacgacggaaccgggtacccggaacgggaaccctacccgggttacttttacggtttttaactttccggttacggttcgggtacggtaagggtaacggggttacggggtaacggggtaaacccggtaaaacggttccgggtaccggttaaccggttacgggggaaggttacggttaagttcggtttacgtttttagggtacgttttccggggtacggggtaacccgttaaaggggg

SEQ ID NO: 186882 - DNA, 616 bp, Homo sapiens
  misc_feature: GYAE6OF01EMB76.25.71.G05.1.454.CMB.1.raw
  modified_base (367)..(367): a, c, t, g, unknown or other
  misc_feature (367)..(367): n is a, c, g, or t
  modified_base (433)..(433): a, c, t, g, unknown or other
  misc_feature (433)..(433): n is a, c, g, or t
  modified_base (441)..(441): a, c, t, g, unknown or other
  misc_feature (441)..(441): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaagtgtccagtgtgaggtggtgctggtggagtcgtgggggagccgtggtcaagccgtggggggtcccgaagactctcttgtgcagcctctggattcaacttcaaagctacagcatgaactggactccgccgagggccgtccgggggaaggtcgtgcgtaggtggtattcgatcctattagtgtacttaagctagactaaattttngacagactcggaggtaccgtcgttaccactactctacagacgacacgaccgactctttcttcttcnctacaatnaacacgcctgacgacgacgaagacgtacgtactttcgtttagtttctggttcgacgagggtacggtagggtacgggaccgtaaacgttcgggaccgttacgggtaacgggtaggttaggtaagttggtttaccgttttaggttaggtttccgggtacggggtacgttaaacgggg

SEQ ID NO: 186883 - DNA, 642 bp, Homo sapiens
  misc_feature: GYAE6OF01DX0J5.25.71.G05.1.454.CMB.1.raw
  modified_base (368)..(368): a, c, t, g, unknown or other
  misc_feature (368)..(368): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtggggggaggcctggtcaaggccgtgggggggtcccgaagactctcttgtgcagcctcgtggattcaacttcaaaggctacagcatgaactggactccgccaggcgtccggggaagggtctgcaggtggatttcatcctattagtggtcttaagcgtagaactaaattttngctagactcgggtacgaaccggtccgttcaccctattcctccgaggacgaccgaacccggacccgaacgtaccttttccttccgtttctcggtacctaaagtcgaaactacgaccctcgaaggacggacccggaaggacgaccgggtctttacggttttatttccgtgtggacggagggaggtagggtacgggaacgtaaacgtgggccgttacggtagggtggtagtagtcgttcgttttagtacgttttcgggcgggggtaccgtaaagggg

SEQ ID NO: 186884 - DNA, 721 bp, Homo sapiens
  misc_feature: GYAE6OF01CTGQD.25.71.G05.1.454.CMB.1.raw
  modified_base (544)..(544): a, c, t, g, unknown or other
  misc_feature (544)..(544): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgaagactctcttgtgcagcctctggattcaacttcaaaggctacagcagtagaactggactccgccaggcgtaccggggaacgggtctgcgagtgacttcatcctattagtgtcttaagcgtagaacttaaaattttgcgacgagtactcgggtacgaaccggtcccggttacaacctatccctaccgaaggaacgaacccgaccggtcccgaaccggttaccttttccttaccttttccgtacggaaacctaaagttcgaaaacctccggtacccttaccgaaggaccgacccgggaacgaccggtaccggtntttacgtttttattccgttcggtacggtaccgagggtacgggtaacggtaggggtaaacccgtaaaacgttgggtaccccgtttagggaacggggttcgggttagtacgttttcgggtttccgtttttaaaggggtcccgttttttacggggcggggggtaaaccctaaacgggggg

SEQ ID NO: 186885 - DNA, 621 bp, Homo sapiens
  misc_feature: GYAE6OF01E1WK6.25.71.G05.1.454.CMB.1.raw
  modified_base (373)..(373): a, c, t, g, unknown or other
  misc_feature (373)..(373): n is a, c, g, or t
tcagactgtacagtcacgaccggtgctcgatttagtgtcgtcgcaagagagaggagccttagccctggattccaaggccttttccacttggtgatcagcactgagcaccgaggattcaccatggagtgggctccgctgggttttccttgtcgcttattttagaaggtgtccagtgtgaggtggtgctggtggagtcgtgggggaggcctggtcaagccgtggggggtcccaagactctcttgtgcagcctctggattacaacttacaaaggctacagcatgaactggactccgaccgaggcgtaccgggggaaggtctgcgtagtgtatttcattcctattacgtcggtacttaagcgtagtactaaattttngcaggactcggtacgaccggtccgttacaccgtactccgtaccaagaccgacgaaccgtccgtacttactttcttcctttacacgtactaaagtcgaactacgcctagacgacgaccgaggactacggttcttgtttacgtttcgtgtagacgaggagggtagtacgggaacgaacgtcggacgttacggtacggtgttagtacgttggttcttttacggtaggttcgggtaggggtaccgtaacggg

SEQ ID NO: 186886 - DNA, 559 bp, Homo sapiens
  misc_feature: GYAE6OF01DVTO5.25.71.G05.1.454.CMB.1.raw
  modified_base (358)..(358): a, c, t, g, unknown or other
  misc_feature (358)..(358): n is a, c, g, or t
  modified_base (457)..(457): a, c, t, g, unknown or other
  misc_feature (457)..(457): n is a, c, g, or t
  modified_base (478)..(478): a, c, t, g, unknown or other
  misc_feature (478)..(478): n is a, c, g, or t
  modified_base (515)..(515): a, c, t, g, unknown or other
  misc_feature (515)..(515): n is a, c, g, or t
  modified_base (545)..(545): a, c, t, g, unknown or other
  misc_feature (545)..(545): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctaggttttccttgtcgctattttagaaggtgtccagtgtgaggtggtgctggtggagtcgtgggggaggcctggtcaagccgtggggggtcccaagactctcttgtgcagcctctggattcaacttcaaaggctacagcatgaactggatccgcaggctccggggaaggtctgcaggtggatttcatccattagtggtcttaagcgtagaactaaattttngacagactcggtgaaccggtccgttacacctatctaccagacgacaacgccgacgtactttctctttctgacaaatgaacagcctcagacgcgaggacncggtcttgtttacttctgtgnggagaggaggtgggactaaagtggacttacggacggnggtagagttcgttcgttttagattttcggngggtccgtaagggg

SEQ ID NO: 186887 - DNA, 573 bp, Homo sapiens
  misc_feature: GYAE6OF01BI7N7.25.71.G05.1.454.CMB.1.raw
  modified_base (306)..(306): a, c, t, g, unknown or other
  misc_feature (306)..(306): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctggggggtcccaagactctcttgtgcagcctctggattcaacttcaaaggctacagcatgaactggatccgcaggctccggggaggtcngcagtgattcatccattgtgtcttaagcgtnactaattttangcagactcggtacgaacggtccgttacacctatcctaccagtacgacaacgccgtacgtactttcttctttctgtactaaatcgaacacgtcctacgagacgaccgaggacacggtcttagtttactttcgtgtgacgaggacggtaggtcggacgtaaacgtcggactacggtacggtaggtcgtagttgttcgttttagtatttcggtggggccgtaacgggg

SEQ ID NO: 186888 - DNA, 716 bp, Homo sapiens
  misc_feature: GYAE6OF01DXDI4.25.71.G05.1.454.CMB.1.raw
  modified_base (358)..(358): a, c, t, g, unknown or other
  misc_feature (358)..(358): n is a, c, g, or t
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgtaggtgcagttgggaggagtcgtgggggagtcgttcgggtccgagggcccgggggggtccctggacggtacctctccgtggtcgcagtccctgtggacttctagttttagctagtagttttggatgagcgtcggtccgcgacggccccgaggggaacgggtctgggtgtgggtagaccaanagtacgaacgaagtacgttgggagtagaaacgtaaagtactagtacggacgtacctgttaggtacgggaacggggccttaacgttccaaccgtaacgtccgtacccggaaacgggtaacctaaaccttacccgaaaactaacctaccgtaagttaactaacgttacgtaacgaactaaaacgttagtaagtcgggttacgtacggaacggtaccggaccggaacggaccgtaacggttccgttaggtttataaccgtttttcgaggtcggtacggtagacggttacccgaaccccgtaacttaccgaacgttaacgtaacccttgttacgttattttacggaattcgggtaacggggg

SEQ ID NO: 186889 - DNA, 740 bp, Homo sapiens
  misc_feature: GYAE6OF01BCW0U.25.71.G05.1.454.CMB.1.raw
  modified_base (271)..(271): a, c, t, g, unknown or other
  misc_feature (271)..(271): n is a, c, g, or t
  modified_base (535)..(535): a, c, t, g, unknown or other
  misc_feature (535)..(535): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggagccgtgggtcaaggccgtggggggtccccaaggactctcgttgtgcacgcctctaggattcaacttnaaaggcttacgagcagtgaacgtggactccgcacgggcgtaccgggggaagtcctgcgtaaggtggtatttcgactcctagtttaggtgttaccgttaaggcggtagaacttaaaattttcgagacgtaacgtaaccggtcgggtacggtaaccgggtcccggttacaacccgtaagttccccgttacgaacggtacgaaaccgtaacccggcgtaaccgtaaccttttcgttccgtttacaaggtacctaaaagtcgtaaacncgtacctacgaacgacgaccggaacggtaccgaccgggttatttacgttttactttccggtaggttccgacgggaggtaacgggtaggttacgggtaaaccggtaaaagttccgggtccttaaagggtaccgggtaagggtagttacggttcggtttaacgtttcggttaaccgttttcggggaaacgggtcccgtaaaacgggg

SEQ ID NO: 186890 - DNA, 654 bp, Homo sapiens
  misc_feature: GYAE6OF01AQG8V.25.71.G05.1.454.CMB.1.raw
  modified_base (336)..(336): a, c, t, g, unknown or other
  misc_feature (336)..(336): n is a, c, g, or t
  modified_base (518)..(518): a, c, t, g, unknown or other
  misc_feature (518)..(518): n is a, c, g, or t
  modified_base (577)..(577): a, c, t, g, unknown or other
  misc_feature (577)..(577): n is a, c, g, or t
tcagactgtacagtcacgaccggtgctcgatttagtgtcgtcgcaagagagaggagccttagccctggactccaaggcctttccacctggtgatcagcactgagcacagaggactcaccgatggaagttggggctgagcgttgggttctccttgttgtcttattttagaaggtgtccagtgtggacccggtgcgtaggttgggaggtagttcggtggggggaggtcgtttgggtcccaggtccgtgggaactcccgtgacgtaccttcgtccgtggtgtggccgcctagactcctacctttgagttagttatcggtcctttcgtcgtcgggtcccncgtagttcgtaccgaggccgaaggggtctgggtacgtggcgtagggtactttacgtggttctagaaccgaagaacaaagtcgaactatactccgacggtcggtacgtcggtagggacggggtctactaccactacgtccgtaccgaggtaacctactaccgaagtacctacctctatcgtanacgtaaatacgaactaacgtgagtcgtacgtacggtacgttaccgttactttgttacgngtcgaccgtacttggagggtagtcggaactaacgggaaattcggtactcgtactccgtacccgcgtcgtcgtccggg

SEQ ID NO: 186891 - DNA, 823 bp, Homo sapiens
  misc_feature: GYAE6OF01CRXD3.25.71.G05.1.454.CMB.1.raw
  modified_base (163)..(163): a, c, t, g, unknown or other
  misc_feature (163)..(163): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtgggctccgctggttttcctgtcgctatttagaggtntcagtgtgaggtggtgcgtggtggagtcggtgggggacgtccgtggtcaacggccggttcggggggtaccccaaagtacttcgtcgtttggcgccgagtcctcgtaggtacttcaacgttacgaaaggtcctaacgagtctaagtacgaaaccgtggtaacctcccggaccgacgggccggttacccgggggtaaggtctcggacgtaggttacggtactttcgaacgtccgtaagtttacggtacggtttacgttaaacgtccggttaagtaaaccgtttaaattttacggcgtaacgtaaacggttccggtaccggggttaaccggtaaccgggttacccggtttacaacccgttacggtactaacccggtaaggaaccgtaacccgaaacccgtcccggttaaccctttacttttccgttacgttttaccgagtaaacccgaaagttaacccgaaccgtacgtacccgacggaacgcggtacggaaaccgggtcgtacgggtttacctttagttttacgttcgtaccggtggtaaccgaggggtaacgggtaggtacccggaaacggtaaaccgtcggaccgttaagggacgggtaggttagtacgtttgttaaccggttttagtaacccggttgggtacccgggtaacgtaagggg

SEQ ID NO: 186892 - DNA, 591 bp, Homo sapiens
  misc_feature: GYAE6OF01BAYS6.25.71.G05.1.454.CMB.1.raw
  modified_base (358)..(358): a, c, t, g, unknown or other
  misc_feature (358)..(358): n is a, c, g, or t
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtgggctccgctgggttttcctgtcgctattttagaaggtgtccagtgtgaggtggtgctggtggagtctgggggagcctggtcaagccgtggggggtcccgaagactctcttgtgcagcctctggattcaacttcaaaggctaacagcatgaactggatccgccaggcctccggggaaggtctgcagtggatttcatccattagtggtacttaagcgtagaactaaattttngcagtactcggtagaacggtccggttacaccgtatcctaccagacgaccaacgcccgacgtactttctctttctagacaaatgaacngcctanagacgaccgaggacacggtcttgtttatttcgtgtcgcgaaggagggtaggtagggaaccaaacgttcgggacttacggaagggtaggtgtaagttcggttcttttaggtagttttcgggtggggtaacccgtaaagggg

SEQ ID NO: 186893 - DNA, 834 bp, Homo sapiens
  misc_feature: GYAE6OF01BPA0G.25.71.G05.1.454.CMB.1.raw
  modified_base (119)..(119): a, c, t, g, unknown or other
  misc_feature (119)..(119): n is a, c, g, or t
tcagactgtacagtcacgaccggtgctcgatttagtgtcgtcgcaagagagaggagccttagccctggattccaaggtcctttccacttggtgatcagcactgagcaccgagattcacntggagtgggctcgcttggtttcctgtcgcttatttagaggtgtcagtgtgaggtggtgcgtgggtgggtagttcgggtggggggacggtccgttgggtaccgaacgggtcccgggttcgggggggtaccccaaaggtccttcgttcgttggtcgccgtacgtcccttcggttaggtactttacctaaaccgttacgaaaacggtcctaacgacgactagtagtaacgtagggtacctcccgaccggtacgggtccggtaccgggggtaacgggtcgtcggcgtacggttggtattttccgacttaccgttagtttgggtacgtttaccgttaaagtccggttaaagtaacctttaaagttttaggacgtacgtaacggtaccggttcgggtaaccggtaaacccggggttccggtttaccaaccgttacgttacccgaacgtaacggaaccggaacccgtaacccgggtacccggtttacgtttaaccctttttacctttccgtttacgtaacgttaaactaaacggtacgaacccgtaccgttccgacgaacggtacggacccggtaacggtaccgttacggttacttttacggtttacgtttcgtacggttacgagtagggtacggaggggttacgaacggtaacgtcggtcgttaggacggtgtaggtacttcggttcgtttaggtacgtttccgggtgggaacgttaacgg

SEQ ID NO: 186894 - DNA, 695 bp, Homo sapiens
  misc_feature: GYAE6OF01BXWHI.25.71.G05.1.454.CMB.1.raw
tcagactgtacagtcacgaccggtgctcgatttagtgtcgtcgcaagagagaggagccttagccctggattccaaggcctttccacttggtgatcagcactgagcacgaggattcaccatggaagtggggctccgctgggttttcctgtcgctattttagaaggtgtccagtgtgaggtggtgctggtggagtcgtgggggagcctggtcaagccgtggggggtcccaagactctcgttgtgcagcctctggattctaacttcgaaaggtctaacaggcatgaactggactccgccaggcgtaccggggaagggtctggctaggtggtactttcgatccaatttaggtcggttacttaaggcgtagtaactaaatttttagcgtacacgtacgtcgggtacgtaaccggccggttaccacctacgttccgtaccgaggaacgaccgaaccggccgtaacgttacctttcttctttctacggtaactaaagtacgaacctacgtccctacgaacggtacgaccggaacggtaccgaacggtacctttaggttttaaccttcgtagttcggacgaaggtcggggtaaggtacgggtaaccgaaaaggtccggtacgttacggtaaccgggtacggtaggtacgttacgttccgttttagtaccggttttcgggtacggggtaaccggttaaacgggg

SEQ ID NO: 186895 - DNA, 679 bp, Homo sapiens
  misc_feature: GYAE6OF01C0U3R.25.71.G05.1.454.CMB.1.raw
  modified_base (302)..(302): a, c, t, g, unknown or other
  misc_feature (302)..(302): n is a, c, g, or t
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgcttattttagaaggtgtccagtgtgaggtgcaggttggaggagtcgtggggggaggcttggtccgaggcccgggggggtccctgagactctcctgtgcagcctctggattcgtagttttagctagtattttggattgagcgtgggtccnccgacggccccgaggggacgggtctgggtggtgggtacaccaacataaccgaacgaagagtggaggtagaagtaaatacgtagtcggacgtactcgtagtaggaacgggtcctattccaacctatccgtaccggacggaacctaaccgtacccaaactaacctctaagtactatctagaactaaagtagtaagttcggtacgtaggaacgtaccggaccggtaaacggacccgtacggtccgttaggttacgtttacgtttcgtcggtacggaccggtaaggtacccggtacccggacccccgttaaactaccccgtaagttaacccgtaccccttagtttacgtttaccgtttttaggagtttacggttacggggg

SEQ ID NO: 186896 - DNA, 609 bp, Homo sapiens
  misc_feature: GYAE6OF01E4OL5.25.71.G05.1.454.CMB.1.raw
  modified_base (363)..(363): a, c, t, g, unknown or other
  misc_feature (363)..(363): n is a, c, g, or t
  modified_base (453)..(453): a, c, t, g, unknown or other
  misc_feature (453)..(453): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtggggggaggcctggtcaagccgtggggggtcccaagactctcttgtgcagcctctggattcaacttcaaaggctacagcatgaactggatccgccaggctccgggggaagggtctgcagtggatttcatcctattagtggtcttaagcgtagactaaaattttangcagactcgggtagaaccggtccggttcacctatcctccagacgacaaccgacccgacgtactttcctctttctagtacaaatgaacacncctacacgacgaccggaggaacgtcggtacttgttttactttcgttgtacggcggaggagggtacgggtcgggtaacgaaaacgtcgggtctacgggtaacggtgggtgtagtggttcgttttaggttagttttcggtggggtaccggtaaagggg

SEQ ID NO: 186897 - DNA, 663 bp, Homo sapiens
  misc_feature: GYAE6OF01EQQDQ.25.71.G05.1.454.CMB.1.raw
  modified_base (350)..(350): a, c, t, g, unknown or other
  misc_feature (350)..(350): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggagcctggtcaagccgtggggggtcccaagactctcttgtgcagcctctggattcaacttcaaaggctacagcatgaactggactccgccaggcgtcggggaaggtctgcagtggatttcatcattgtgtctaagcgtgactaaatttngcagactcggagtaacggcgttacaccatctacagtacgacacgccgacgtactttcgtcttctcgacaatagaacgacaccgtactacgacgaccgacgacgtaccggtcgttacgttttagtttacgttcggttacggtacggtaaggtacggggtaacgggttacggggaaaccggtaaaaaccgggttcgggtacccggtttacgggttaaacccggggtaagggttacggttaaggttacgggtttaccgtttttacgggttaaccggtttttccgggttacgggggtacccgggttaaaacgggggg

SEQ ID NO: 186898 - DNA, 735 bp, Homo sapiens
  misc_feature: GYAE6OF01ALZ2I.25.71.G05.1.454.CMB.1.raw
  modified_base (178)..(178): a, c, t, g, unknown or other
  misc_feature (178)..(178): n is a, c, g, or t
  modified_base (327)..(327): a, c, t, g, unknown or other
  misc_feature (327)..(327): n is a, c, g, or t
  modified_base (393)..(393): a, c, t, g, unknown or other
  misc_feature (393)..(393): n is a, c, g, or t
  modified_base (550)..(550): a, c, t, g, unknown or other
  misc_feature (550)..(550): n is a, c, g, or t
  modified_base (585)..(585): a, c, t, g, unknown or other
  misc_feature (585)..(585): n is a, c, g, or t
tcagactgtacagtcacgaccggtgctcgatttagtgtcgtcgcaagagagaggagccttagccctggactccaaggccctttccacctggtgatcagcactgagcacagaggactcaccagtggaagttgggctgagcgtggtctcgttgtgcttagtttagagtgtcagtgtcagntgacacgtggacggaggtcggggagcggtacgtaccgagggaccgggtaagtcccgtggactccgtccgtcgtgtcgctaggtccgtcccgcgttccctacccgtttccggttagtttcgactacgttccgacggtcggtcccgaccgnggtacctccggaggtaacgaacgggtcgtgggtaggttggggtcggtaccggtgtaaggtttcggnggggttaaggagttaaccggtaagttaagtcgtactttatttagcgtaaccacggtaccgtacggtaacgggaaccgcctaccgtacctacgtcgtacccgtagaaggtagtaccgacgtacccgttaaacgaaacgttaaccctttgtttaaaccncgttaagtaacgttaaaacgttacgaaaccggttnaaccgtactacgaacgacgtccggttatacgtaacttacgtcgtacggaccggtaagtcgtaaaggtaaacggtccggtaggggtaccccgtagtaaccggaccgtagaccggttccggacgttacggggcctaaaccgggagtaacccg

SEQ ID NO: 186899 - DNA, 661 bp, Homo sapiens
  misc_feature: GYAE6OF01CLE3L.25.71.G05.1.454.CMB.1.raw
  modified_base (396)..(396): a, c, t, g, unknown or other
  misc_feature (396)..(396): n is a, c, g, or t
  modified_base (489)..(489): a, c, t, g, unknown or other
  misc_feature (489)..(489): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtgggctccgctggttttccttgtcgctattttagaaggtgtccagtgtgaggtggtgctggtggagtcgtgggggagcctggtcaaggccgtggggggtcccaagactctcttggtgcacgcctctggtacttcaacttcaaaggtcctacaggacagtgaaccgtggactcccgaccgaggccggtaccgggggaagggtcctggccgtaggtggtactttctactccgtagttaggtgttacgttaagccgtagaacttaaattttangtacagacgtggtacggacggtccgtacaccgtactcctacagacgaccacggccgtactctttcttactttcgacgtacaaacgtcgaaacnccgtcctacgacgtacgaccgacggacgtaccgtctttagtttcgttagtcgtacggtacggtacgtacgggtaggttcgggaaaccgtacgacggtcgttaccggttaagggtacggtagtacgtttcgttacgttttacgtaggtttccgggtgggtaccggtaaacggg

SEQ ID NO: 186900 - DNA, 803 bp, Homo sapiens
  misc_feature: GYAE6OF01D5NM1.25.71.G05.1.454.CMB.1.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggtagtcgtggggggaggtcttggtccgagggccgggggggtcctgagactctcctgtgcgagcctctggtattctagttttagcgtagtatttggatgagcgtcgggtccgccgacggaccccgaggggaacggggtcgtgggtggtagggtacgaccaacgtagtacgaacgaagagtagggaggtagaagtaaagtacgtagtggacggtactcgtaggtaggtaacgggccgtaacttaccgaacctattccgtaccgaacgggtaacctaaacctaccctaaaacctaaacccttacgaaagtttaacgttacttacgtacggtaaacctaaaagttacggttaaacgttcgggttaacccgttagggaaacgggtaaccgggtacccgggaaaccggggaacccggtaaccggggtttaccgtttacgggtttacgggttttaccgtttttaccgtacggggttcggtaacccgggtaaaggggttacccgggttacccggtaaccccccggtaaaacttaccccggtaaacgttaaacccggtaacccccgttttagttaccggttttaccgttttaacggttaaagtttaggggttaccgggggg

SEQ ID NO: 186901 - DNA, 740 bp, Homo sapiens
  misc_feature: GYAE6OF01C42DS.25.71.G05.1.454.CMB.1.raw
  modified_base (429)..(429): a, c, t, g, unknown or other
  misc_feature (429)..(429): n is a, c, g, or t
  modified_base (577)..(577): a, c, t, g, unknown or other
  misc_feature (577)..(577): n is a, c, g, or t
  modified_base (632)..(632): a, c, t, g, unknown or other
  misc_feature (632)..(632): n is a, c, g, or t
  modified_base (695)..(695): a, c, t, g, unknown or other
  misc_feature (695)..(695): n is a, c, g, or t
  modified_base (704)..(704): a, c, t, g, unknown or other
  misc_feature (704)..(704): n is a, c, g, or t
  modified_base (714)..(714): a, c, t, g, unknown or other
  misc_feature (714)..(714): n is a, c, g, or t
tcagactgtacagtcacgaccggtgctcgatttagtgtcgtcgcaagagagaggagccttagccctggattccaaggcctttccacttggtgatcagcactgagcaccgagattcaccatggaagtgggctccgctggttttccttgtcgcttattttagaggtgtccagtgtgaggtcggtgctggtggagtcgtgggggagcctggtcaagccgtggggtacccaagcctctcttgtcgcagcctgtggacttcgaacttcgaaaggctaacgagctaagttacgaaacgttcggacttacccggacgtacgggcccgtaccgggggtaaacggttcctcggacgtaggtacggtaactttcgaacttaccgtaagtttacggtacggttacttaaaggccggtaagtaacctttaaagttttacgnggacgtacgtacggttacggtacgtaacccggttcccggtaccaaccgtacgttcccgtaccaaacgggaactaacccggaaccgtccccggttaacttaccttttccttaccctttttagacgtaacaaacttccgaaacccgttanaccccgtacgagacggaccggtaagaccctaccggtgtttacgtttttactcggngttacggacgtagggaaggtaccgggtaagtaaacggaactcgggtaccgtaggagggacgtntacggtttntacgtttacncggtttacggcgggtacgtaaacggg

SEQ ID NO: 186902 - DNA, 823 bp, Homo sapiens
  misc_feature: GYAE6OF01AOTTK.25.71.G05.1.454.CMB.1.raw
tcagactgtacagtcacgaccggtgctcgatttagtgtcgtcgcaagagagaggagccttagccctggattccaaggcctttccacttggtgatcagcactgagcaccgaggattcaccatggaagtgggctccgctgggttttccttgtcgctattttagaaggtgtccagtgtgaggtggtgctggtggagtcgtggggaggcctggtcagccgtggggggtcccaagactctcttgtgcgacgcctctggattacgaacttacgaaaggtctacagacatacgaacgtcggactcccgaccgacgggtccgtaccgggggaacggtcgtgacgtaggttcggtactttcgacttacctagtttacggtacgttacgttaaggccgttaagtaacgtttaaaagtttttagcgtacgtaacgtaaccggttcgggtacggtaacccgggtcccggtttaccaacccgttacgtcccgtaaccgaacggtaacgtaacccggaacccgtacccgtaaccggtttaccctttttacccgtttaccgtttaaccgtcgaaccttaaaacggtacgtaaaccgacccgtaccccgtaagaaccggtaccggtaacccgggaaccggaaccgttaaccggttcgttttacgtttacgtttaccgtcggttacggaaccggtaagggtaaccgggttacgggtaacggtaaaaccggtaaacggttcgggttaccggttacgggaacgggttaggttacgttaacgtttcgggttttacgttttcggttaccggtttaccggggtagggttaaccggttaaacgggg

SEQ ID NO: 186903 - DNA, 723 bp, Homo sapiens
  misc_feature: GYAE6OF01C2JXU.25.71.G05.1.454.CMB.1.raw
  modified_base (415)..(415): a, c, t, g, unknown or other
  misc_feature (415)..(415): n is a, c, g, or t
  modified_base (669)..(669): a, c, t, g, unknown or other
  misc_feature (669)..(669): n is a, c, g, or t
tcagactgtacagtcacgaccggtgctcgatttagtgtcgtcgcaagagagaggagccttagccctggattccaaggcctttccacttggtgatcagcactgagcaccgagattcaccatggaagtgggctccgctggttttccttgtcgcttatttagaaggtgtccagtgtgaggtggtgctggtggagtcgtgggggcgccgtggtacaaggccggtcggggggtacccgaagaccttctcgttgtgccacgcctcgtggtacttactaaccttcgaaaaggtctaaccgaggtacaagtacgaacgtggactcccggccgaggtccggtaccgggggaaggtcgtaggccgtaggtcgtactttacactctagtttaggtgttacgttaaggcgtagtaacttaaattttnagtactaagtcgtacggtacggaaccggtccgttaccaaccgtacgttccgaccgaaggtacgaaccgacccgtaccgtaacgttaccttttccttacgtttcacgtaactaaagtaccgaaccacgtcctacgacggaaccggtcggaacggtaccgtacggtacttttacggttttacgttccgtaggtcgtacggtaggtaaccgggtgggtaccggaaacgtaaacggtcggtacgtacggttaacgggngttaacgtgtttacgttaccgttttagaccgtttccgggagggtacgtaacggg

SEQ ID NO: 186904 - DNA, 733 bp, Homo sapiens
  misc_feature: GYAE6OF01ED18P.25.71.G05.1.454.CMB.1.raw
tcagactgtacagtcacgaccggtgctcgatttagtgtcgtcgcaagagagaggagccttagccctggattcccaaggcctttccacttggtgatcagcactgagcaccgagattcaccatggaagtggggctccgcttgggtttttccttgtcgtcttattttagaaggtgtccagtgtgaggtggtgctggtggagtcgtgggggagccgtggtcaaggccgtgggggtacccaagactctcgttgtgccagtcctgtggtacttacaacttacgaaaggctaacacgctagtacgaacgttggactccgaccgacggtccggtaccgggggaaggtctggacgtaggtggtactttcacgtaccttagttaggttggttacttaaggcgtataacttaaagttttgacgcgtacgtacgttcgggtaaccgaaccggtccgtaccacgtactctaccgaagaacgacgaacccgtacccgtaacggttccttttacttctttcgtacgaactaaacgtacgtaacccactacccgtacgtagaccgggaccgtacgaacgtaccgttacgtttagtttacgtttacgtcgggttagacggtaggaagggtcggtaacgggtaacgtaaacggtcgggtacccgtaggttacccggggtaggttacgtacggtttacggtttacgttttacggttacgtttacggggtaccgggaaccggtttaaacgggg

SEQ ID NO: 186905 - DNA, 783 bp, Homo sapiens
  misc_feature: GYAE6OF01B3WF5.25.71.G05.1.454.CMB.1.raw
  modified_base (426)..(426): a, c, t, g, unknown or other
  misc_feature (426)..(426): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgcttgggttttcctgtcgctattttagaagtgtcagtgtgaggtggtgctggtggagtcgtgggggagccgtggtcaagccgtggggggtacccaagactcgtcttgtgcacgcctcgtggtacttcaacttacgaaacggctacgagacatacgaactggactcccgccgacggccggtacccggggaaggttctcggactaggttacggtacttttaccgaacttcccgttaagtttagggttacggtttacttaaacggtcgttaaggtaaaccttaaagtttttagnggtaacctaaggtaccggttaccggttaaacggtacccgggttacccggtttcaaacccgtacttacccgtaccgaacggtacgaacccgttaacccgcccgttacgttaaccttttccgttactttacgtgaacctaaagtactaccacgtacctcgaacgacgtaccggacgtactcggtacttttagttatttccgtggtacgtagggaacggtgggtaacgggtaggggtaaaaccctaagggttaccggtaacggttacccgggtaagggggtttagtaccgggttagttcggttttaaccgtttacggggttaaccgtttcgggttaacgggggaacccgtttaaacgggg

SEQ ID NO: 186906 - DNA, 807 bp, Homo sapiens
  misc_feature: GYAE6OF01ALY82.25.71.G05.1.454.CMB.1.raw
tcagactgtacagtcacgaccggtgctcgatttagtgtcgtcgcaagagagaggagccttagccctggactccaaggcctttccacctggtgatcagcactgagcacagaggactcaccatggaagttggggcgtgacggcgtgggttcttccttgttgtcttaattttaggtaaggttgtccaggttggtggaggtgcgtagggtttgggaggtacggttcggtggggggtaggtccggtttcggggtacccggacgggggtccccggggggggttacctcgggtaacgtcccgttccgttccgtgggtcgtacctacggtcccttacgtggtactttccgttaagttttcgcgttagttaggttttggagttaggacgtcggttccgggcccgtaccgtaccggggacccgggaaggggtacgggtcggttaggggttcggtacggggtaacgccgtaacgtactaacggaacgtaagtacgggtaggtacggtagaaagtaactacgtaagtcggtaacgtcgtggttagtaacggggtagggtccctaagttcccaactacgttcggtacgaacgggaacctaacctaccaaacctactacgtactaattaccgtacttaggaaaccttaagtacggtaacgttcggtacggttagacggtaaccggaacgggtacgaccgggtacggtacttaggtttacggtctttacggttaggtaggtaaccgggtaggttccggaccccgttaagaccgtctaacgtacccgttacttgtacgtttcggtaactggttcggtacgggg

SEQ ID NO: 186907 - DNA, 851 bp, Homo sapiens
  misc_feature: GYAE6OF01EVNAS.25.71.G05.1.454.CMB.1.raw
tcagactgtacagtcacgaccggtgctcgatttagtgtcgtcgcaagagagaggagccttagccctggattccaaggcctttccacttggtgatcagcactgagcaccgaggattcaccatggagtgggctccgctggttttcctgtcgctattttagaaggtgtccagtgtgaggtggtgcgtgggtggagtcgtgggggacgccgtggtcgaggccggtcgggggtccaagactctcttgtgcacgcctcgtggtacttacctaaccgttacgaaaacgggtcctaactaggactaagttacggaaacttgggtaacctccccggaccccgtaaggggtccccggttacccggggggggtaaaccggggttccgtacgggtaccggagggtttacggggtttaacttttaccgaactttacccgttaaagttttacggggttacggtttaacgtttaaacggtccggtttaacgtaaactttaaaagttttttacgaggtaccgtaacggtaccggtttaccgggggtaccggtaaacccggggttccggtttaacccaaccctacgttaccctacccgaaaggtacccgtaacgtaaaccccgggacccgtaaccgttacctttttacttcccgttttacgaataaccgtaaataacgaactacgtccttacggacggacggaccggaccggtaacgacccgggtttatttacggtttttagttccgttagggtcgacgggtaagtacgggaggtaccgggtaacgaaacggttcgtaccgttacggacgggttaaggtcgtagtttcgttctttaggtttaccgttcggagggtaacccggttaagg

SEQ ID NO: 186908 - DNA, 720 bp, Homo sapiens
  misc_feature: GYAE6OF01EXZWK.25.71.G05.1.454.CMB.1.raw
  modified_base (153)..(153): a, c, t, g, unknown or other
  misc_feature (153)..(153): n is a, c, g, or t
  modified_base (166)..(166): a, c, t, g, unknown or other
  misc_feature (166)..(166): n is a, c, g, or t
  modified_base (184)..(184): a, c, t, g, unknown or other
  misc_feature (184)..(184): n is a, c, g, or t
  modified_base (589)..(589): a, c, t, g, unknown or other
  misc_feature (589)..(589): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgntatttagaaggtntccagtgtgaggtggtgntgggtggagtcgtggggggagcctgggtccgaaggtcccgtcggggggggtaccccaaaggtaccttcctacgttttgcgcaacggcccttcgtgggtactttactaaacctttacgaaaagggtccttaaccaaggcctaattagaactcggactcccgccgacggtcggtacccgggggaaggtcgtgcgtaggtggtaactttcactcctattaggtcggtacttaaggccgtagtaacgtaaaatttttcgagcgtaacggacctcgggtacgaacccgggttccggttacaacccgtatcctaccgagacgaccaacgaccgtaactactttcgttctttcgtagtactaaagtacgaaactacgacctacgagtaacggaccgaacgggacgtaccggnttacgttttatccgttagtccggtacgtaggaggtaaggtgggaaaccgaaacgttcggtacgtaccggtaaggtacgggtacgtgttagttcgtttaacgttagtttacggtccgggaccggtaaacggg

SEQ ID NO: 186909 - DNA, 670 bp, Homo sapiens
  misc_feature: GYAE6OF01CGDFV.25.71.G05.1.454.CMB.1.raw
  modified_base (93)..(93): a, c, t, g, unknown or other
  misc_feature (93)..(93): n is a, c, g, or t
  modified_base (204)..(204): a, c, t, g, unknown or other
  misc_feature (204)..(204): n is a, c, g, or t
  modified_base (402)..(402): a, c, t, g, unknown or other
  misc_feature (402)..(402): n is a, c, g, or t
  modified_base (529)..(529): a, c, t, g, unknown or other
  misc_feature (529)..(529): n is a, c, g, or t
  modified_base (607)..(607): a, c, t, g, unknown or other
  misc_feature (607)..(607): n is a, c, g, or t
  modified_base (661)..(661): a, c, t, g, unknown or other
  misc_feature (661)..(661): n is a, c, g, or t
tcagactgtacagtacacgaccggtgctcgatttagtgtcgtcgcaagagagaggagccttagccctggactccaaggcctttccacctggtnatcagcactgagcacagaggactcaccatggagttggggctgagtctgggttctccttgttgcttatttagaggtctccagtgtgaggtgctaggttggaggtacgttggngggggagtcgttcggtccaggtccggaggggggttccctaggacgtacctcgtccgtgacgcagtccttgtaggtattcgtaagttttacgagtagttagttttaggacgttggaggtccggttacgggccccgacgtaccgggaccccggtaaggggggacgggtcgtggggtaggtacggggtaacaccctaaaanaacgttaaccaaggaaggtaggtacgggtaaggagaaacggaaattaactaaggtggacgtactcgtaggacggtacgggcctatccgactactaccgacaaggaaccacgtaaccaaactacgtanaatagttacacgttacaataaactagtaagtggactaggaacgaccgacggaagtccgagttcgtatcgttagttcgngtccgagtagtcgttaccgaccctaagacctagaacctcttaagttctagtttnagttacggg

SEQ ID NO: 186910 - DNA, 839 bp, Homo sapiens
  misc_feature: GYAE6OF01AR4NM.25.71.G05.1.454.CMB.1.raw
  modified_base (185)..(185): a, c, t, g, unknown or other
  misc_feature (185)..(185): n is a, c, g, or t
  modified_base (482)..(482): a, c, t, g, unknown or other
  misc_feature (482)..(482): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgcttgggtttccttgtcgctattttagaaggtgtccagtgtgaggtggtnctggtggagtcgtgggggagcctggtcaagccgtggggggtacccaagacgtctcttggtgcacgcctcgtggtacttacaacgttcgaaaacggccttaaccgaggtaccaagttacgaaacgttcgggaacttccccggacccgtaacgggtccggttacccggggggaaacggttccgttacggacgtaacgggttacgggtaacttttccgaacgttacccgtaaggttttacggttacgggtttaacccttaaaagggtccgtaaacggttaaacctttaaaacgtttttanacggtaccttaaacggtacgtttacccgggtaagggaaacccggttcccgggtttaccaacccgtaagtcccctacggaacgacgtaaccgaaccggacccgtaacggttacctttacgttcccgtttacgtacgtaactaaacgtacgaacctaagtcctaaccggaacgtaccgaccggtaacgaccgtaccgggttactttacgttttacttacggtacgtcggtacgtaaccgggtaaggtaaccgggtaggtaaccggtaaaacgtcgggtaccgttacgggtaaccgggtaggtacggtaacttacgttgtttaaccggttaggtttacggtacgggtaacgggtaaacgg

SEQ ID NO: 186911 - DNA, 564 bp, Homo sapiens
  misc_feature: GYAE6OF02FZWQ1.25.71.G05.1.454.CMB.1.raw
  modified_base (353)..(353): a, c, t, g, unknown or other
  misc_feature (353)..(353): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctggggggtcccaagactctcttgtgcagcctctggattcaacttcaaaggctacagcatgaactggatccgccaggctccggggaaggtctgcagtggatttcatccattagtgtcttaagcgtgactaaatttangcagactcggtgaacggtccgttcaccatctccagacgacaacgccgacgtactttctctttctgactaatcgaacacgccctcgacgacgccgaggaccacggcttgtttatttcgtgtgcgaggagggagtgggacgaaacgtggaccttacgtacgggtaggtgtagtcggttcgttttggattttcggtaggggtaccgtaacgggg

SEQ ID NO: 186912 - DNA, 540 bp, Homo sapiens
  misc_feature: GYAE6OF02IAHKQ.25.71.G05.1.454.CMB.1.raw
  modified_base (351)..(351): a, c, t, g, unknown or other
  misc_feature (351)..(351): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggagcctggtcaagcctgggggtcccaagctctcttgtgcaggcctctggattcaacttcaaaggctacagcatgaactggatccgcaggctccggggaaggtctgcagtggatttcatccattagtggtcttaagcgtgactaaattttngcagactcggtagaacggtccggttacaccatcctccagacgacaacgccgacgtactttctctttctgacaaatgaacacgcctcagacgaccgaggacacggcttgtttattctgtagcgagaggtagtggacgaacgtggctacgtacggaggtgagtgtctttgacgtttcgtcgggtctaaggg

SEQ ID NO: 186913 - DNA, 520 bp, Homo sapiens
  misc_feature: GYAE6OF02HXMHX.25.71.G05.1.454.CMB.1.raw
  modified_base (325)..(325): a, c, t, g, unknown or other
  misc_feature (325)..(325): n is a, c, g, or t
  modified_base (348)..(348): a, c, t, g, unknown or other
  misc_feature (348)..(348): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggagcctggtcaagcctggggggtcccaagactctcttgtgcagcctctggattcaacttcaaaggctacagcatgaactggatccgcaggctcgggaggtctgcagtggatttcatccattagnggtctaagcgtgactaaattttngcagactcggtgaacggtccgttcaccatcctcagagacacgccgacgactttctcttctgacaatgaacagcctcacgagccgagacacggctgtttattctgtgcgagagagtggacgaaacgtggctacgtacggaggtgagtgtctttgatttcgtgggacctaaggg

SEQ ID NO: 186914 - DNA, 558 bp, Homo sapiens
  misc_feature: GYAE6OF02JDXBB.25.71.G05.1.454.CMB.1.raw
  modified_base (260)..(260): a, c, t, g, unknown or other
  misc_feature (260)..(260): n is a, c, g, or t
tcagactgtacagtcacgaccggtgctcgatttagtgtcgtcgcaagagagaggagccttagccctggattccaaggcctttccaattggtgatcagcactgagcaccgaggattcaccatggaagtggggctccgctgggttttccttgtcgctattttagaggtgtccagtgtgaggtggtgctggtggagtctgggggagcctggtcaaggcctggggggtcccaagactctcctgtgcagcctctaggttcccttnaagacgcctggatgagttggtccgccaggctccagggagggctggagtgggtgccgtataagacaatagtgaaggtggacaagagactacgctgcatccgagaaagacagattcacatcctacgaagggatagattacaaaagacccagctagtatctagacagatgaaacagcctaggaaggtcgaagaccacgagtaccgtttatacttgtacctaccgtttagaacgctacgtacggggtaactcgtagggaccagggaaccctgggtcaccggtctccgtacacgtccctaccg

SEQ ID NO: 186915 - DNA, 516 bp, Homo sapiens
  misc_feature: GYAE6OF02FMF1X.25.71.G05.1.454.CMB.1.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggaggcttggtccagccgggggggtccctgagactctcctgtgcagcctctggattcagttttagcagattttggatgagctgggtccgccaggccccagggaaggggctggtgtgggtagccaacatacacgaagatggaggtgagaaatactatgcggactctgtgaagggccgattcaccatctccagggacaactccaacaactcagtatatctgcaaatgaatggtctgagagccgaggacacggctgtgtatttctgtgcgagagtcgaccccgaatccatacgaccctagtcgtcttttagatatcggg

SEQ ID NO: 186916 - DNA, 729 bp, Homo sapiens
  misc_feature: GYAE6OF02I8V9Y.25.71.G05.1.454.CMB.1.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcaggttggaggagttcgtggggggaggtcgtttcgggtcccgagggtcccggggggggtccctggacgtacctcctcccgtggtcgccacgtcccttcgtggtactttcctaaggtttttagctagtagtttttgggattggacgtcgtcggggtcccgccgacggcccccggtaagggggaacgggtcgtgggtggtgggtacgaccaacgatacacggaagagtgggaggtagaagtaaactatagtcggacggtactcgtggtaggaacggggcctataccgacctactccgtaccgaacggaaccaacgtaccaaacaactacgaagttataacttcgtagtaaactaaataggtaagttcggttaccgtaggtaacgaacgggtccggaacggaacccgtacgggtcgtttacgggttagttttacgtttcggtagttcggaccggtaggtacggttacccggaaccccgtaacgtacccgtaacgttaccggtaacccgtttacggtccgtttacgtttttaggacgttttaggtcggggg

SEQ ID NO: 186917 - DNA, 557 bp, Homo sapiens
  misc_feature: GYAE6OF02GCRF8.25.71.G05.1.454.CMB.1.raw
  modified_base (330)..(330): a, c, t, g, unknown or other
  misc_feature (330)..(330): n is a, c, g, or t
  modified_base (355)..(355): a, c, t, g, unknown or other
  misc_feature (355)..(355): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaagcctggggggtcccgaagactctcttgtgcagcctctggattcaacttcaaaggctacagcatgaactggatccgccaggctccggggaaggtctgcagtggattcatccattagnggtcttaagcgtgactaaattttangcagactcggtgaacggccgttcaccatctccagagacaacgccgacgactttctcttctgtacaaatgaacagccctacagacgaccgaggaccacggcttgtttatttctgtgcgagaggagtgggacgaaacgtggcttacgtacgggtaggtagagttcggtctttttaggacttttcggtcgggggtacctaagggg

SEQ ID NO: 186918 - DNA, 516 bp, Homo sapiens
  misc_feature: GYAE6OF02FQSF0.25.71.G05.1.454.CMB.1.raw
  modified_base (289)..(289): a, c, t, g, unknown or other
  misc_feature (289)..(289): n is a, c, g, or t
  modified_base (328)..(328): a, c, t, g, unknown or other
  misc_feature (328)..(328): n is a, c, g, or t
  modified_base (452)..(452): a, c, t, g, unknown or other
  misc_feature (452)..(452): n is a, c, g, or t
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggagcttggtccagccgggggggtccctgagactctcctgtgcagcctctggattcagttttagcagattttggatgagctggggtccnccaggccccaggggaaggggctgggtgtgggtagccaantacacgaagatggaggtgagaaatactatgcggactctgtgaagggccgattcaccatctccagggacaactccaacaactcagtatatctgcaaatggatggtctgagagccgaggacacggntgtgtattctgtgcgagcgtgccccgaatccgaatacgaccctatcgtacttttgattatcggg

SEQ ID NO: 186919 - DNA, 583 bp, Homo sapiens
  misc_feature: GYAE6OF02IKAEE.25.71.G05.1.454.CMB.1.raw
  modified_base (357)..(357): a, c, t, g, unknown or other
  misc_feature (357)..(357): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctatttttagaaggtgtccagtgtgaggtggtgctggtggagtctgggggaggcctggtcaagcctggggggtcccgaagactctcttgtgcagcctctggattcaacttcaaaggctacagcatgaactggatccgccaggcgtccggggaaggtctgcagtggatttcatccattagtgtacttaagcgtagactaaatttngcagctcggtgaacggccgttacaccatcctcagagacacgaccgacgtactttctctttctgactaaatgaacacgtcctacgaagacgaccggaggaccgaccggtacttagttttactttcgtgtcgacggagagggtaggtagggacgtaaacgtgggactacggtacgggtaggttagagttcgttcgttttgtacgtttcggtacggggaccgtaacggg

SEQ ID NO: 186920 - DNA, 559 bp, Homo sapiens
  misc_feature: GYAE6OF02F6384.25.71.G05.1.454.CMB.1.raw
  modified_base (360)..(360): a, c, t, g, unknown or other
  misc_feature (360)..(360): n is a, c, g, or t
  modified_base (484)..(484): a, c, t, g, unknown or other
  misc_feature (484)..(484): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggtttccttgtcgctattttagaaggtgtccagtgtgaggtggtgctggtggagtcgtggggggaggcctggtcaagccgtggggggtcccgaagactctcttgtgcagcctctggattcaacttcaaaggctacagcatgaactggatccgccaggcgtccggggaaggtctgcagtggatttcatccattagtggtacttaagcgtagactaaattttngcagactcggagaacggtccgttacacatctccagacgacaacgccgacgtactttcttcttctacgacaaatcgaacagcctcgagacgccgagacacggcttgtttattctgtgcgagaggngtagggacgtaacgtcggtctacgtacgggtaggtgagttcgttcgtttgtagtttcggtaggggacgtaacggg

SEQ ID NO: 186921 - DNA, 666 bp, Homo sapiens
  misc_feature: GYAE6OF02H5115.25.71.G05.1.454.CMB.1.raw
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtggggggaggcctgggtcaagccgtgggggggtccccgaaggactctcttgtgcagcctctggattcaacttcaaaggctacagcatgaactggatccgccaggcgtccgggggaaggtctggcgaggtggtatttcatccctagttagtggttacttaagcgtagtaactaaattttatgacagtacgttacggtacgaaccgggtcccgttacaaccgtacttcctaccgaagaacgaccgaaccggcccgaacgtacctttccttctttcctacgactaatacgaacctacgacctacgagtacgccggaacggacgacggtacttagttttactttcgtgtcgcggaaggagggtaggtagggacgtaaacggtcgggtaccgttacggtaacgggtagggttagtacggttcggttacgttttacggttacgttttccggttacggggtacccggtaaacgggg

SEQ ID NO: 186922 - DNA, 537 bp, Homo sapiens
  misc_feature: GYAE6OF02GOMPO.25.71.G05.1.454.CMB.1.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggtggagtctgggggaggcttggtccagcctgggaccgggtcgtgagagtctcctgtgcagcctctggattcatcttcagtgaccactacatggactgggtcccgccaggcctccgagggagggctgggagtgggtgcgtatagaaataagctaagagttacacacaagaatacgcgcgtctgtagaaaggcagattcattatactacaagagtatagaattacgaaagtaactcacttagtatctagacaaatgaacagacctaaggaaaccgagaacgacggccgtagtacttacgtgtgctaggtacacgacgtacggtgactacctaaccctattacctacctaac

SEQ ID NO: 186923 - DNA, 593 bp, Homo sapiens
  misc_feature: GYAE6OF02I5X1K.25.71.G05.1.454.CMB.1.raw
  modified_base (359)..(359): a, c, t, g, unknown or other
  misc_feature (359)..(359): n is a, c, g, or t
  modified_base (435)..(435): a, c, t, g, unknown or other
  misc_feature (435)..(435): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctatttagaaggtgtccagtgtgaggtggtgctggtggagtcgtgggggaggcctggtcaagccgtggggggtcccaagactctcttgtgcagcctctggattcaacttcaaaggctacagcatgaactggatccgcaggcgtccggggaaggtctgcgagtggattcgatcctagttagtgtacttaagcgtgaactaaattttngactagacgtcggacgtaacggtccgtcacctagtcctccgaagacacgtaacgccgacgtactttctacttcganacaatacgaactcgacctcagacgccgacggacaccggtcttagtttacgttcgtgtacgcgtaggacgggtagtacgggacgtaaacgtggaccgtacgtacggggtagtcggagttcggttactttaggtatttcgggtacgggtacctaacgggg

SEQ ID NO: 186924 - DNA, 678 bp, Homo sapiens
  misc_feature: GYAE6OF02HZTB1.25.71.G05.1.454.CMB.1.raw
  modified_base (359)..(359): a, c, t, g, unknown or other
  misc_feature (359)..(359): n is a, c, g, or t
  modified_base (494)..(494): a, c, t, g, unknown or other
  misc_feature (494)..(494): n is a, c, g, or t
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtggggggagcgttggtccgaggccgggggggtccctggagactctcctgtgcacgcctcgtggattcgtagttttagctagtagttttggatggagtcgttcggggtccgaccgacggacccccgaggggtaacggggcgtgggtgggtggtacgccaaacntaacgacggaagagtgggaggtgaagtaaatacagtgaccggacttcgtaggtaggaacggccgtattccaactacgttcctaccgaacgggaacccaaaccctaccaaaccgtacctacgtaacttactacttntacgaactaaagtataggttcgtagcgaaggtacggaccggaacggtaccgaccggtgttcggttgtttacttcgttggtcgacgggtaacgtccggtacccggtaacccgtacgtaaccgtaaccgttaccgtacccgtttacgttacgttttcgtttaacggttagttacgggtaccggggg

SEQ ID NO: 186925 - DNA, 614 bp, Homo sapiens
  misc_feature: GYAE6OF02HHORR.25.71.G05.1.454.CMB.1.raw
  modified_base (523)..(523): a, c, t, g, unknown or other
  misc_feature (523)..(523): n is a, c, g, or t
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttggtccaggccgggggggtccctggagactctcctgtgcagcctctggattcagttttagcagtattttggatgagcgtggggtccgccgaggcccccgaggggaaggggcgtgggtggtggggtacgccaaacgataacgacgaagagtgggaggtgaagaaatacagtgacggacttcgtagtaggaacggggcctattcacctatccgaccgagggaccaacgtacccaaacaactcaagtatactctagaactaaagtgtaatgggtactaggagacggccgaaggaccacggtcttagttgttatttcgngttacggcgtaaggtacggtccggaaccccgtaatacccgtaagtaccggtacccttatcggttaccttttaggtagttacggttcggggg

SEQ ID NO: 186926 - DNA, 771 bp, Homo sapiens
  misc_feature: GYAE6OF02HLHI3.25.71.G05.1.454.CMB.1.raw
  modified_base (427)..(427): a, c, t, g, unknown or other
  misc_feature (427)..(427): n is a, c, g, or t
  modified_base (752)..(752): a, c, t, g, unknown or other
  misc_feature (752)..(752): n is a, c, g, or t
tcagactgtacagtcacgaccggtgctcgatttagtgtcgtcgcaagagagaggagccttagcctggatccaaggccttccacttcggtgatcagcactgagcaccgagattcaccatggaagtggggctccggctgggttttccttgtcgcttatttagaagtgtccagtgtgaggtggtgcgtggtggagtcgtgggggagtccgtaggtcaaggccgtggggggtccccgaagacgtcgtcgttggtcgcgagcccttgtcgggtaattcaaaccgtttacgaaaacggtctaaccaggacaattaggaaaccgttgggaaacttcccggaccctaggggccccttaccggggggaaaggttccgtgccgaaggtcggtattcgagtccattagtgttactaaagcgtagaactaaaagttttnagtacacgtactcggtacggaaacggtcgtacctaacgacgtttccaccggaagtaccgaacgaaccggtaccgaaccgtaactttccgttactttaccgtagacttaaaaacgtcgtaaaacgtaccgtaccgttacaagggtaaacccggtaaccggaagggtaaaccctaaacccgggttacgtttacgggttttaacttttaccggtgttaacgggccgtaaagggaaaggtcggttaaggggaccctaaaaggttccgggacttttaaccgaagggggaactacgggaattcggttacgttttagttagtttacccgggnggggtaaccctaaaggggg

SEQ ID NO: 186927 - DNA, 611 bp, Homo sapiens
  misc_feature: GYAE6OF02HWDWQ.25.71.G05.1.454.CMB.1.raw
  modified_base (365)..(365): a, c, t, g, unknown or other
  misc_feature (365)..(365): n is a, c, g, or t
  modified_base (432)..(432): a, c, t, g, unknown or other
  misc_feature (432)..(432): n is a, c, g, or t
  modified_base (454)..(454): a, c, t, g, unknown or other
  misc_feature (454)..(454): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctcgctgggtttccttgtcgctattttagaaggtgtccagtgtgaggtggtgctggtggagtcgtgggggagcctggtcaagccgtggggggtcccaagactctcttgtgcagcctctggattcaacttcaaaggctacagcatgaactggatccgccaggcgtccggggaagggtctgcgagtggtatttcatccagtttagtggttacttaagcggtagaactaaattttangcagtacgtggtacgaacggtccgttacaccatcctcagacgacacgccgacgtctttcgtctttcngactaatcgaacacgtccctanacgacgaccggaggacgacggtacttagtttactttcgtggtcgacggtaacggaagggtacggtacgggacgtaaacgtcggccgttacggtacgggtaggtacgtagttcggttacgtttaggtaccgtttgggtaccgggtacggtaaacgggg

SEQ ID NO: 186928 - DNA, 626 bp, Homo sapiens
  misc_feature: GYAE6OF02IJOWI.25.71.G05.1.454.CMB.1.raw
  modified_base (417)..(417): a, c, t, g, unknown or other
  misc_feature (417)..(417): n is a, c, g, or t
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttgggtccaggccgggggggtccctgagactctcctgtgcagcctctggatttctagttttagctagtattttggatgagtcgtgggtcccgccgaggccccgagggggaacggggtctgggtggtgggtacgaccaacataccacgaagagtgggaggtgaagaaatactagtggacggactcgtggtaggaacgggctattccacctntcctacgagggaaccaactccaacactacagtactatctagacaaagtgtaagtggtacaggacgtacgaccgggacggaaccgacgggtcgttagttacgttaacgtttcgttggtcggtacgtaggtacggtccggaccccgttaacgtacccgtacgttaaccgtaccccttagttccgttacgttttagacgttaggttcggggg

SEQ ID NO: 186929 - DNA, 653 bp, Homo sapiens
  misc_feature: GYAE6OF02GTT69.25.71.G05.1.454.CMB.1.raw
  modified_base (330)..(330): a, c, t, g, unknown or other
  misc_feature (330)..(330): n is a, c, g, or t
  modified_base (353)..(353): a, c, t, g, unknown or other
  misc_feature (353)..(353): n is a, c, g, or t
tcagactgtacagtcacgaccggtgctcgatttagtgtcgtcgcaagagagaggagccttagccctggattcccaaggcctttccacttggtgatcagcactgagcaccgaggattcaccatggaagtggggctccgctgggttttcctgtcgctatttagaaggtgtccagtgtgaggtggtgctggtggagtctgggggagcctgggtcaagcctggggggtcccaagactctcttgtgcagcctctggattcaacttcaaaggctacagcatgaactggatccgcaggcgtaccggggaaggtctgcagtggatttcatccattagngtctaagcgtagaactaatttancgcagactcggagtaacggtccggttacaaccgtatccgtacctaaggacgaacgaaccggacccgtaacgtacctttctcctttcgtacgtactaaatacgaactacgaccttacgagtaccgaccggacggtaaccgtacggtaccgttagttttacgtttcgtaggtacgtacggtaaggaacgggtacggtacgggtacgaaaacggttccgggaacgttaccggtacggggtaggtacggtaggttacggttccggtttagttaacgttttcggtacggggtaccgtaaacgggg

SEQ ID NO: 186930 - DNA, 717 bp, Homo sapiens
  misc_feature: GYAE6OF02JNMTH.25.71.G05.1.454.CMB.1.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcaggttggaggagtcgtggggggaggcgttgggtcccgagggcccggggggggtccctggacgtacctccgtccgtgtgccacggccctcgtggtattcctaggtttttacgcgtagtagtttttggattggagtcggtcgggtccgcccgacgggccccgaggggacgggcgtgggtggtgggtacgccgaacgataaccgacgaagtagtacggaggcgaagaaagtacgtaatcggcggacttcgtggtaggaacggggctattccgaccatccgtccgaaggacctaaccgtaccaaccgtaactacaagttaactactacgtacgactaaagtgtaatcggtcagggtacgaacggtaccggaaggtaaccgacccgggtgtttacggttacggtttaactttccgtaggttcggacgggtaacggtacgggtaaccccgtaccccggtaaacgtcccgtaaacgtttaacccgttaacccgttacgttccggtttaaccttttcggtaacggtttaccggttacggggg

SEQ ID NO: 186931 - DNA, 709 bp, Homo sapiens
  misc_feature: GYAE6OF02H2T6T.25.71.G05.1.454.CMB.1.raw
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
  modified_base (378)..(378): a, c, t, g, unknown or other
  misc_feature (378)..(378): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgaagactctcttgngcagcctntggattcaacttcaaaggctacagcatgaactggactccgccaggcgtccggggaaggtctggcgagtggtactttcacgtcctagtttacggtgttacttaaggcgttagaacttaaagttttangacagtacgttcggtaggtaaaccgggtccggttacaacctaagtcctaccgtaaggaacctaaccgaaaccggccggaaacgtttaccttttaccgtctttaccgtacggaacctaaaacgttcgaaaacctacgacccttacgaacggaacgacccggaaagggaacccgtaacgggttcctttaaggtttttactttacggtacggttacgacggaaaggtacggggaaggtaccgggaacgtaaacgttgggaacccgttaccgtaaggggtagttacgagttcggttacgttttagaccggttttcgggacggggaccgtaaaggg

SEQ ID NO: 186932 - DNA, 713 bp, Homo sapiens
  misc_feature: GYAE6OF02FGBYY.25.71.G05.1.454.CMB.1.raw
  modified_base (274)..(274): a, c, t, g, unknown or other
  misc_feature (274)..(274): n is a, c, g, or t
  modified_base (360)..(360): a, c, t, g, unknown or other
  misc_feature (360)..(360): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggtttccttgtcgctatttagaaggtgtccagtgtgaggtggtgctggtggagtcgtgggggagcctggtcaagccgtggggggtcccaagctctcttgtcgcagcctcgtggacttcaacttcgaaaggctacngcatgaactggatccgacaggctcgggggaagtctgcagtgtattcatccagttagtcgtacttaagcgtagtaactaagttttangacaggtacctgggtacggaaccggtcgttaccaccgtatccttaccgaagaacgtaaccgaaccggtacccgtacgttaaccgttttccttaccgtttacgtacgtacctaaaagtcggaaaccgttcggtaccccttagaacggaccgtaccggaacgggaccgtaaccgggttatttacggtttttaacgttcgttaggttacggacgtaagggacgggttaagggttaccggggaacctaaaccggtgggtaaccgttaccgggtaacggggtacggttaacgtaacggtttggtttccgttttaagggttaccgttttaccgggacgggggtaacccttaaacggggg

SEQ ID NO: 186933 - DNA, 657 bp, Homo sapiens
  misc_feature: GYAE6OF02G35CW.25.71.G05.1.454.CMB.1.raw
  modified_base (368)..(368): a, c, t, g, unknown or other
  misc_feature (368)..(368): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggtttccttgtcgctattttagaaggtgtccagtgtgaggtggtgctggtggagtcgtgggggagcctggtcaagccgtgggggtcccaagactctcttgtgcagcctctggattcaacttcaaaggctacagcatgaactggactccgccaggcgtaccggggaggtctgcaggtggtatttcatcctattacggtggttacttaaggcgttagaacttaaattttgngactagtacgtcggtacggaaccggtccgtacacctatcctaccgagacgaacgaccgaccgacgtacctttctacctttcgtacgtaactaaagtacgaacctacgtccctacgaacgacgaccggaacggaccgtaccggttctttacgttttacgttcgtagtcgacggtaggtaacgggtagggtacgggtacgtaaaccgtcgggtaccgttaccggtacgggtacggtagttacggttcgttcggttttaggtacggtttacgggtacggggtacgtaacggg

SEQ ID NO: 186934 - DNA, 758 bp, Homo sapiens
  misc_feature: GYAE6OF02H4QHV.25.71.G05.1.454.CMB.1.raw
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgcgtggtggagtcgtgggggaggcctggtcaagccgtggggggtcccgaagactctcttgtgcagcctctggtattcaacttcgaaaggctacagcatgaactggactccgaccgaggccggtacggggaacggtctcgcgaggtgtactttcatcctagttagtgtacgttaagcgtagtaacttaaattttagtgactacgtacgtacgggtacggtaaccgggtccggttaccaacctacgttccctaccgaacgaacgtaaaccgaaccgggtaccccgtaaaccgtttacctttttccctttaccgttttcgtaacgtaacctaaaaggttaccgaaaccgtacggtaccccgttacgaacggtaaccggaccgggtaacgggaccgtaccgggttacttttacggtttttacgttttacgtcggttacgaccgggtaggaagggttacggtacggggtaaacctaaacgggttcggaaccgttacgggtacggggtaacggttagtaggtttcgtttccgttttaggttaaccggttttcgggtaccggggtaacggttaaaccgggg

SEQ ID NO: 186935 - DNA, 965 bp, Homo sapiens
  misc_feature: GYAE6OF02JZT8H.25.71.G05.1.454.CMB.1.raw
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggtttcctgtcgctattttagaggtgtccagtgtgaggtggtgctggtggagtcgtggggggagccgtgggtacaaggccgtcgggggggtccccaaaggactcgttcgttggtgccagcccgttctgggattccaactttacgaaaggtcctaaccgagtccaacgttcgaaacgttcgggactcccggacccgtaacggggacccgtaccgggggggtaaacgggtccctaggacccgtaagggttggtaacgttttaccgaacttacccgtaagttttaacgggtacgggtttaaccgttaaacgggtccgggttaacgtaaaaccgttaaaaagttttttacgacggtaaccgtaacggggtaccgttaccggggttaaacggggtaaacccggttaccccgggtttacccgaaacccgttaccgttaaccccgttaccccggtaaagaacccgggtaaacccaaccccgggtaaccccggtaaaccggtttaaacccctttttcccgttaacccgttttccgtaccggtaaaccgtaaaaccgttaacggaaacccgttaacccggtacccgttaacggaaccggtacgggacccccggtaaaaggggttaaccccaaacccggggtttcgttttaacggtttttacgtttaccgttacgggtttaaccggacggttaaccgggaacgggtaggggttacccgggtacgggtaaaaaccgttggggtaaccccgttacggtaaagggtacgggttaacggtaggtttacgtttccgggtttaaagttccggtttaaccggtcgggggtaaccgttaacggg

SEQ ID NO: 186936 - DNA, 621 bp, Homo sapiens
  misc_feature: GYAE6OF02HJX06.25.71.G05.1.454.CMB.1.raw
  modified_base (334)..(334): a, c, t, g, unknown or other
  misc_feature (334)..(334): n is a, c, g, or t
  modified_base (361)..(361): a, c, t, g, unknown or other
  misc_feature (361)..(361): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtctgggggaggcctggtcaaggcctggggggtcccgaagactctcttgtgcagcctctggattcaacttcaaaggctacagcatgaactggatccgcgaggcctccggggaagggtctgcaggtggatttcatcattagnggttcttaagcgtagaactaaattttngacagacgttcgggtagaaccgggtccggttacaacctatccctacgaaggacgaccgaaccgacccgacgtaccttttccttctttactcgtactaaatcgaaccacgtcctacaagacgccggaaggaccgacggtccttgttttacttcgtgttgacggtagagggtaggtagggaccgaaacgttcgggtactacggtacgggtaggtcgtagtcggttcttttaggtacgttttcggacggggtcctaaacgggg

SEQ ID NO: 186937 - DNA, 582 bp, Homo sapiens
  misc_feature: GYAE6OF02H7RYA.25.71.G05.1.454.CMB.1.raw
  modified_base (363)..(363): a, c, t, g, unknown or other
  misc_feature (363)..(363): n is a, c, g, or t
  modified_base (367)..(367): a, c, t, g, unknown or other
  misc_feature (367)..(367): n is a, c, g, or t
  modified_base (436)..(436): a, c, t, g, unknown or other
  misc_feature (436)..(436): n is a, c, g, or t
  modified_base (448)..(448): a, c, t, g, unknown or other
  misc_feature (448)..(448): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccgaagacctctcttgtgcagcctctggattcaacttcaaaggctacagcatgaactggatccgccaggctccggggaagggtctgcagtggatttcatccattagtggtacttaagcgtagaactaaattttancganagtactcggtagaacggtccggttacacctatcctaccagagacaaccgccgacgtactttctctttcngacaaatgaacncgcctcgagacgaccggaggacgacggcttgtttattcgtgtgacgaggaggtggtagggacgtaaacgtggtctacggtacggtaggtcgtagttcgttcgttttgacgttttcggtacggggaccgtaaggg

SEQ ID NO: 186938 - DNA, 697 bp, Homo sapiens
  misc_feature: GYAE6OF02FUXSJ.25.71.G05.1.454.CMB.1.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtcgtgggggaggcttggtccgaggccgggggggtccctggagactctcctgtgcagcctcgtggattcagttttacgcagtattttggatgagtcgtgggtcccgccgaggcccccgaagggggaacggggctggggtggtggggtacgaccgaacagtaacgacggaagacgtgggaggtgaagaaatactagtgacggtactcgtggtaggaacgggcctattacacctacgtccgtaccgaacgggtaaccaaccgtaccaaaccgtaacctacgtaagttaactaacgtaccgttacggaactaaagttaggtaacttagggtacgtaaggaaggtaccggaccgggaacggaacccggaaccgggtcgttaggttacgttaaacttttcgtagggttcgacggtaggacggttcccggaaccccgtaacgttacccgaacgttacccgtaacccgttacgttcggtttacttttaacggtagttaggttaccgggggg

SEQ ID NO: 186939 - DNA, 843 bp, Homo sapiens
  misc_feature: GYAE6OF02JHTXE.25.71.G05.1.454.CMB.1.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctatttagaaggtgtccagtgtgaggtgcagttggaggagtcgtgggggaggcgttgggtcccaggccggggggggtccctggagtactcctccgtgtgcagcctctggatttcagttttagcagtattttggatgagcgtgggtccgcctacgggccccgaagggggtaacggggcctggggtggtcggggtaagcccgtaaacgacgttacgaacggaaggtaacgtaggggaagggttagaaacggtaaaagttaccgtaagtcggaccgggtaactccggttggtacgggtaaacggggtcccgtaagtttacccgaaccctagtacccgttacccgaaggggtaacccaaaccgttaccccaaacgtaaaccgttacaaacggttaactaaccggttacctttaaccgtaaaacgttaggtaaacgttacggggtttaactacgggaacgggttaaccgggaaccccgggtaaagggtaacccgtaacccggggttaacggttaccgggtttaccggtttaaacgttttccgggttaggttaccgggtaacgggtacggtaacggggttacccggtaacccccgggttaaacgttacccggtaacgttaaacccgtaacccgtttacgttaccggtttaccgtttttaggaaccgtttacgggttccggggttaacccggggggg

SEQ ID NO: 186940 - DNA, 633 bp, Homo sapiens
  misc_feature: GYAE6OF02JY378.25.71.G05.1.454.CMB.1.raw
  modified_base (129)..(129): a, c, t, g, unknown or other
  misc_feature (129)..(129): n is a, c, g, or t
  modified_base (454)..(454): a, c, t, g, unknown or other
  misc_feature (454)..(454): n is a, c, g, or t
  modified_base (469)..(469): a, c, t, g, unknown or other
  misc_feature (469)..(469): n is a, c, g, or t
  modified_base (504)..(504): a, c, t, g, unknown or other
  misc_feature (504)..(504): n is a, c, g, or t
  modified_base (517)..(517): a, c, t, g, unknown or other
  misc_feature (517)..(517): n is a, c, g, or t
tcagactgtacagtcacgaccggtgctcgatttagtgtcgtcgcaagagagaggagccttagccctggattccaaggcctttccacttggtgatcagcactgagcaccgagatcaccatggaagtgggntccgcttggtttccttgtcgctattttagagtgtccagtgtgaggtgtgctggtggagtcgtggggagtccgtggtcagccgtgggggtcccaagactctcttgtagcagcctctggattcaacttcaaaggtcaacagactatgaactgtactcccgacaggccgtacccgggggaaggtctcgacgagtggtactttcctagcccttaattaggttcgttacgttaaggccgttagtaactaaattttcgtgtacgtacgactcggtacgaacggtccgtactaccgatccacctagacaaccgtacgctacgtctttacctntttacagtaactaanaccggtatacggtacctcgaacggacaccgggaanacggtaccggttntttacgtttacttcgtgtcgaacggagtagggtacgtacggaacgtaacgtggaacgtacgtcgggaacgttatcggtttaggtcgtttacgtcggtttacggacggaccgttagg

SEQ ID NO: 186941 - DNA, 589 bp, Homo sapiens
  misc_feature: GYAE6OF02GFE05.25.71.G05.1.454.CMB.1.raw
  modified_base (354)..(354): a, c, t, g, unknown or other
  misc_feature (354)..(354): n is a, c, g, or t
  modified_base (360)..(360): a, c, t, g, unknown or other
  misc_feature (360)..(360): n is a, c, g, or t
  modified_base (387)..(387): a, c, t, g, unknown or other
  misc_feature (387)..(387): n is a, c, g, or t
  modified_base (431)..(431): a, c, t, g, unknown or other
  misc_feature (431)..(431): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccaagctctcttgtgcagcctgtggattcaacttcaaaggctacagcatgaatggatccgccaggctccggggaaggtcgtgcagtggattcgatccattgtggtcttaagcgtgactaaatttangacagngtcggtggaacggtccggttacacctntctccgagagacgaaccgcgacgtcttctctttcacacaacgtnaacgtacgcctacgagacggaccgaggacgacggtcttagttttattcgtggtcgcggaggtagggtaggtagggacgtaaaccgtgggtctaacggtaacgggtaggtagagttcggttcgtttacgttacgttttcggacggggtacgtaaccggg

SEQ ID NO: 186942 - DNA, 602 bp, Homo sapiens
  misc_feature: GYAE6OF02GJAJ2.25.71.G05.1.454.CMB.1.raw
  modified_base (352)..(352): a, c, t, g, unknown or other
  misc_feature (352)..(352): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggtttccttgtcgctattttagaaggtgtccagtgtgaggtggtgctggtggagtctgggggagcctggtcaagcctggggggtcccaagctctcttgtgcagcctctggattcaacttcaaaggctacagcatgaactggactccgccaggctccgggggaaggtctgcagtggatttcatcattagtgtacttaagctgactaaattttangcagactcggtagaaccggccggttacacctatccgtccagacgacaaccgccgacgtactttcgtcttctgacctaaatgaacagtccctacgacgacgccggacggactacggtcttagttttacttttcgttggttacgcgaaggacggtacgggtcgggtacgaaacggttcgggacctacggttaacgggagggttacgtaggttgttcgttttagtagttttcggtacggggtaccgtaacggg

SEQ ID NO: 186943 - DNA, 732 bp, Homo sapiens
  misc_feature: GYAE6OF02JZE1V.25.71.G05.1.454.CMB.1.raw
  modified_base (262)..(262): a, c, t, g, unknown or other
  misc_feature (262)..(262): n is a, c, g, or t
  modified_base (372)..(372): a, c, t, g, unknown or other
  misc_feature (372)..(372): n is a, c, g, or t
  modified_base (432)..(432): a, c, t, g, unknown or other
  misc_feature (432)..(432): n is a, c, g, or t
  modified_base (540)..(540): a, c, t, g, unknown or other
  misc_feature (540)..(540): n is a, c, g, or t
  modified_base (695)..(695): a, c, t, g, unknown or other
  misc_feature (695)..(695): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtgggctcgctggtttcctgtcgctatttagagtgtccagtgtgagtggtgctggtggagtctagggggagcctggtccaaggcctggggggtcccaagactcgtcttggtgcagccttactggaatttcgaacttnaaaggtcctaacgagcgatcgaactggactccggccaagggccaaccggggttagggtctcgtgaacggttggactttcgagtccctagttacggtcggtaccttaaggngtacgtaaccgtaaaattttgcgtctaacggtactccgggtagaaaccggtcccgtttanaacccgtagttccacgtaagacgacacggacccgtactacgtttctaccgtttacgtcgactaacgtacaaacgtcgtacccagtaccgaagtaccgaaccgggtaanaccgggtacgtttagttttaaccgtttcgtacgggtttaaccgcgtaacggtaaacgttaggggttaccgggaaccggtaaacgttccgggttaacccgggccttaaaccggggtacggtttacggaagttaccggttacgggttttttaaccgnggttttacccggttaggggtacccccggttaaagggg

SEQ ID NO: 186944 - DNA, 718 bp, Homo sapiens
  misc_feature: GYAE6OF02JPFDQ.25.71.G05.1.454.CMB.1.raw
tcagactgtacagtcacgaccggtgctcgatttagtgtcgtcgcaagagagaggagccttagccctggattccaaggcctttccacttggtgatcagcactgagcaccgagattcaccatggaagtgggctccgctggtttccttgtcgctattttagaaggtgtccagtgtgaggtggtgcgtggtggagtcgtgggggaggccgtggtcaagccgtgggggtccccgaagactctcttgtgcagccttcgtggtacttactaacttcaaaggtctacagcagtagaacgtgactcccgccaggtccgtccgggaaggtcgtcgcgtaggtggtatttcgatcccgtagttagtggttacttaggcgtaggtaacttaaagttttacaggtacaggtactcgggtagaaccggtccggttaccaaccgtacgttccaccggtaagacgaacccgtaaaccgcccggtaaacgtacccgttttccgttaacgtttctacgtaactaaacgtacgtaaccgaacggtaccctaccgaaagtccgtaccgggaaacggacgtaaccggtacgtttacgttttaacgtttcgtacgttgaaccggtaacggtagggacggttacgggacgttaaaccgtacgggtaacctaccggtacgggtaacggttagagtttaacgtcgttttaacgtagtttcggtaccgggtaacccgtaagggg

SEQ ID NO: 186945 - DNA, 686 bp, Homo sapiens
  misc_feature: GYAE6OF02HX3BS.25.71.G05.1.454.CMB.1.raw
  modified_base (251)..(251): a, c, t, g, unknown or other
  misc_feature (251)..(251): n is a, c, g, or t
  modified_base (376)..(376): a, c, t, g, unknown or other
  misc_feature (376)..(376): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgctattttagaaggtgtccagtgtgaggtggtgctggtggagtcgtgggggagcctggtcaagccgtggggggtcccgaagactctcttgtgcagcctntggattcaacttcaaaggctacagcatgaactggactccgccaggcgtaccggggaaggtctgcgaggtggtatttcacttcctagttacggtggttacttaaggcgttagaacttaaattttgngactagacgttacggtagaaccggtccgttacacctatcctacgaagaacgaccgaaccgccgtaacgttacttttccttctttcgtacgtaactaaactacgaaacgtacgtacccgtacgaaggaaccgaccggtaacgggaacgtaccgggtacgtttacgtttttacttaccgttggtacggtacggtaaggaagggtacgggtacggggaacgtaaacgtcgggtaccgttaccggtaaggggtaggttacgtagttacggtttcgttttaggtacggttttcgggtacggggtaccgtaacggg

SEQ ID NO: 186946 - DNA, 645 bp, Homo sapiens
  misc_feature: GYAE6OF02HCLVN.25.71.G05.1.454.CMB.1.raw
  modified_base (393)..(393): a, c, t, g, unknown or other
  misc_feature (393)..(393): n is a, c, g, or t
  modified_base (492)..(492): a, c, t, g, unknown or other
  misc_feature (492)..(492): n is a, c, g, or t
  modified_base (499)..(499): a, c, t, g, unknown or other
  misc_feature (499)..(499): n is a, c, g, or t
  modified_base (503)..(503): a, c, t, g, unknown or other
  misc_feature (503)..(503): n is a, c, g, or t
tcagactgtacagtcacgaccggtgctcgatttagtgtcgtcgcaagagagaggagccttagccctggattccaaggcctttccacttggtgatcagcactgagcaaccgaggattcaccatggaagtgggctcgctggttttcctgtcgctattttagaaggtgtccagtgtgaggtggtgcgtggtggagtcgtgggggaggcctgggtcaagtccgtgggggggtcccgaaagctctcttgtgcacgcctctggtacttactaacgttacgaaaggctaccagcagtagaacctgactccgaccgacggtccgtcgggggtaaggtctggcgtaggtgtattcgactccgtagttagtcgttacttaggcgttacgaaattaactttagngactaagtccgtacggtcggaaacggtccgtttaccacctacgtcctaccgagacgaacgaccgacgtacgtactttctcttacgtgtacaagcgaacncgcctanacgngaccgaggactgtacgtttagttccttgtgtacgaggtaggacggacggtacggaccgtaaacgtgtaaccggtaccggtagggtacgtggttaagttggttaccgtttagtttacggtccgggttacgggacccgtaaggg

SEQ ID NO: 186947 - DNA, 807 bp, Homo sapiens
  misc_feature: GYAE6OF02GX7VC.25.71.G05.1.454.CMB.1.raw
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcaggttggaggagtcggtgggggagtcgttcggtaccgaggcccggtacggggggttcccctaggacgtaccgttccgtacccgttggtccgacacggtcccttcgttagggtactttcgtaagttttacgccgtagttagttttaggactggacggtcgttcgggtcccgacccgacgggccccggaagggggtaacgggtccgttcggggtgggtacggggtaacgaccccgtaaagtaacgttaaccgaacggaacggtacggtacggggacggtaacggaaaggttaaaacgttaacggttagtacgggtaaccggtaccttcggttacgggtacgggaaaccggggtcccgttaacgtttacccgaaccgtacttaccggttaccggaacgggtaaacccaaccgtacccgaaactaacgtaccgttaattaactacgttacgtacgaacttaaagtacgtaggtcggttactagaacggaccggaccggaaggaccggtacgtcgttaggttacgtttaccgtttgtacggtgaaccggaggtccggtcccgtaacccgtaaccgttccgtaacggtcccggttaaccctaggtttcgttacttttagagtttacgggg

SEQ ID NO: 186948 - DNA, 828 bp, Homo sapiens
  misc_feature: GYAE6OF02JK1Q0.25.71.G05.1.454.CMB.1.raw
  modified_base (314)..(314): a, c, t, g, unknown or other
  misc_feature (314)..(314): n is a, c, g, or t
  modified_base (368)..(368): a, c, t, g, unknown or other
  misc_feature (368)..(368): n is a, c, g, or t
  modified_base (377)..(377): a, c, t, g, unknown or other
  misc_feature (377)..(377): n is a, c, g, or t
tcagactgtacagtcacgaccggtgctcgatttagtgtcgtcgcaagagagaggagccttagccctggattccaaggcctttccacttggtgatcagcactgagcaccgagattcaccatggaagtggggctccgctgggtttcctgtcgctattttagaaggtgtccagtgtgaggtggtgcgtggtggagtcgtgggggagcctgggtcaaggccgtcggggggtccccgaagacgtcgtcgttggtcgcacgccttacgtggtatttagtttcaaggttggttctcgggcagttgcctaacggtgggtccnccggaggtctaccgaggcgaacggggccggtagtgggttagccgtaggttaacngccgtaacngtcggagtagggtaaatgtaacgtagttaattacgcgacgtaagtaccgttcggaggtaacggggtcctacgtacgtaaccctattccggtaacccgtagtaaccgaaccgttaaaccgtaccccggtaaagttactttagggtaccgtttacggttaaacgggtaaacgttcccgggtttaaagcccgggttaacttacggtaaaggggttaaacgggtccggtaaaccggggttacccgttcggttaacccgtttaccgttaacggttttaaccgtttacggtcgggtttaacccggataaccggggttgggtaaccgggggttaaggtttacggggttaacttttaacggggtttaacggtttacccccggggaagggttcgttaaaccgggtttacgggtaccccggggggtttaccggggaacggttaccccggggttaacccggg

SEQ ID NO: 186949 - DNA, 804 bp, Homo sapiens
  misc_feature: GYAE6OF02IUMVS.25.71.G05.1.454.CMB.1.raw
  modified_base (206)..(206): a, c, t, g, unknown or other
  misc_feature (206)..(206): n is a, c, g, or t
  modified_base (277)..(277): a, c, t, g, unknown or other
  misc_feature (277)..(277): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctccgcttgggttttccttgtcgcttattttagaaggtgtccagtgtgaggtggtgctggtggagtcgtgggggngcctggtcaagccgtgggggtccaagctctcgtgtcgcagtcctctggattcaacttcgaaggctacacgnagtgaactggactccgcgaggcggtaccggggtaggtctgcgtaggtacggtactttacacttcccgtaagtttacggttacggttacgttaaaccggtcggttaaacgtaaacgtttaaaaacgtttttacggtagtaccggtaaacgttaccggtttacgggttaacgggtaaaaccccggggttcccgggttttaaccaaaccccgttacgttaacccgtacccgaacgggttaaaccgaaacccgaacccgggtaaccccgttaaaccgtttaccctttttccgtttaccgttttacgtacgtaaactaaagttacgaaaccgtaccgttacccacggtaacggaccggaccgggaacgtaccggtaacggttcgttttacgttttacgttcggtacgttcggacggtaagggacggtcggttaaggacgttaacggtggtaccgttacggtacgggacggtttagacgttttacgttcggttttaacggttacgttttccgggagggttacccggtaacggg

SEQ ID NO: 186950 - DNA, 580 bp, Homo sapiens
  misc_feature: GYAE6OF02FZTBY.25.71.G05.1.454.CMB.1.raw
  modified_base (335)..(335): a, c, t, g, unknown or other
  misc_feature (335)..(335): n is a, c, g, or t
tcagactgtacagtcacgaccggtgctcgatttagtgtcgtcgcaagagagaggagccttagccctggactccaaggcctttccacctggtgatcagcactgagcacagaggactcaccatggaattggggctgagctgggttctccttgttgctattttagaaggtgtccagtgtgaggtgcagttggaggagtctgggggaggcttggtccagccaggggggtccctgagactctcctgtgcagcctctggattcagttttagcagtattttggatgagcgtgggtccgccgagggcccccaggggaacggggctgggtggtgggtagccaanatacgacgaagagtggaggtgaagaaatactatcgacggactcgtagtagaacgggccgtagttccacctagtcctaccgagggaacctaactacccgaacaacctacaagtatatctagacaaatgaatggtctagagacgccgaggacgacggctgtgttacttcgtgtcgcgtaggtcgtacgacccccgtaagtaccctaagtaccgtaacccgttagttcggtacttttagacgttaagg

SEQ ID NO: 186951 - DNA, 681 bp, Homo sapiens
  misc_feature: GYAE6OF02H8RSX.25.71.G05.1.454.CMB.1.raw
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttcctgtcgctatttagaaggtgtccagtgtgaggtggtgctggtggagtcgtgggggagcctggtcaagccgtgggggtcccaagactctcttagtgcagcctctggattacctaacttaccgaaaggtacctacagacatagaactggactccgccgtaggccgtacgggggaacgttcgtgacctaggtggtactttacactacctagttacggtgttaacgttagcgtagtaaccttaaatttcgtagtacgtagtacgtcgggtacgtaaacggtccggtacaaccgtactccgtacgaacgtaacgaccgaaccgtaccgtacgttacctttacctacgttttcgaacgtaccaaagttacgaactacgctaacgtacgacgacggagaccgtccgacgtttagtttacgttgtaccgtagaccggtaggtaacgagggtaccgaaccggtaaagtcggaaccgtaccggaaggtaccggtagtacgttcgtacggtttacgttacggttaccggtacggggacttaacggg

SEQ ID NO: 186952 - DNA, 854 bp, Homo sapiens
  misc_feature: GYAE6OF02JC7QL.25.71.G05.1.454.CMB.1.raw
  modified_base (356)..(356): a, c, t, g, unknown or other
  misc_feature (356)..(356): n is a, c, g, or t
  modified_base (408)..(408): a, c, t, g, unknown or other
  misc_feature (408)..(408): n is a, c, g, or t
  modified_base (724)..(724): a, c, t, g, unknown or other
  misc_feature (724)..(724): n is a, c, g, or t
tcagactgtacagtcacgaccggtgctcgatttagtgtcgtcgcaagagagaggagccttagccctggactccaaggcctttccacctggtgatcagcactgagcacagaggactcaccatggaattggggctgagcgtgggttctccttgttgctattttaggaagtgtccagtgtagaggtgtcaggttggagggtgttcggtagggggcggtcgttgggtaccgacgggcccggggggggtcccttggacgtacccgttcgtcccggtgtcggaccaggtccctcgtaggtacttcgtaggttttagcgtagttacgtttgagtgtacgcgtacggtccgcctacggacccgngggacggtcgtaggtcggtacggtacgacccgtaagacgtaacgacggaagngtagggaggtaaccgaaagttaacgtaaacgtttacgtaggtaccggtaagttccggttaagggtacggtaaacggggtccccccgttttaaagttaccccggaacgtaaccgtttcccggttaaccggtaaacgggaacccctaaaccgtttaaacccaaaaccgtaacgtaaccgtaagttaacgttagtaaccgtaacgtaaccgaaaagttccgggaaatttccgggtagttaacggaaccgggttaaggtaacccggacggggtaaaccctagggggtcctaaacggttttgggtttacctttaaccgggnggtaacggtcccggtaagggtaccggttaacccgggaccccgttaaagttacccgaaaccggttaccggttaaaccccgttggttccgttttacccttttaaaggtaccgttaacggggtttaaccgggg

SEQ ID NO: 186953 - DNA, 956 bp, Homo sapiens
  misc_feature: GYAE6OF02H9XZA.25.71.G05.1.454.CMB.1.raw
  modified_base (134)..(134): a, c, t, g, unknown or other
  misc_feature (134)..(134): n is a, c, g, or t
tcagactgtacagtcacgaccggtgctcgatttagtgtcgtcgcaagagagaggagccttagccctggattccaaggccctttccacttggtgatcagcactgagcaccgagattcacatggagtgggctccgnttcgggttttccttgtcgcttatttagaaggtgtccagtgtgaggtgtgcgtgggagtagtcggtcgggggacgccttggcaggccggtcgggggtcccaaagccttcgtctggtgcacggtcctgtagacttaccgaacttacgaagtacctacgagtacctagtacgtaaccgtcggtacctcccggaccctaacgggccggggtaacccgggggaacgggttccgtacggacggttagggttacgttaactttccggtaactcccgtttaagttacgggtttcgttacgtttaagggccggtttaaaagtaaccgttttaaaaagtttcggtaccgtaacgttaccgggtaacgggtttaacgggttacggggtaaaccccgggttcccgtttaacccgaacccgttcgtttacccgaaccgggaaacccggttaacgaaccccggttaacccccggggtaacccggtttaaccccgttttaacccttttttaccccgtttttaacccggtttccgaacccgggttaaaacctaaacccggtttaggttaaaacccccgaacggggtttccccccttaaaaggggccgggttaaacccggaccgtaaaccccgggggttaccgttaaccgggttccgtttttaacgtttttacggttagtccggggtaacgtaacggtaagggggtagttaaacgggggacgtaacccggttaacccggttgggtaacccgttaaccggggacgggttagtttaccgggtcgtttacggtttactttccggtttaaccgggttacggtaacccggggtaacttacgggg

SEQ ID NO: 186954 - DNA, 622 bp, Homo sapiens
  misc_feature: GYAE6OF02IPHIR.25.71.G05.1.454.CMB.1.raw
  modified_base (232)..(232): a, c, t, g, unknown or other
  misc_feature (232)..(232): n is a, c, g, or t
  modified_base (335)..(335): a, c, t, g, unknown or other
  misc_feature (335)..(335): n is a, c, g, or t
  modified_base (375)..(375): a, c, t, g, unknown or other
  misc_feature (375)..(375): n is a, c, g, or t
  modified_base (378)..(378): a, c, t, g, unknown or other
  misc_feature (378)..(378): n is a, c, g, or t
  modified_base (445)..(445): a, c, t, g, unknown or other
  misc_feature (445)..(445): n is a, c, g, or t
  modified_base (453)..(453): a, c, t, g, unknown or other
  misc_feature (453)..(453): n is a, c, g, or t
  modified_base (461)..(461): a, c, t, g, unknown or other
  misc_feature (461)..(461): n is a, c, g, or t
  modified_base (506)..(506): a, c, t, g, unknown or other
  misc_feature (506)..(506): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctcgctgggttttcctgtcgctattttagaaggtgtccagtgtgaggtggtgctggtggagtcgtgggggagcctggtcaagccgtggggggccaagcctntctgtcgcacgcctctggattacaacttacgaaaggctaacagcatacgaactggactaccgacgaggccggtaccggggagggtctggcaggtggtactttnactccgtaagttacgtgtacttaagcgtagtactaatttncgnagactcggacgaacggtccgttcaactctcctcgaagacgacaccgcgaccgttactttctctttcntaactaancgtaaacngtaccctacgacgacggtccagggacctacggtagtttacgtttnttacgtggcgtaacggaggaggtaggtacgggactaacgggtcgtccggtagtaacggggtgttagtacgttcgtttacggtttgtacggtttacgggtacgggtaccgtaacggg

SEQ ID NO: 186955 - DNA, 885 bp, Homo sapiens
  misc_feature: GYAE6OF02GI6ET.25.71.G05.1.454.CMB.1.raw
  modified_base (165)..(165): a, c, t, g, unknown or other
  misc_feature (165)..(165): n is a, c, g, or t
  modified_base (179)..(179): a, c, t, g, unknown or other
  misc_feature (179)..(179): n is a, c, g, or t
tcagactgtacagtcacgaccggtgctcgatttagtgtcgtcgcaagagagaggagccttagccctggattccaaggcctttccacttggtgatcagcactgagcaccgagattcacatgagtgggctccgctggtttccttgtcgctattttagaggtgtccgngtagtgaggtggtncgtggtcggagtcggtgggggaggccgtacggtcaaggccggtcgggggtcccgaacgtactccttcgttgtcgacgacgtcctcgtggtattaccgtaaccgttaacgaaacggtcctaacgaggtacgattaggtaaaccgtacggcccgtacccggacccgtaccgggggtacccggtacccggggggtaaccgggggtccgttcggccggttaagggttacgttacggtttaccgtaaccgttaccgttaacgttaggttcgggtttaaacgttaacggtaccggttaacggttaaacctttaaaagtttacgtacggaacgtaacggttaccggttaccgggtaccgggttaacccggttccccggttacctaacccgtaccgtcccgtaccgaacggaacgaacccgaaccggtcccgttaaaccggttaccttttttctacctttccgggtaacaaaccgttaaacaccgtaacggacccgtacccgttaagaacgtccggaccgggtaacgtaccggttaccgtttaacgtttcggttttccgttacgtaggtacggacggttaaggaaccgggtttcgggaacgggttaaaccggtcggtaaccggttacggcggttaaacgggtagttacggttacttgggtttaccgggttttaattacccgggtttacggttaccggggtaagggttaacccgg

SEQ ID NO: 186956 - DNA, 829 bp, Homo sapiens
  misc_feature: GYAE6OF02HXZ14.25.71.G05.1.454.CMB.1.raw
tcagactgtacagtcacgaccggtgctcgatttagtgtcgtcgcaagagagaggagccttagccctggattccaaggcctttccacttggtgatcagcactgagcaccgaggattcaccatggaagtggggctccgctgggttttccttgtcgcttattttagaaggtgtccagtgtgaggtggtgcgtggtggagtggtgggggagtccgtggtcaagccggtcgggggtacccaagtactctagttgcgcacgcctagtggtattactaacttagaaaggtctacgacgacagtacgacgtggactccgacgacggtcgtaccggggtaacggtctacggcgtaggttggtaactttcgacgttcctaagttttacggtacggtttacgttaacggtcggtaacgtaaaccgtttaaaagtttggtcgtacgtaacggttaccgttacgggtaaccgggtaacccgggttacccggtttaacccaacccggttatccccggtaaccgaacggtaaccgtaaacccgtaacccggtacccggtaaaccgtttaccgtttttccgttacgtttaccacggaaaccttaaagttaccgaaaacggtccgtaccgttaaacgacggttaaaccgggacccggtagggtaacgttaaccggttccgtttaggtttttaacccgttgtacggtacgggtacgtaacgggtaaggtaccgggttaacggggaaacttaaacgggttcgggaccgttaacgggtaacggtagggttacgttacgttgtttaccgggtttacgtcgggttttaaccgggcggggtaacctaacggg

SEQ ID NO: 186957 - DNA, 764 bp, Homo sapiens
  misc_feature: GYAE6OF02GHDIM.25.71.G05.1.454.CMB.1.raw
tcagactgtacagtcacgaccggtgctcgatttagtgtcgtcgcaagagagaggagccttagccctggactccaaggcctttccactggtgatcagcactgagcacagaggactcaccatggaagttggggctgagcgtggttctccttgttgcttattttagaggtgtccagtgtgaggtgcgtaggttggaggtagtcggtggggggaggtcgttcggtccggacggggtcccgggggggtccctggacgtacttccgtccgttgtcgctacgcctcgtaggtacttcgtagtttagctagttagtttggatggtagtcggttacgggtcccgaccggtaccgggaccccggtaagggggacgggtcgttggggtacggttacggggacaaccgaactaacgtaacgaacggtaaggcggtaggaggtacgaaagtaaagtacgtaagtcggaccggttactggtaggacggtacggaccgttaacgttaccaacgtacgtaccccgtaacggaacggtaaacccaaccggtaacctaaaccgtaacctacggtaacttagaaccttcgaacgtaactaaaagtgttaacgtacggtactaggaacggtaccggaacggtaaccggtaaccgccgttaaggttcgttaagtttacttggtacgggtacggtacgttacggaaccgttacccggaaccccgtttaacgacttaacggacccgttaccgttgttaccggttaccttaggtactcgggtacgggg

SEQ ID NO: 186958 - DNA, 764 bp, Homo sapiens
  misc_feature: GYAE6OF02G8JLL.25.71.G05.1.454.CMB.1.raw
  modified_base (449)..(449): a, c, t, g, unknown or other
  misc_feature (449)..(449): n is a, c, g, or t
tcagactgtacagtcacgaccggtgctcgatttagtgtcgtcgcaagagagaggagccttagccctggattccaaggcctttccacttggtgatcagcactgagcaccgaggattcaccatggaagtggggctcgctgggtttcctgtcgctattttagaaggtgtccagtgtgaggtggtgctaggtggagtcgtgggggagcctggtacaacggccgtggggggtcccaagactctcgttggtgacacgccttcgtaggattaccgaaacttcaaaacgggtcctaacgagacctaatacgaacgttggactcccggaccgaagggccgtacccgggggtaagggtcctaggccgtaaggttcggtaacgttttaccaacttccgtaaagttcggtacggttaccgttaaggtcggtaacgtaacgttaaaagttttacgacggtanaacgtaccgtttacgggtacgaaccgggtccgtacaaccgtactccgtaccgtaagaccgaaccgaacgtacccggtacgttaaccttttacgtcctttgacgtaacgtaaacgaacgtaacgtacgtacctcgaacgtccgacgtaaccggactacgggtacctttaggttttacttcggtagtcggtaacggtaaaggcgggtaagggtaccgggtaacgtaaaccggtcggtaacgttaccgtaaaggggacgttaacgtaggttaccgtttaggttacgttaacggttcgggtaccgggtaccgtaaaggg

SEQ ID NO: 186959 - DNA, 573 bp, Homo sapiens
  misc_feature: GYAE6OF01DZ47M.9.31.C09.1.454.CMB.1.raw
  modified_base (245)..(245): a, c, t, g, unknown or other
  misc_feature (245)..(245): n is a, c, g, or t
  modified_base (410)..(410): a, c, t, g, unknown or other
  misc_feature (410)..(410): n is a, c, g, or t
tcagtgatacgtctcacgaccggtgctcgatttagacgtctcatcaaggaaggaaggggggggtctcaggaggcagcgctctcgggacgtctccaccatggcctgggctctgctattcctcaccctcctcactcagggcacagggtcttgggcccagtctgccctgactcagcctgcctccgtgtctgggtctcctggacagtcggtagccatctcctgcactggaaactaacagtgacgttggngactttaataattatgtctcctggtatcaaacaacaccaggcaaagccccccaatcattatttctgatgtacaacaatccggacccccagggtatttctgatcgtcttctctcggctccaagtctggacaacgacggccctcctgaccatctcgtggctccgggntaggacggacgaggctcgactattactgcagctactaatactaaccaaccagaccgactacttcgttagttcggttcggacgggtaggacctacgaacgtcggaacccgttccgtaggtaccacgacccgaaggtaccctccggcccccctggtccctacccg

SEQ ID NO: 186960 - DNA, 698 bp, Homo sapiens
  misc_feature: GYAE6OF01AULOU.9.31.C09.1.454.CMB.1.raw
  modified_base (266)..(266): a, c, t, g, unknown or other
  misc_feature (266)..(266): n is a, c, g, or t
tcagtgatacgtctcacgaccggtgctcgatttagacgtctcatcaaggaaggaaggggggggtctcaggaggcagcgctctcgggacgtctccaccatggcctgggctctgctattcctcaccctcctcactcagggcacagggtcttgggcccagtctgccctgactcagcctgcctccgtgtctgggtctccgtggactaggtcggtagcctatctcctgcacgtaggaactaacgaggtgacgttggtgtacttaataattntgtcctcgtgtatcaacaacaccaggacaaccgcccccaatctattattctgatcgtacaacacgtccggaccccgagggtacttcgtagactcgtcttctctcggcctcgacgtcgtcgacacgtaccgtcctcctacgtacctacgtccgtcggtcgggtcccggttccgggtacgtcgggaacgggtaccggtacggtaccctacgttaaccgttacgtttaaccgtcggtacgtaccggtccttaactaaccgttaaacctaacccgtaaacccgaccggtacccgtaaccgtacctttcggtttacgggttccggttaccggggtacgggacgggtacgtaccggtaacgtcccggtacccggttacggtaccgtaccgaccggacccgtacggtcccgtacccggtcccctcgggtccctacccgg

SEQ ID NO: 186961 - DNA, 631 bp, Homo sapiens
  misc_feature: GYAE6OF01EL8TM.9.31.C09.1.454.CMB.1.raw
  modified_base (246)..(246): a, c, t, g, unknown or other
  misc_feature (246)..(246): n is a, c, g, or t
  modified_base (310)..(310): a, c, t, g, unknown or other
  misc_feature (310)..(310): n is a, c, g, or t
  modified_base (346)..(346): a, c, t, g, unknown or other
  misc_feature (346)..(346): n is a, c, g, or t
tcagtgatacgtctcacgaccggtgctcgatttagacgtctcatcaaggaaggaaggggggggtctcaggaggcagcgctctcgggacgtctccaccatggcctgggctctgctattcctcaccctcctcactcgagggcacgagggtcttgggcccagtctgccctgactcagcctgcctccgtgtctgggtctcctggacagtcggtagccatctcctgcactggaactaacagtgacgttggntcttaataattatgtctcctggtactcaacaacaccaggacaaacgcccccaatctattattcngtatgtacaacacgtccggaccccgaggtactttcngtatccgtcttcgtctgcctacaagtctcggacaacgccggtccctccgtacgaacctacgtcctcgtcgggtccgtccgggtctacgggacggacggacggtcctaccgtaacttagttacctgtacagtcctactaattaactaaccaacgacgaccgtaactccttacgttcggtttacggtccgggacgggtacggtactagtaaccggtcgtacccggttacgacggtccaccggacccgtaacgggtccctacccggtcccccgttaggtccctacccg

SEQ ID NO: 186962 - DNA, 985 bp, Homo sapiens
  misc_feature: GYAE6OF01E5EFD.9.31.C09.1.454.CMB.1.raw
tcagtgatacgtctcacgaccggtgctcgatttagacgtctcatcaaggaaggaaggggggggtctcaggaggcgagcgctctcggggacgtctccgaccatggcctgggctctcgcgtattcctcgacccgtcctcactcagggcacagggtcttgggcccagtctcgccctgactcacgcctgcctccgtgtctcgggtctccgtggacagtcggtagccatctctgcacgtggaactaacgagtcgtacggttgggtgacttaagttaagttagtcgtcttccgttaggttaactacgtaaccgaactaacccggaacgaccaaaccgtacccccctaaacgtacctaacgtttaacgtttccgtaggtacgtacgtaccaaacgtaaccgtacccgggacccccgtaaggggtactttacgtacgtaacgttccgtacctttaccgtcggttcggtccttacccgtaacgttaccgtacgggaacctaaaccgtacccggtaccccgtaccccgtacggtaaccctacgttacccgtaccgggtaccggggtacccggttaccggggtacgttacggggtaacgggtaaccgggtaaccgggtaccctttaaacccgttaaaccgtttaaaccgtttaacccggtacgggttacccggtaaccgggttacccttaaccgttaaaccgttaaaacgtaaccccggtaaaacccggacccgggtaacccggttaaaccccgttacccggtttaaccgttttccgggttttacccggggttacccggggtaaccggggtaacccggggttaaccgtaaaccccggggttaaaccccggttaacccgggttaaccccccggggttaccccggtttaaacccggggttacccgtaaacccccgggtttacccccgggaaaccggggtttcccccgtaacccccgggttcccccccggtttacccgggtaccccgttaaccccccgg

SEQ ID NO: 186963 - DNA, 526 bp, Homo sapiens
  misc_feature: GYAE6OF02GKXQG.9.31.C09.1.454.CMB.1.raw
tcagtgatacgtctcacgaccggtgctcgatttagacgtctcatcaaggaaggaagggggggtctcaggaggcagcgctctcgggacgtctccaccatggcctgggctctgctattcctcaccctcctcactcagggcacagggtcttgggcccagtctgccctgactcagcctgcctccgtgtctgggtctcctggacagtcggtagccatctcctgcactggaactaacagtgacgttggtgcttataattatgtctcctggtatcaacaacacccaggcaaagccccccaactcattattctgatgtcaacaatcggcccccagggatttctgatcgcttctctggctccaagtctggcaacacgcctccctgaccatctctgggctccgggctgaggcgaggctcactattactgccagtcttatgaacaaacgtcagaactagtttgggtgtttcggcggagggaccaaggctcgaccgtcctcagtcagcccaaggcctacgccccctggtccacttccg

SEQ ID NO: 186964 - DNA, 531 bp, Homo sapiens
  misc_feature: GYAE6OF02FUUN1.9.31.C09.1.454.CMB.1.raw
  modified_base (419)..(419): a, c, t, g, unknown or other
  misc_feature (419)..(419): n is a, c, g, or t
tcagtgatacgtctcacgaccggtgctcgatttagacgtctcatcaaggaaggaagggggggtctcaggaggcagcgctctcgggacgtctccaccatggcctgggctctgctattcctcaccctcctcactcagggcacagggtcttgggcccagtctgccctgactcagcctgcctccgtgtctgggtctcctggacagtcggtagccatctcctgcactggaactaacagtgacgttggtgcttataattatgtctcctggtatcaacaacacccaggcaaacgccccccaatcattattctgatgtcaacaatccggccccagggatttctgatcgcttctctggctccaagtctggcaacacgcctccctgaccatctctgggctccgggctgaggacgaggctcactattacngcagctacatactacaaccagcacacttcgtgttcgttcgcggtaggctagaacctggacccgttccgtaggtccacgccccgaaggcctccggcccccgtcggtcctaccg

SEQ ID NO: 186965 - DNA, 527 bp, Homo sapiens
  misc_feature: GYAE6OF02G32UJ.9.31.C09.1.454.CMB.1.raw
  modified_base (243)..(243): a, c, t, g, unknown or other
  misc_feature (243)..(243): n is a, c, g, or t
  modified_base (439)..(439): a, c, t, g, unknown or other
  misc_feature (439)..(439): n is a, c, g, or t
tcagtgatacgtctcacgaccggtgctcgatttagacgtctcatcaaggaaggaaggggggttctcaggaggcagcgctctcgggacgtctccaccatggcctgggctctgctattcctcaccctcctcactcagggcacagggtcttgggcccagtctgccctgactcagcctgcctccgtgtctgggtctcctggacagtcggtagccatctcctgcactggaactaacagtgacgttggngcttataattatgtctcctggtatcaacaacacccaggcaaagccccccaatcattattctgatgtcaacaatcggcccccagggatttctgatcgcttctctggctccaagtctggcaacacgcctccctgaccatctcgtgggcctccgggctgaggacgaggctcactattactgcagctcatactacaaccngacgacactctgttgtcggcggtagggctgaacctggacccgttctaggtcacgcccgaaggtcctccggcccccttggtcctacccg

SEQ ID NO: 186966 - DNA, 648 bp, Homo sapiens
  misc_feature: GYAE6OF02GFH5X.9.31.C09.1.454.CMB.1.raw
  modified_base (229)..(229): a, c, t, g, unknown or other
  misc_feature (229)..(229): n is a, c, g, or t
  modified_base (287)..(287): a, c, t, g, unknown or other
  misc_feature (287)..(287): n is a, c, g, or t
  modified_base (443)..(443): a, c, t, g, unknown or other
  misc_feature (443)..(443): n is a, c, g, or t
tcagtgatacgtctcacgaccggtgctcgatttagacgtctcatcaaggaaggaaggggggggtctcaggaggcagcgctctcaggacgtcaccaccatggcctgggctctgctcctcctcaccctcctcactcagggcacagggtcctgggcccagtctgccctgactcagcctccctccgcgtcccgggtctcctggacagtcagtcaccatctcctgcgctggacnccaccaatgtactttggtgttttaatcgtgtcgtcgtcggtaaccaaaaaccaccaanacaaacgcccccaaactcctacatttatcagtaccaactaacgccgcctacgacgggtcctggtcgcttctcgtgctactaactctagacacgtacgtccctaccgtcgaccgtcgtcgtcgggcctaccgacggtcgtaggacggataggacggnttagtaatttacgttacgtcgactaccgttactaatcgtgacggacggtacgtacggctaagttcgtagttaggttacgtaagttaacgttcgggaccggaacgggaaccacgcgtaccggtaacccgttacggtaaaccgttagaacccggacccgtaacggtcccgttacccggtcccccgtacggtaccctaccgtttcccg

SEQ ID NO: 186967 - DNA, 797 bp, Homo sapiens
  misc_feature: GYAE6OF02FNNS2.9.31.C09.1.454.CMB.1.raw
  modified_base (144)..(144): a, c, t, g, unknown or other
  misc_feature (144)..(144): n is a, c, g, or t
tcagtgatacgtctcacgaccggtgctcgatttagacgtctcatcaaggaaggaaggggggggtctcaggaggcagcgctcgtcgggacgtctccaccatggcctgggctctgctacttcctcaccctcctcactcagggcacngggtcttcgggcccagtctgccctgactcagcctgccctcgtgtctcgggtctctgacagtcgatagcctatctccgtgcacgtacggtaaactacaggtcgtacgtttggtactactttaataattatgtacctcgtggtactacaaccaactacccgacggaccaaaccgcccccaatcgtaactttctttcgtagtactcgtaaccaaaccgtcgtaccccgggaccccgttaagggttacctttctaggttacctccgtttacctttcctcggtccgtaccgttaccgtaaccgttcgtacgaaccgtaacccgtaccggtccccttaccctccggtacctaccgtttaccttcccgggtcggggtcccggtacccgggtacgtcggggaacccggtacggtccgtaccgttaacctagtttacttacccgtacggtaccttacgtacctaataacgttaacccaacgttaaacccgaagacccggttaaccttaccgttaccggttttcggtttaccggggtaccgggtacggggtacggtaacccgtaccggtttaaccggaccggttaaccccgttcggggtaaaccgtccggacccgtaccggtaaccggcccgttacccccggttccgtaccccgtttaacccg

SEQ ID NO: 186968 - DNA, 542 bp, Homo sapiens
  misc_feature: GYAE6OF01EEYUL.40.87.H10.1.454.CMB.1.raw
  modified_base (194)..(194): a, c, t, g, unknown or other
  misc_feature (194)..(194): n is a, c, g, or t
  modified_base (537)..(537): a, c, t, g, unknown or other
  misc_feature (537)..(537): n is a, c, g, or t
tcagtctagcgactcacgaccggtgctcgatttagcagtactgcgttgggtttggggggtagagaagacaggattcaggacaatctccagcatggccggcttccctctcctcctcaccctcctcactcactgtgcagggtcctgggcccagtctgtgctgactcagccaccctcagcgtctgggacccccgggnagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtcgggctccggtccgaagatgagggtgactattactgtgcagcttagggatgagagccgtgagaggttggcgtggttcgggcggagggaccaagctgaccgtcgtaggcacgccgaaggcctcgcccctcggcctactcgtcgttcccgccctcctcgngtccg

SEQ ID NO: 186969 - DNA, 574 bp, Homo sapiens
  misc_feature: GYAE6OF01COHMM.40.87.H10.1.454.CMB.1.raw
  modified_base (565)..(565): a, c, t, g, unknown or other
  misc_feature (565)..(565): n is a, c, g, or t
tcagtctagcgactcacgaccggtgctcgatttagcagtactgcgttgggtttggggggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatttctgttctggaagcaactccaatatcggaactaattatgtatactggtaccagcagctcccaggaacggccccaaagtcctcttctataggaataatcaaccggccctcgacggggtccctgaccgattctctgcctcaagtctggccacctctgtcgtccctggccatcagtcgggcctcccgggtccgaagatggagggtgacttattactgtgcagtcgttgggatggagagccgtgagtaggttggcgttggttacgggcgggacggggaccaaggcgtcgaccgtccgtaggtccacgcccgaaggtcctcgcccccgtcggtccacttccgttccgttccccacccttccncgtcgtccg

SEQ ID NO: 186970 - DNA, 763 bp, Homo sapiens
  misc_feature: GYAE6OF01DXRCZ.40.87.H10.1.454.CMB.1.raw
  modified_base (174)..(174): a, c, t, g, unknown or other
  misc_feature (174)..(174): n is a, c, g, or t
tcagtctagcgactcacgaccggtgctcgatttagcagtactgcgttgggtttggggggtagagaagacaggattcaggacaatctccagcatggccggcttccctctcctcctcaccctcctcactcactgtgcagggtcctgggcccagtctgtgctgactcagccaccctnagcgtctcgggacccccgggcagaggtcacctatttctgttctggaagcaactccaatatcggaaactaattactgtatactggtaccagcagctcccaggaaccggccccaaagtcctcttctataggtaataactcaacggccctacgacggggtccctgaccgtattctctcgcctctaagtctggctacctctgtcgtccctggtcctactcgacgtcgggtccgttcccgggtacgtaacgagttcggtaaggggttacgtaacgttaacttttacgttacggttcgtacgtaaggtccgtttaggggtagttacggtaaacgggtacggtcccggtttaggaacgggttacgggtttagggtccgtttaacggggttttccggggacggggtaaccgggggtaacccggtaaacgggttcccggttacggtacccgggttaacccggttaacggggtacccgtaaaccggacccggtaaaccgggttcccggtacccggtacccccggttcccggggttaccctacccgttccgtttcccggttaccccccgtcccgtttaccccgtcgtaccgttaacccgg

SEQ ID NO: 186971 - DNA, 796 bp, Homo sapiens
  misc_feature: GYAE6OF01CXPL0.40.87.H10.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
tcagtctagcgactcacgaccggtgctcgatttagcagtactgcggttgggtttggggggtagagaagacaggattcaggacaatctccagcatggccggcttccctctcctcctcaccctcctcactcactgtgcagggtcctgggcccagtctgtgctgactcagccaccctcagcgtcgtcgggacccccgggnagacgggtcacctatttcttgtctggaancaactccaatactacggaactaattatgtactacgtcggtaccagcacgcctacccgaacggaacccggaccccctaaaagtcctcttactactaggaacttaactccgaaccggccctcggtacggggtccctaggacccgtacttctctcgtcccttacgaacgttccgtcggcctaccttcgtcgttcgtacccgtggtccctaagtccgagggtccgggtaccttccccgggtaccgtaaaggtacggtagggtaacgggttcgtaaccgtttaacgtttacgtacgggtcgtacggtacgttacggttcggggtagtacgggaacggtacggtacccgtttagggaacgggttaggggtttcgggtacggtttacggggttacccgggggacggggtaaccggggaccgtaaaccgggtccgtttacccgggtacccgtttaccggtaacgggtaccacccgggacccgaacgggtccccgttacccgtaccccccggtttcggtcccgttaccgttcccgttacccgttacccccaccccgtttcccgtaccgtcgtacccggg

SEQ ID NO: 186972 - DNA, 734 bp, Homo sapiens
  misc_feature: GYAE6OF01BNPGG.40.87.H10.1.454.CMB.1.raw
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
tcagtctagcgactcacgaccggtgctcgatttagcagtactgcgttgggtttggggggtagagaagacaggattcaggacaatctccagcatggccggcttccctctcctcctcaccctcctcactcactgtgcagggtcctgggcccagtctgtgctgactcagcccaccctcagcgtcgtcgggacccccgggnagagggtcacctattttcttgttctggaancaacctccaatatacggtaaacttaattatgtaattactcggtaccagcagcctacccgaacgggaacccggacccccaaagttcccttacgttactaagtaacggtaaattaactaccgaaccggtccctacggtacgggggttcccctaggacccgtatttcctcgtcgtcccctacgtaacgttcgttacggcctacccgttgtcggttcgtccccgtaggccctagttcgtacgggtcgggcccgttacccggggtacgaaagtacggttgggtacggggtacgtaacgtttactttacgttggtgtacgtacggtcggtttacgggagttaggaacgtacgtaccgtaggtacgggtagggttcggtcggttcgggttcgggcgggtacgggacgtacggcgtaccgtaccgtccgtacgtacgaccgtccgaacggtccgtcccggtccccgtcggtcctccgtcccgttccgttccccgtccccttcgtccgtcgtccgg

SEQ ID NO: 186973 - DNA, 884 bp, Homo sapiens
  misc_feature: GYAE6OF01AZ1GT.40.87.H10.1.454.CMB.1.raw
  modified_base (193)..(193): a, c, t, g, unknown or other
  misc_feature (193)..(193): n is a, c, g, or t
  modified_base (260)..(260): a, c, t, g, unknown or other
  misc_feature (260)..(260): n is a, c, g, or t
tcagtctagcgactcacgaccggtgctcgatttagcagtactgcgttgggtttggggggtagagaagacaggattcaggacaatctccagcatggccggcttccctctcctcctcaccctcctcactcactgtgcagggtcctgggcccagtctgtgctgactcagccaccctcagcgtctcgggaccccggnagagggtcaccatttcttgttctggagcaactccaatactacggaactaattatgtactactgtacngcagcctacccgaaggaaccgaccccaaagtccctcttactataacggtaataactaccgaaccggtccctacggacggggttaccctacggtaacccggtactttccgtcctacgtacccctaccgtaacgttcctacgggtaccctacccttccgttacgttccgttccccgtgggtaccctaacgtccgtaagggttccgggtccgttcccggggttaccgaaaggtaacgtacgggtacggggttacgtaaccgttaagtttaccgtaggtacggcgtaacggtcggtttagggtaagtacggaacggtacggtacccggtagggtaacgggtttacgggtttaacggggtcggtttcggggttacccggggggaacggggtaaccgggggtaaaccccggtaagggtcccggttaaccgggttaacccgggttacccgttaacggggtacccctaaccggggtaacccccgggtaaaccggggttcccgttaaccccgggtccccccccgggttaacgggttaccccccgttaaaccggtttaccccggtttcccccggtttaacccccccctacccccggttttaccccgtaaccggggtttccccggtaaccccggg

SEQ ID NO: 186974 - DNA, 812 bp, Homo sapiens
  misc_feature: GYAE6OF01BKBNG.40.87.H10.1.454.CMB.1.raw
tcagtctagcgactcacgaccggtgctcgatttagcagtactgcgttgggtttggggggtagagaagacaggattcaggacaatctccagcatggccggcttccctctcctcctcaccctcctcactcactgtgcagggtcctgggcccagtctgtgctgactcagccaccctcagcgtctcgggacccccgggcaggagggtcacctattttcttgttctggaagcaactccaatagtcgaactaattatgtatactgtaccagcagcctccgaggaaccgccccaaagtcctcttactagtaggaataactcgaaccggcctcgacgggtccctgaccgattccactcgcctaccgaagtcctcggccaccttcgtcgttccgtcccgtggccctagttcgacgggtcgggtcccgttccgggtaccgaagtacgtcggggtaagggtacgtaacgttacgttaacgttgggtcgtacggtaacggttcgtttaacggggacttagggaacggtcggttacccgttagggtaaacggggtttagggggtttaccggtcgggtttacgggggttaccccggggaacggggggtaaccggggtaaccccgtaaaggggtccccgtttaaccgggaaccccccgggtttccgggttaaaccggggttacccgaaacccggggtaacccccggtaaacgggggtccccgtttaccccccggacccccccgggtttcgggtaccccttaacccgtttccccgtttcccccggttaccccccgtccccctttacccgttccgccgggtttaccccg

SEQ ID NO: 186975 - DNA, 734 bp, Homo sapiens
  misc_feature: GYAE6OF01AL007.40.87.H10.1.454.CMB.1.raw
  modified_base (174)..(174): a, c, t, g, unknown or other
  misc_feature (174)..(174): n is a, c, g, or t
  modified_base (261)..(261): a, c, t, g, unknown or other
  misc_feature (261)..(261): n is a, c, g, or t
tcagtctagcgactcacgaccggtgctcgatttagcagtactgcgttgggtttggggggtagagaagacaggattcaggacaatctccagcatggccggcttccctctcctcctcaccctcctcactcactgtgcagggtcctgggcccagtctgtgctgactcagccaccctnagcgtctcgggacccccgggcagagggtcaccatttctgttctggaagcaactccaatatcggaactaattatgtatactggtaccngcagcctccgaggaaccggccccaaagtcctacttctataggtaaatataccaacggccctcgaggggttcccctaggacccgtattcctcgtcgtccctccgaacgttcctcggtcctacccgttcgtcggtttccgtccccgttgggacccctacgtccgtaacgggttcggggcccttaccccggggttacccgaaaggttacgtacggggtacgggttacgtaacgttaacgtttaccgtgggtcgacgtacggtcgtttaggggattaggaggtacgtccgtagggtacggtacgggttcgggtcgttgggttaccggggcgggtaacgggacccgtaaggtccgtacggtacccggtccgtagggtccgacggacccggtacggtcccgtacccggccccgtaccgggtaccctaccgttcccgttaccggttacccccctacccgttcccctccggtccgttccgg

SEQ ID NO: 186976 - DNA, 741 bp, Homo sapiens
  misc_feature: GYAE6OF01DC0KE.40.87.H10.1.454.CMB.1.raw
  modified_base (196)..(196): a, c, t, g, unknown or other
  misc_feature (196)..(196): n is a, c, g, or t
  modified_base (373)..(373): a, c, t, g, unknown or other
  misc_feature (373)..(373): n is a, c, g, or t
tcagtctagcgactcacgaccggtgctcgatttagcagtactgcgttgggtttggggggtagagaagacaggattcaggacaatctccagcatggccggcttccctctcctcctcaccctcctcactcactgtgcagggtcctgggcccagtctgtgctgactcagccaccctcagcgtcgtcgggacccccgggnaggagggtccacctattttcttgttctggaagcaacctccaaatacgtacggtaacttaattatgtaatacgtgtaccagcacgtcctcccgaacgggaccgaccctaagttcctacttactaagtaggaaacttacacgaaccgtccctacggaccgggttccctaggaacccttnttcctcgtacgtccctaccgaagttccgtacgcctacttcgtgtccgtcccgttggacctagtacgtggtacggtccgtaccggtaccgaaaggtcgttaagggtacgggtactaagttacttacgtggtcgtacgtaggttcggttacgggaagttcggacgtacgtacggtagggacgttaggggttcggtcggtttaggggtaccggggtacgggtaacgggtacccgtaacgggttccgtaccggtacccgttccgtaacggtccggaaccgtaccgggaaccgtcccgtacccgggttccccctcgggtacttacccgttccgttcccggtaaccccctcccgtccctaacgtccggtacccg

SEQ ID NO: 186977 - DNA, 810 bp, Homo sapiens
  misc_feature: GYAE6OF01DCFHY.40.87.H10.1.454.CMB.1.raw
  modified_base (503)..(503): a, c, t, g, unknown or other
  misc_feature (503)..(503): n is a, c, g, or t
tcagtctagcgactcacgaccggtgctcgatttagcagtactgcgttgggtttggggggtagagaagacaggattcaggacaatctccagcatggccggcttccctctcctcctcaccctcctcactcactgtgcagggtcctgggcccagtctgtgctgactcagccaccctcagcgtcgtcgggacccccgggcagacgggtcaccgtatttctgttctggaagcaactccaatatcggaactaattatgtatacgtcggtaccagcagcctaccgagggaacccggacccctaaacgtcctcttacttataaggaattaactccgaaccggccctacggacggggtcccctaggacccgtatttccgtactcgtacccgtaccgtaacggttccgtcgggtacctaccgtttcgttcggttaccgtccccgttgggccctagttccggacggttccgggtccgtacccgggttcggaaaggtacgttagggacgggttanacgtttacgttacgttcggtacggtacgaacgttcggttacggggtattacgggaacggtacgtaccggttagggtacgggtttacggggttcgggtacgttcggggtttaccggggaccggggtacggggtaacccgtacggtccgttaccgggttacccggttacgtaccgggttaaccgacccgggtacccggtaacgggccccgttacccgggtccccccggttacggttaccccgttacccgttcccggtttacccggttccccccgtccccgtttacccgtccgttcccgggttaacccgg

SEQ ID NO: 186978 - DNA, 714 bp, Homo sapiens
  misc_feature: GYAE6OF01BX5D5.40.87.H10.1.454.CMB.1.raw
  modified_base (196)..(196): a, c, t, g, unknown or other
  misc_feature (196)..(196): n is a, c, g, or t
  modified_base (238)..(238): a, c, t, g, unknown or other
  misc_feature (238)..(238): n is a, c, g, or t
tcagtctagcgactcacgaccggtgctcgatttagcagtactgcgttgggtttggggggtagagaagacaggattcaggacaatctccagcatggccggcttccctctcctcctcaccctcctcactcactgtgcagggtcctgggcccagtctgtgctgactcagccaccctcagcgtcgtcgggacccccgggnagagggtcacctatttcttgttctggaagcaactccaattancggaactaattatgtatactggtaccagcacgctcccaaggaccgaccccaagtcctcttcatagaataactcaccggcctcggacgggtccctgaccgtattcctctcgtcctaccaagttcctcggcctaccttcgtcgtccgtccccgtggcctactcgagggtccgggtccttacccgggtacgaaagtcgtacgggtacggggttctaaccttaagtttaccgtgggtccgtacgtacggtcgttagggaataggtacgacggtaccgtgggaacggttcgggttcggtcgttcgggtcgggacgggtacgggaccgtacggtcgtaccggacccgttaccggtaggtacccgacggtaccccggtaacgggtcccgttaaccccggtccccccggttacggaccccttacccgtttacccggttcccggttacccccccgtaccctttccccgtacgtccgggttacccg

SEQ ID NO: 186979 - DNA, 834 bp, Homo sapiens
  misc_feature: GYAE6OF01AB9IX.40.87.H10.1.454.CMB.1.raw
tcagtctagcgactcacgaccggtgctcgatttagcagtactgcgttgggtttggggggtagagaagacaggattcaggacaatctccagcatggccggcttccctctcctcctcaccctcctcactcactgtgcagggtcctgggcccagtctgtgctgactcacgccaccctcgagcgtcgtcggggacccccgggcaggacggtcacctattttcgttgttcgtaggaacgcaacctccaatactacggaactattatgtatacgtggtaccagcacgcctacccgaacgggaaccccgacccctaaacgttcccttacttactaagtaaggtaaactaactaccgaaaccggtccctacggtaccggggttcccctacggaacccgttactttcccgtacgttccgaccccttacccgtaaggttccgtcggaccctacccgttcttcggttacccgttccccgtcggccctacgtccggtacgggttccgggtccccggtttacccggggtaacccgaaagggtcggttacggggtaacgggttactaaccgttttagttaccggtggttacgtaccggtacggttacggttagggaacggttacgaacggtcgtaccgtgggtaacgttcggggttccgtcggttcggggtacggggtaccgggaacgggtaacctacgggttccgtaccgggttacccggtaacgtccggaccgaacccggacggttacccggccgttacccccggtccccggttcgaaccctttacccggttcccctttaccccggttaccccctacccggtttcccgtcgtacccggttacccgg

SEQ ID NO: 186980 - DNA, 860 bp, Homo sapiens
  misc_feature: GYAE6OF01C3UQE.40.87.H10.1.454.CMB.1.raw
  modified_base (782)..(782): a, c, t, g, unknown or other
  misc_feature (782)..(782): n is a, c, g, or t
tcagtctagcgactcacgaccggtgctcgatttagcagtactgcggttgggtttggggggtagagaagacaggattcaggacaatctccagcatggccggccttccctctcctcctcaccctcctcactcactgtgcagggtccgtcgggcccagtctgtgctgactcacgccaccctcgagtccgtcggtccggggaccccccgggagacggacgggtccaccttacgttttcttcggttacctagggaacgacctaaaccgtacctaaagtacgtaaccggtaaaacttaagtttagtagttaattaccggtacggtaccgagtaccgacgtacctaccccggaacgggaaccccggtaacccccctaaaacggttccctttacgttaacgttaacggtaacggtaaacttaacgtaaccggaaacccggtaccctcgggtaacccggggttaccctacggtacccgtttattccgtaccgtccgtaccctaaccgtacgtcgtccgtaccctacgttccgttcggttcccgtcccgtcgtacctacgttcggtacgggtccgggtacccgttaccggtaccggaagtaggtacgggtacgggtacgtaaccgtttagttcgtaggtacggacgtacgggtcggtgggtagtacggaacggtcgtaccggtaaggtagggtttacgggttcgggtaccggttagggttaccggggacggtaccgggtactacggtccgtacgtaccgtcggtacgtacgcccggtaccggtacggtcccnccggttccccgtaggttaccccttcccggttcccttaccccggttaccccctcccgttacctcccggtcggttacccg

SEQ ID NO: 186981 - DNA, 815 bp, Homo sapiens
  misc_feature: GYAE6OF01DCHOA.40.87.H10.1.454.CMB.1.raw
  modified_base (106)..(106): a, c, t, g, unknown or other
  misc_feature (106)..(106): n is a, c, g, or t
  modified_base (194)..(194): a, c, t, g, unknown or other
  misc_feature (194)..(194): n is a, c, g, or t
  modified_base (210)..(210): a, c, t, g, unknown or other
  misc_feature (210)..(210): n is a, c, g, or t
  modified_base (231)..(231): a, c, t, g, unknown or other
  misc_feature (231)..(231): n is a, c, g, or t
  modified_base (615)..(615): a, c, t, g, unknown or other
  misc_feature (615)..(615): n is a, c, g, or t
  modified_base (723)..(723): a, c, t, g, unknown or other
  misc_feature (723)..(723): n is a, c, g, or t
  modified_base (799)..(799): a, c, t, g, unknown or other
  misc_feature (799)..(799): n is a, c, g, or t
  modified_base (805)..(805): a, c, t, g, unknown or other
  misc_feature (805)..(805): n is a, c, g, or t
tcagtctagcgactcacgaccggtgctcgatttagcagtactgcgttgggtttggggggtagagaagacaggattcaggacaatctccagcatggccggcttcccnctcctcctcaccctctcactcactgtgcgaggtcctcggcccagtctgtgctgactcacgccacctcagcgtcgtccgggaccccggngaggacggtcaacctntttcgttcgttcgtaggaacnccaacctacctaatagtacggaaacttaagttatagtactacgttacggacagacgacgtcccgaacccggacggaaaccccggaccccgtaaaagttcccttacgttacgttaaacgtaacggtaaattaaaccgtacccggtaaccggtcccccgttaagggtacccgggttacccgtacggaaccgttttccttccggttcctaaccggtccccttaaccgaaggttcccggaacggtccctaacccgttacgtgggtttcccgtaccccggtacgtacccgtaacgtccggtaacggggttccgggtcccgttaacccgggtaacggtaaagggtccggttagggtagttaccgttaaacgttcgttaacgtgtaaccgngttacgtccgggtttagacgtaggtaacggtcgtaacggttcggttaaggtcgggtttgggtacggtttccggggtacgggaccgggtaacggtaccgtacggttacncccggttacgacggtacgtacgacccggtacgaccggtcccgtccgtacccggctacgccgttaccgtccgacccncccgtnaccgtgtacg

SEQ ID NO: 186982 - DNA, 885 bp, Homo sapiens
  misc_feature: GYAE6OF01DFGU5.40.87.H10.1.454.CMB.1.raw
  modified_base (201)..(201): a, c, t, g, unknown or other
  misc_feature (201)..(201): n is a, c, g, or t
tcagtctagcgactcacgaccggtgctcgatttagcagtactgcgtttgggtttggggggtagagaagacaggattcaggacaatctccagcatggccgcttccctctcctcctcaccctcctcactcactgtgcgagggtcctcggcccagtctgtgctgactcacgcccaccctcagccgtcgtccggggacccccggngaggacggtccaccttattttcgttgttcgtaggaacgactaacctctaatacgtacggaaacttaattatgtataccgttaggaccagcacgacctacccgaacggaacccggaccctaacgttcctacgttacgtaagtaagaaactaacgtccgaaaccggtccctacggaccgggttacccacggtacgttactcttacgtcgtaccctaccgaagttcacggtaccctaccgtttcgtccggttccgacccgttcggtaccctaacggtcggttacgggtccggtcccggttaacccggtaacggtaagtacgggttcgggtaacggggttaacttaacgttagtttaccggttcggtacgtaacggttcgggttaacggttgggtacgtagggtaccggtaacgtaccggttaagggacgggtttacgggtttacgggtcgggtttacccgggggtcggggtaaccggggtaacgggtaaccccggtaagggtccggttaacccgggttaccgggtacccggttaccgggttacccggaccccgggttaaaccggggtacccggtaccccgttaaccccgggtttcccccggttaccggttaacccccgttcggtttaccccccgttcccggtttacccccttaccccgtacccgtttcccgggtacggtttacccgg

SEQ ID NO: 186983 - DNA, 855 bp, Homo sapiens
  misc_feature: GYAE6OF01A0YAD.40.87.H10.1.454.CMB.1.raw
  modified_base (197)..(197): a, c, t, g, unknown or other
  misc_feature (197)..(197): n is a, c, g, or t
tcagtctagcgactcacgaccggtgctcgatttagcagtactgcgttggggtttggggggtagagaagacaggattcaggacaatctccagcatggccggcttccctctcctctcaccctcctcactcactgtgcagggtcctgggcccagtctgtgctgactcagcccaccctcagcgtcgtcggggacccccggnaggagggtccaaccgtattttcttgttccgtagggaaagcctaaaccttccgaaattacgtaccggtaaacttaatttagtagttaactaccgttaggtaccaggctaagcctacccgaaggaacccggcccccctaaaaggttccctacgtttacctaagtaaggtaaacttaaaccgtccgaaacccggtccccttcgtaaccgggggttcccctaggaacccggtattttcccgtacgtccggtacccctacccgtaaaggttccgttcggcctacccttgtcgtaccgtcccgtaggccctaagttccgaagggttccgggccgtttaccccgggtaccgtaaaggtgttcggggtaacgggttcgtaaaccttagtttaaccgtggtacgtaccgtagggttcgttacggggtatacgggtacgtacgttcccgttagggtaaggttcggggttccgggttcgttacggggtttacccggggacggggtaaccgggggtaaccgtaacgttccgggtaaccgggtacccgttaccggtacgggtaccggaccggtaccccgtaaacgggtcctacccccggtaccccgttcggtcccctaaccggttcccgtcccgtttaccccctacccttcccgttccgtcggttacccgg

SEQ ID NO: 186984 - DNA, 870 bp, Homo sapiens
  misc_feature: GYAE6OF01C4GOV.40.87.H10.1.454.CMB.1.raw
  modified_base (205)..(205): a, c, t, g, unknown or other
  misc_feature (205)..(205): n is a, c, g, or t
  modified_base (510)..(510): a, c, t, g, unknown or other
  misc_feature (510)..(510): n is a, c, g, or t
tcagtctagcgactcacgaccggtgctcgatttagcagtactgcgttgggtttgggggtagagaagacaggattcaggacaatctccagcatggccgcttcctctcctcctcaccctcctcactcactgtgcgagggtccgtgggacccagtctgtgctgaactcacgcccacccgtcagccggttaccgccggggacccccggnacgggacgggtaccaccttcttttccgttgttcgtaaggaacgcctaaaccttaccgtaaagttacgtaccggtaaattaagtttacgttaggttaactacgtcggtaaccagcccacggtacctacccggaacggaaccccggtacccctaaaacgttccttccttaagtaagtaacggaaattaaacgtccgaaacccggcctacggtaccggggtccctacgaccgttaacttcgtcctcgaccccttaccaaggttcgacggtccttaccgtcgttacgtcccgttacccgtggtaacccngtaccgtagggtccggtcggtccccggagtaaaggcgttagggtagggttactaacgttacgttactaggtcggtacgtaggttcgggttaaggacgtagggtaacgacgggttccgtaagggttagggtagggtttccggttacgggtttccgggtaacggggtaccgggaacggggttaacccgagggtacccggttacccggtaccgggtacccggttaaggacccggaaccggtaaccccggtacgggggtacccccttccccggttacccccgggttcaacccccgggtttaccttccccggttttaaccccttccccgtaccccgtttacccgttaccggttcccggtaacccg

SEQ ID NO: 186985 - DNA, 684 bp, Homo sapiens
  misc_feature: GYAE6OF01D2SAK.40.87.H10.1.454.CMB.1.raw
  modified_base (248)..(248): a, c, t, g, unknown or other
  misc_feature (248)..(248): n is a, c, g, or t
tcagtctagcgactcacgaccggtgctcgatttagcagtactgcgttgggtttgggggtagagaagacaggattcaggacaatctccagcatggccggcttccctctcctcctcacccctcctcactcactgtgcagggtcctgggcccagtctgtgctgactcagccaccctcagcgtctcgggacccccggagagggtcacctatttcttgttctggaagcaactccaatatcggaaacttaattntgtatacgtcggtaccagcagcctcccgaaggaaccgcccccaaagtcctcttctataaggaataatcaaccggccctcgacggggtccctgaccgattctctcgcctcaagttctcggcctacctctcgtcgtccctcggcctatcgaggtcgggccttccggtaccgaaagtacgtgggacgggttacgtacgttagtttacgtggtcgacgtaaggttcggttagggtacttaggtacggtacgtccgtaggaacgggttagggtttcgggtcgtttcgggttccgggacgggtacgggaccgaagtcggtacgtacccggttacgtacgggtccaccgggccctaacggtccgttcccggtaccccgttcggtccctaccgttcccgttcccggttacccccgccccttaccccggtgttcccggtaaccgg

SEQ ID NO: 186986 - DNA, 1149 bp, Homo sapiens
  misc_feature: GYAE6OF01CQW40.40.87.H10.1.454.CMB.1.raw
tcagtctagcgactcacgaccggtgctcgatttagcagtactgcgtttgggtttggggggtagagaagacaggattcaggacaatctccagcatggccgccttccctctcctcctcaccctcctcactcactcgtgcgacgggtcctcggcccagtctggtgctcgacctcgacgcccaccctcacgcgtccgtaccggggcccccggacacggtacgggtcctaaccttattttcgttcggttaccgtagggtaaactacctaaaccttacccaaattacgttaacggtaaaacttaaagtttagttagtaacgttaacgtacgggttaacccaggacctacggtacccgtaccccgggaacggtaaacccccgggacccccgttaaaaccgttaccctttccgtttaaccttaaaggttaaaccgggaaactttaaacccgtcccgggtaaaacccccgggttaccccgttaccggggaaaccccggggtttacccccgtaaccggttacccggtttactttcccttaacccggtttaccctaccccggttttaacccgtaaacgggttcccggttacccgggtaccctttaacccggttccgtttagggttcccccggttacccggtttacccgggaccttaacggttccggtaccgggggttacccgggtcccgttaaccccggggtttaacgaaacggttacgggtttacgggggaaccggttccggttaaaccgtttaacgtttaccggttcggttacggttaccggtaacgggtttacgggtttaaccgggtaacgtaccgggtaaacggttaaccggtaaccgggtttacgggtagggggtttaccggggtttagggttacccggggttttaacggggttacccgggggtaccgggggaaaccgggttaccccgaacgggttttacccggtaccccgggttacccgtaacccgggttaccggtaaccggtaacccccgggtacccgggtaaacccgggtcccccgttttaccccccgggaaccccccggggttttcccgttaacccccgggttcccccgttttaccccgggttacccccgtttcccccccgggttacccccgtttttaccccggcccgggtttaaacccggttaccccggg

SEQ ID NO: 186987 - DNA, 761 bp, Homo sapiens
  misc_feature: GYAE6OF01DSA9D.40.87.H10.1.454.CMB.1.raw
  modified_base (196)..(196): a, c, t, g, unknown or other
  misc_feature (196)..(196): n is a, c, g, or t
tcagtctagcgactcacgaccggtgctcgatttagcagtactgcgttgggtttggggggtagagaagacaggattcaggacaatctccagcatggccggcttcctctcctcctcaccctcctcactcactgtgcgagggtccgtcgggcccagtctgtgctgactcagccacctcagcgtcgtccgggaccccggnaggacgggtccacctattttcgttagttcgtaggaacacctaactccaatacgtacgtaacttattattagtatacgtagtacagtcacgcctaccgaacggacccgaccccaagttccttcttactaagtaacggaacttaacgtaccgaacccggtaccctacgggtaccggggttcccctacggtacccgtactttccgttacgtcggtacccctacaacgttcgtcggacctccgtccgttgttccgtccctaggtcctacgtccgtaggtccggtccgtccggtacgaaagtcggtaggtacggtatacgttaatttcggcgtcgtacgtagtaccggtttagggattagggacgtcgtacgttagggtaacggcgggtttacggtcggttcgggacggggtagggaaccgggtaacgtacgtccgggtacgtaaccccggtaggttaccggaccctacgggtaaccccgacgggtcccgttaaccccggtcccggtttaccccgactcccgttttccggttacccccgccgttccccttaacgtccggtacccgttacg

SEQ ID NO: 186988 - DNA, 541 bp, Homo sapiens
  misc_feature: GYAE6OF02IQ1BV.40.87.H10.1.454.CMB.1.raw
  modified_base (193)..(193): a, c, t, g, unknown or other
  misc_feature (193)..(193): n is a, c, g, or t
tcagtctagcgactcacgaccggtgctcgatttagcagtactgcgttgggtttgggggtagagaagacaggattcaggacaatctccagcatggccggcttccctctcctcctcaccctcctcactcactgtgcagggtcctgggcccagtctgtgctgactcagccaccctcagcgtctgggacccccgggnagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtggctccggtccgaagctgagggtgactattactgtgcagtcttgggatgagagcctgagtaggtggctggttcggcggagggaccaagctaggaccgtctaggtcacgcccgaaggcctcgccccctcggtccaccgtctcgttccccaccctcctcacgtcg

SEQ ID NO: 186989 - DNA, 514 bp, Homo sapiens
  misc_feature: GYAE6OF02IKLB3.40.87.H10.1.454.CMB.1.raw
  modified_base (449)..(449): a, c, t, g, unknown or other
  misc_feature (449)..(449): n is a, c, g, or t
  modified_base (491)..(491): a, c, t, g, unknown or other
  misc_feature (491)..(491): n is a, c, g, or t
  modified_base (502)..(502): a, c, t, g, unknown or other
  misc_feature (502)..(502): n is a, c, g, or t
  modified_base (509)..(509): a, c, t, g, unknown or other
  misc_feature (509)..(509): n is a, c, g, or t
tcagtctagcgactcacgaccggtgctcgatttagcagtactgcgttgggtttgggggtagagaagacaggattcaggacaatctccagcatggccggcttccctctcctcctcaccctcctcactcactgtgcagggtcctgggcccagtctgtgctgactcagccaccctcagcgtctcggggacccccgggcagagggtcaccatttcttgttctggaagcaactccaatatcggaactaattatgtatactgtaccagcagctccaggaacggcccccaaagtcctcttctataggataatcaacggcctcagggtccctgaccgattctctgcctcaagtctggcactctgtgtccctggccatcagtggctccggtccgaagatggaggtcgactattactgtgcagcgttggatgagagcctgagaggttggcttggtcggnggaggcagctgaccgtcagtcagccgaggctcgcccctcgcnctctcgtcccncctctcngtccg

SEQ ID NO: 186990 - DNA, 678 bp, Homo sapiens
  misc_feature: GYAE6OF02FWA70.40.87.H10.1.454.CMB.1.raw
  modified_base (177)..(177): a, c, t, g, unknown or other
  misc_feature (177)..(177): n is a, c, g, or t
  modified_base (198)..(198): a, c, t, g, unknown or other
  misc_feature (198)..(198): n is a, c, g, or t
  modified_base (227)..(227): a, c, t, g, unknown or other
  misc_feature (227)..(227): n is a, c, g, or t
tcagtctagcgactcacgaccggtgctcgatttagcagtactgcgttggggtttggggggtagagaagacaggattcaggacaatctccagccatggccggcttcccttctcctcctcaccctcctcactcactgtgcagggtcctgggcccagtctgtgctgactcagccaccctnagcgtctcgggacccccgggngagagggtcaccatttcttgttctggaancaactccaatatcggaactaattatgtatactggtaccagcagctccgaggaaccgccccaaagtcctcttctatagaataatcaacggccctcgacggggtccctaggaccgtattcctcgtcgtccctaccaagtcctggaccacctcgtcgtcgtcccgtggccctatcgtaggtcgggccttcccgggtaccgaagtacgtggagggtcaacgttattacgtggtgcgaggtcgtttgggatggtaagtagtccgtggaggtagggtttcggcgttaggttacggggacgggtaaccggggtacctaacggtccgttacggtacccggttccgtaacgggttccacggtacccgaagggtcccttacccggtaccccccgttacggtccctaccgttccgttacccggtttacccccaccccgttcccgttaccgacggttacccgg

SEQ ID NO: 186991 - DNA, 634 bp, Homo sapiens
  misc_feature: GYAE6OF02GXAD2.40.87.H10.1.454.CMB.1.raw
  modified_base (199)..(199): a, c, t, g, unknown or other
  misc_feature (199)..(199): n is a, c, g, or t
  modified_base (231)..(231): a, c, t, g, unknown or other
  misc_feature (231)..(231): n is a, c, g, or t
tcagtctagcgactcacgaccggtgctcgatttagcagtactgcgttgggtttggggggtagagaagacaggattcaggacaatctccagcatggccggcttccctctcctcctcaccctcctcactcactgtgcagggtcctgggcccagtctgtgctgactcagcccaccctcagcgtcgtcggggaccccccgggnaggacgggtcacctattttcttgttctggaancaactccaatatcggaactaattatgtatacgtggtaccagcagcctccgaggaaccggacccccaaagtcctcttactatagaatatacaacggccatcgacgggtccctgaccgattctctcgccctaccaagtctcggcctacctctcgtcgtccctgcctagtcaggtcgggcctccggtaccgaagtacgtgggagggttcgaacttacgtttacgtggttcgacgtaggtccgttgggattggagcgcgtaggaggtgggttcggcgttgggtcgggacgggtacgggaccaagtcggtacgtacccgtgtacggtacgacgtacccgaaggtccctccggcccccgttgtacctacccgttccgttcccttcccccgacccgttccctaccgtcgg

SEQ ID NO: 186992 - DNA, 777 bp, Homo sapiens
  misc_feature: GYAE6OF02GMYDZ.40.87.H10.1.454.CMB.1.raw
  modified_base (197)..(197): a, c, t, g, unknown or other
  misc_feature (197)..(197): n is a, c, g, or t
tcagtctagcgactcacgaccggtgctcgatttagcagtactgcgttgggtttggggggtagagaaggacaggattcaggacaatctcagcatggccggcttccctctcctcctcaccctcctcactcactgtgcagggtcctgggcccagtctggtgctgactcagcccaccctcagcgtctcgggacccccgggnaggagggtcacctatttcgttgttcctgggaacgccaactccaaatacgtacggaaacttaattatggtatacgtggtaaccagcagcctacccgaggaaccggacccccaaaagtcccgttcttcgtataacggaattaactccgaaccggtccctacgtacggggtccctgaccgtattccgtctcgcccttaccaagtcgtcggcctacctgtcgttcgtcccgtggaccctagtccgagggttcggccgttcccgggtacccgaagtacgtagggtagggttacgactttaagttaacgttggtcgacgtaaggtcggttttacggggattgggtaacggttacgttaccgttaggtaagggttacgggtttagggccggtttacgggtttccggggaaccggggtaacggggtaacccgtaaacgggtccgttaccgggtaaacccggttccgtttaacggggaaccggaccggtaacccggaacggggtacccttcccgggtaccccccggttaggttacccgtaccgtttaccgttccggttccccctacccgtcccgttaccgcgttacccg

SEQ ID NO: 186993 - DNA, 869 bp, Homo sapiens
  misc_feature: GYAE6OF02JSVL8.40.87.H10.1.454.CMB.1.raw
  modified_base (204)..(204): a, c, t, g, unknown or other
  misc_feature (204)..(204): n is a, c, g, or t
tcagtctagcgactcacgaccggtgctcgatttagcagtactgcgttgggtttggggggtaggaggaaggacgagggattcgaggacgaatctccagcatggccggcttcctctcctcctcaccctcctcactcactgtgcagggtcctgggcccagtctagtgctgactcgagccaccctcagcgtacgtcgggacccccggnaggacgggtccacctagtttcttcgttctagggaagtcaacgttccaaagtgtacggaaaacttaagttatcgtaataacgtaggtaacctagactaacgtccttacccgaagggtaaaccgggaccccctaaaagttccccgttacgtttaaccgtaacgtaacgggtaaacttaaacgttccgaaaccggcccttaacgaccgggggtaccctacggtaccggaactttcgtaccgtacggttacctacccgtaaggtcccttagggtcctaaccgttcgtcggttccgttccccgtacggggtcctaacgtccgtacgggttccgggtccgtacccgggttaccgaaggtacgtttacggggacgggttacgtaccttacgttaacgtgggtaacgtcggtaccgtggtttaggggactgggtaacgtacgggcgttacgaacgggttcggtttaggggacccgtttagggttccgggggacgggttaaaccggggaccgttaaacgggtccggttaccggtaaccgttacccggggttaaggccgttaccgacccgggttaacggcccggtttcccggaccccgggtttacggtaccgtaaccggtttccggttccgggttccccccggcccttaaaccggttcccggttaaccgcccggg

SEQ ID NO: 186994 - DNA, 824 bp, Homo sapiens
  misc_feature: GYAE6OF02JHA74.40.87.H10.1.454.CMB.1.raw
tcagtctagcgactcacgaccggtgctcgatttagcagtactgcgttgggtttggggggtagagaagacaggattcaggacaatctccagcatggccggcttccctctcctcctcaccctcctcactcactgtgcagggtcctgggcccagtctgtgctgactcagccaccctcagcgtctgggacccccgggcagacgggtcacctattttcttgttctggaagcaactccaatatcggaactaattatgtatactgtacagcagctccaggacgaccccaagtcctcttactataggaataataccaacggtccctacgacggggttccctacggaccgtatttcctcgtcgtccctaccgaagttccgttcggaccttaacccgttctcggttacgtccccgtgggtacccagttaccgtaacggttccggggaccgttccccgggttaaccgaaggtaacgttacgggaacggggtttacgtaaccgtttaactttaacggtggttacggtccgtaacgttcgggtttagggaacttgggaacggtaacgacccgttgggtaaacggttcgggtttacggtccgtttgggttaccggggaccgggggtaacggggaaacccgtaagggttcccgtttaaccgggtaaccccggtttaccggtaaccggggttaccgacccgggtaaccccgggtaaccggttaccccggttaccccgggtacccccggtttaccgggtaacccgttcccgttaccccgttttcccgggtttaaccccccctaccccgttttcccccggttaacgttcccggttacccggg

SEQ ID NO: 186995 - DNA, 765 bp, Homo sapiens
  misc_feature: GYAE6OF02FF1YL.40.87.H10.1.454.CMB.1.raw
  modified_base (194)..(194): a, c, t, g, unknown or other
  misc_feature (194)..(194): n is a, c, g, or t
  modified_base (230)..(230): a, c, t, g, unknown or other
  misc_feature (230)..(230): n is a, c, g, or t
tcagtctagcgactcacgaccggtgctcgatttagcagtactgcgttgggtttggggggtagagaagacaggattcaggacaatctccagcatggccggcttccctctcctcctcaccctcctcactcactgtgcagggtcctggcccagtctgtgctgactcagccaccctcagcgtctgggaccccccgggnagacgggtccaccacttttcgttcgttcctggaacnccgaacctccaatctccgggaactacttactcgtataccgtggtacccagccagcctcccaggaaccgcccccgtaaaagtccctcttcctatacggaacttaacgtccaaacgggtcccttacgagggggttaccctaggacccgtactttcctctacggcccctaccgaaacggttcctcgggcctacccttctcggttcgtccccgtagggccctaagtccaagggttccgggggacccttcccggggtacccgaaactcgtacgggtacggggttccgtaacttactttaaccgtggttccgcgtacgtccgttagggacgttacggacgacggtacccgtgacggtacggtttcgggtacgttcgttaccgggacgggtaacggaacccgtaaagtcccggtactacccggtcgttaccgggtaccaccgtccccgtaacgggtcccgttcccggtccccccgttcggtccctaacccgttcccgttaccggttaccccccacccgtaccccgttccgtacggttcccgg

SEQ ID NO: 186996 - DNA, 828 bp, Homo sapiens
  misc_feature: GYAE6OF02GULRG.40.87.H10.1.454.CMB.1.raw
  modified_base (201)..(201): a, c, t, g, unknown or other
  misc_feature (201)..(201): n is a, c, g, or t
tcagtctagcgactcacgaccggtgctcgatttagcagtactgcgttgggtttggggggtagagaagacaggattcaggacaatctccagcatggccgcttccctctcctcctcaccctcctcactcactgtgcagggtcctgggcccagtctgtgctcgactcacgccctaccctcgagccgtcgtcggggacccccggntaggacgggtaccacctatttcttgttctggaacgccaaacctcaatagtacgaactaattgtcgtaactacgtagtaccaggcacgtcctacccgaaggaaccccggtaccccctaaaaggttccccttacgtttacgtaactaacgggtaaaataaaccgtaccgaaaaccccgggtccccttaggaacccgggggtttcccctacggggtaaacccctacgttttcccgttaccgtcccggttaccttccccgtaaaggttcccgttacgggacccttaacctttcggtaacggtttccccttccggcgggtaaccctaggttaccgtaagggttcccgggtccgtacccgggtacggaagtaccgtagggagggtttacgaactttacgttaagtcggtagcggtaacgtcgggtttaggcgttaggacgtacggttctagggtggtaagtttcgggcgtttaggggtccgggaacgggtacgggaaacgtaccgtacgttaaccggtccgttacggtacgttaccgtacccgggacctaacggtccgtaccccgtcccggttaccggttaccctccggtaccgtttcccgtaccccggtccccttacgtccggtactcccgg

SEQ ID NO: 186997 - DNA, 757 bp, Homo sapiens
  misc_feature: GYAE6OF02FHZNL.40.87.H10.1.454.CMB.1.raw
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
  modified_base (383)..(383): a, c, t, g, unknown or other
  misc_feature (383)..(383): n is a, c, g, or t
tcagtctagcgactcacgaccggtgctcgatttagcagtactgcgttgggtttgggggggtagagaagacaggattcaggacaatctccagcatggccggcttccctctcctcctcaccctcctcactcactgtgcagggtcctgggcccagtctgtgctgactcagccaccctcagcgtctcgggacccccggnagagggtcaccntttcttgttctggaagcaactccaaatactacggaacttaagttatagtatacctggtaaccagcacgcctccgaacggaaccggtacccccctaaaggttcccctacttacctagtacggtaaataacgtacgaaccggcctacggtacggggtccctacgaccgtagttttccncttcgccctaccgtaaggttcctcgggtacctaccgttcgttcgtacgttcccgtacgggacctacgtcgtacggtcggggtcccttcccggggaccgttaaagccgtgggtacggggttactacgtttaagttacgtttcggtacgtaccgttacggttcggttaggggaatacggtaggaccgttaccggtgggaacgggttacggggttcggttacgggttcgggtccggggtacggggaccgggtaacgaacgtaccgtccgtaccggtacgtacgggccgtacgccggtaacgtcccggtacccgccccgttccggtaccgtacgttcccgttcccgttaccccctacccgtttccgtccggaccgttc

SEQ ID NO: 186998 - DNA, 558 bp, Homo sapiens
  misc_feature: GYAE6OF01CEOPH.35.28.C06.1.454.CMB.1.raw
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtggttataattctgtctcatggtaccaacaatacccaggcagacgcccccaaactcatgatttttgagtcagtaagcggcctcaggggtccctgatcgcttctctggctccaagtctgacacacggcctcccttaccgtctctggctccagactgagatgaggctgattatactgcagctcatatgcaggcagactaaccgtttgtagttttcggacggtagggactaagttcgaccgtaccgtaacgtcacgacccgaaggcctcgcccccgtcggtccactccgttccgttccccgccccttccctccgaccgcttccgtacgttacctggacggcgggctcgggacaagggcgcgagtacg

SEQ ID NO: 186999 - DNA, 536 bp, Homo sapiens
  misc_feature: GYAE6OF01CUWXC.35.28.C06.1.454.CMB.1.raw
  modified_base (230)..(230): a, c, t, g, unknown or other
  misc_feature (230)..(230): n is a, c, g, or t
  modified_base (334)..(334): a, c, t, g, unknown or other
  misc_feature (334)..(334): n is a, c, g, or t
  modified_base (520)..(520): a, c, t, g, unknown or other
  misc_feature (520)..(520): n is a, c, g, or t
tcagtacagatcgtcacgaccggtgctcgatttagagctcacgtattgggtttggggggggtctcaggaggcagcgctctcaggacgtcaccaccatggcctgggctctgctcctcctcaccctcctcactcagggcacagggtcctgggcccagtctgtcctgactcagcctccctccgcgtccgggtctcctggacagtcagtcaccatctcctgcactggaaccaanaatgacgttggtgttataattctgtctcatggtaccaacaatacccaggcagacgcccccaaactcatgtatttttgagtcagtaagcggcctcacgggtcccngatcgcttctctggctcaagtctgacaacgacgcctccctaccgtctctcgggctccagactgagatgaggctgtattattactgcagctcatatgcagcagactaacgttgtacgttttcggacggtacggactaaggttcgaccgtaccgtaacgtcacgcccaaggcctcgtcccctcggtcncctcgtccgttccccg

SEQ ID NO: 187000 - DNA, 514 bp, Homo sapiens
  misc_feature: GYAE6OF01AR4ZU.35.28.C06.1.454.CMB.1.raw
  modified_base (483)..(483): a, c, t, g, unknown or other
  misc_feature (483)..(483): n is a, c, g, or t
  modified_base (509)..(510): a, c, t, g, unknown or other
  misc_feature (509)..(510): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtggttataattctgtctcatggtaccaacaatacccaggcagacgcccccaaactcatgatttttgaggtcagtaagcggccctcaggggtccctgatcgcttctctggctccagtctgacacacggcctcccttaccgtctctggctccagactgaggatgagctgattattactgcagctcatatgcaggcagctaacgtttgtacgtttcggcggtacgggacctaagttcgaccgtctaagtcacgccaagctcgcccctgtcactctcgtcccgcctctcacgntctgtactgacgcggcgtggcaggcnngtcg

SEQ ID NO: 187001 - DNA, 550 bp, Homo sapiens
  misc_feature: GYAE6OF01CQF9D.35.28.C06.1.454.CMB.1.raw
  modified_base (391)..(391): a, c, t, g, unknown or other
  misc_feature (391)..(391): n is a, c, g, or t
  modified_base (417)..(417): a, c, t, g, unknown or other
  misc_feature (417)..(417): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtggttataattctgtctcatggtaccaacaatacccaggcagacgcccccaaactcatgatttttgaggtcagtaagcggcctcgaggggtccctgactcgcttctcgtcggctccaagtctgaacaacgacggcctcccttaccgtctcgtggctccagactgagatgaggctgtattattactgacagctcatangcaggcagctaacgtttgtattcggnggaggactagtcgaccgtctaagtcacgccaagcctccgccccgtgtccacttcgtccgtcccgtccctccgtcacgtctccgtgtaacgtcggaccggtcgggtccgtacgggacgaacggcgacgtacgtg

SEQ ID NO: 187002 - DNA, 591 bp, Homo sapiens
  misc_feature: GYAE6OF01ATTJT.35.28.C06.1.454.CMB.1.raw
  modified_base (223)..(223): a, c, t, g, unknown or other
  misc_feature (223)..(223): n is a, c, g, or t
  modified_base (256)..(256): a, c, t, g, unknown or other
  misc_feature (256)..(256): n is a, c, g, or t
  modified_base (293)..(293): a, c, t, g, unknown or other
  misc_feature (293)..(293): n is a, c, g, or t
  modified_base (314)..(314): a, c, t, g, unknown or other
  misc_feature (314)..(314): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtgctgataactatgtctcctggtaccaanaccaccaggcaaagcccccaaatcatgatttangatgtcagtaatcggcctcagggtttcaatcgcttcnctggctcaagtctggctaacncggcctcctgacctatctacgtgggcctcgagctagacgacgagctagattatacgtgcagtctcatactgcgacgtcacgtacctaacggtttgtaacgttttccgggacggtacggtaacctaaggttcgacccgtaccgttaacgtcgaacgtacccgaaggtccgtaccgtcccccgtaggttccaccgtcgttacccgtaccctacccttcccttacgacgtattccgtgtaccgtggaaccggtcggacttcgggacctaaggccgtaacg

SEQ ID NO: 187003 - DNA, 659 bp, Homo sapiens
  misc_feature: GYAE6OF01CXWYK.35.28.C06.1.454.CMB.1.raw
  modified_base (363)..(363): a, c, t, g, unknown or other
  misc_feature (363)..(363): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtgttataattctgtctcatcggtaaccaacaatacccaggcagacgaccccaaatcatgattttgagtcagtaagcggcctcgaggggtcccagactcgtcttctcgtggcctccaagtctagacaacaccggtcctacccttacgtctcgtcggctccagactgaggntggagctagattatactgcagctacgatagtcgacgaggaccgtagtaccgttaaacggttttggtaacgttttccggggaacgggtaacgggtaacccgttaagggttacccgtacccggttaaccgtttaaacgccgtaaccggaccccgtaaacgggtcccgttaccgtccccccggttaggtaccctaaccgtttccctccggtttaccccctaacccttcccgacctaaccgtacttcgtacgttacgtcggacggtccgggtacgtacggacgaagggccacgtagtacg

SEQ ID NO: 187004 - DNA, 250 bp, Homo sapiens
  misc_feature: GYAE6OF01BR2V7.35.28.C06.1.454.CMB.1.raw
  modified_base (246)..(250): a, c, t, g, unknown or other
  misc_feature (246)..(250): n is a, c, g, or t
tcagtacagatcgtcacgaccggtgctcgatttagagctcacgtattgggtttgggggtttggtggtctccactcccgccttgacgaggctgattattattgttgctcatatgcaggtagtagcactaatgtcttcggaactgggaccaaggtcaccgtcctaggtcagcccaaggccaaccccactgtcactctgttcccaccctcctcacgatctgtactgagcgggctggcaaggcgcatagnnnnn

SEQ ID NO: 187005 - DNA, 533 bp, Homo sapiens
  misc_feature: GYAE6OF01APTFQ.35.28.C06.1.454.CMB.1.raw
  modified_base (528)..(529): a, c, t, g, unknown or other
  misc_feature (528)..(529): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtggttataattctgtctcatggtaccaacaatacccaggcagagcccccaaactcatgatttttgaggtcagtaagcggccctcgaggggtccctgatcgcttctctggctccaagtctgacaacacggcctcccttaccgtctctgggctccagctgagatgaggctgattattactgcagctcatatgcaggcagctaaccgtttgtacgtttcggcggagggaccaagttcgaccgtcctaagtcacgcccaaggcctcgcccccgtcggtccactcctcgttccccgcctcctccacgtctctgtactgacgcgggctcggcaaggccgnngtag

SEQ ID NO: 187006 - DNA, 675 bp, Homo sapiens
  misc_feature: GYAE6OF01CQIYQ.35.28.C06.1.454.CMB.1.raw
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
  modified_base (383)..(383): a, c, t, g, unknown or other
  misc_feature (383)..(383): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctccctccgcggtccgggtctcctggacagtcagtcaccatctcctgcactaggaaccaacaatgacgttggtgttataattctgtctcatacggtaaccaaacaaactacccgaggacagaacgccccaaatcatgtatttgagtcagtaagcggacctgacgggtccngactcgctttcnctggctacaagtcagaaccaacaccggtcctccttaccgtctcgtcggcctccgaagtcctaggagaactggacggntagtaattacttaactgctaatctactaatacgtgagaggacacgaccgttaaccggtttagtaacggttttaccggggaacgggtaacggggtaaccgtaagggttacgtaccgttaccgtaacgtacgtaccgacccgaacggtacccgtacccgtcccccgttacggtacccgttaaccgttccgtcccgttacccctaaccccgttccctaccgtaaccggtacttacgttacggttaacgtcggaacgggtccggacggtcgggaacgaacgggacgagaacgtagg

SEQ ID NO: 187007 - DNA, 609 bp, Homo sapiens
  misc_feature: GYAE6OF01AEZYR.35.28.C06.1.454.CMB.1.raw
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtggttataattctgtctcatggtaccaacaatacccaggcagacgcccccaaactcatgtattttgaggtcagtagccggccctcgacgggtccctgatcgcttctctggcctccaagtctgaacaacctacgtccctcccttaccgtctcgtggcctccagacgtggaggatggacggtctgtatttacttactgcagtcctactatagtcgcgaggccaacgtccgtaaccggtttgtacgtttcgggacgggacgggtacctaaggttcgaccgtaccgtaacgtcacgacccaacgaccgtccgtccccgtcggtcctaccttccgtccgttccccgtcccctcctccgtaccgtcgttccgttagtaccgtggaccggtcggccgtacgggacgacgggccgtcgagtcg

SEQ ID NO: 187008 - DNA, 579 bp, Homo sapiens
  misc_feature: GYAE6OF01EUSJJ.35.28.C06.1.454.CMB.1.raw
  modified_base (249)..(249): a, c, t, g, unknown or other
  misc_feature (249)..(249): n is a, c, g, or t
  modified_base (445)..(445): a, c, t, g, unknown or other
  misc_feature (445)..(445): n is a, c, g, or t
tcagtacagatcgtcacgaccggtgctcgatttagagctcacgtattgggtttggggggggtctcaggaggcagcgctctcaggacgtcaccaccatggcctgggctctgctcctcctcaccctcctcactcagggcacagggtcctgggcccagtctgtcctgactcagcctccctccgcgtccgggtctcctggacagtcagtcaccatctcctgcactggaaccagcagtgacgttgggaatttangactatgtctctggtaccaacttcacccagacacacgtaccccaaaaccatgatctaacaatgtacaatattccggccctcgaggacgtaccctaattcgtttcctcgtgtcctacctaagtctggtctagtcgccggtccttccggtcgtccctattcctcgtcggtacctccgagggtctaggaacgggacggnggcttagaactttagttggagtctgtacttagtataagagactagtcgacctacttctaagttagtagttcgggacggacggaccagtcgtcgacccggtacaggtcacggaccaaggtctccgccccgttcgg

SEQ ID NO: 187009 - DNA, 531 bp, Homo sapiens
  misc_feature: GYAE6OF01EUORX.35.28.C06.1.454.CMB.1.raw
  modified_base (526)..(527): a, c, t, g, unknown or other
  misc_feature (526)..(527): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtggttataattctgtctcatggtaccaacaatacccaggcagacgcccccaaactcatgatttttgaggtcagtaagcggccctcaggggtccctgatcgcttctctggctccaagtctgacaacacggcctcccttaccgtctctcgggctccagactgaggatgaggctgattatactgcagctcatatgcaggcagctaaccgtttgagttttcggcggagggaccaaggttcgaccgttcctaagtcacgcccgaaggcctcgccccctcggtcctactctcgttccccacctcctcacgtctctgtactgacgcggctggcaaggcnngtag

SEQ ID NO: 187010 - DNA, 673 bp, Homo sapiens
  misc_feature: GYAE6OF01CZYJF.35.28.C06.1.454.CMB.1.raw
tcagtacagatcgtcacgaccggtgctcgatttagagctcacgtattggggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtggttataattctgtctcatcggtaccaacaactacccaggcagacgaccccaactcatgtattttgagtacagtaagccggcctcgacggggtccctgactcgtcttctcgtcggctaccgaagtctacgaaccaaccgaccggtccctacccttaccgtcgtcgtcggcctccgagtacctggaggtatggaggtctagtaattacgttactgacacgtctacagtgtacgaccgaggtactacgtacgttaacggtttcgtacggtttaccgggacgggtacggtaaccgtaacggttaccgaccgttaacctaaggtccacggtaccgacggtccgtaccgtcccgttaccccgtcgtaccgttaccgttccgttccccggttcccctccccgttaccctaccgtaacgttcgttaccggttacgttacggaccggcgggtaccgtacgggtacggacgtaacggcgtacgagg

SEQ ID NO: 187011 - DNA, 741 bp, Homo sapiens
  misc_feature: GYAE6OF01DE3YA.35.28.C06.1.454.CMB.1.raw
  modified_base (737)..(737): a, c, t, g, unknown or other
  misc_feature (737)..(737): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactacggaaccaacaatgacgttggtggttactaattctgtctcatggtaccaaacaactaccgaggcacgacgcccccaaatcatcgtattttgaggtcagtagcgcctgacgggtccctgactcgcttcgtcgtcggcctaccgaagttctacgaaccaaccgtaccggtccccttacccgttaccgttcgtccggttcgggccttacccgaagtccgttaggaagggtattaggaggtcctaggttaactttaatttaccgtgacctagtaccttacaagttacgtgaccgaggaccgaacgtaccgttaaaccggtttacggttaacggttttaccggggaacgggtaaccgggtaaccgtaaacgggtttaccgaacccggtttaaccgttaacgggtaccgaaccggtacccgaacgggtccctacccggtacccccgttacgggtacccttaaccgttccggtttaccgtccccccgtacccttcccgtacccgtaccgttccgtacggtccgtacggtacggccgggtccgtacgggcgtaacgggccgacgtaacgnggtc

SEQ ID NO: 187012 - DNA, 780 bp, Homo sapiens
  misc_feature: GYAE6OF01CXLO3.35.28.C06.1.454.CMB.1.raw
  modified_base (224)..(224): a, c, t, g, unknown or other
  misc_feature (224)..(224): n is a, c, g, or t
  modified_base (258)..(258): a, c, t, g, unknown or other
  misc_feature (258)..(258): n is a, c, g, or t
  modified_base (272)..(272): a, c, t, g, unknown or other
  misc_feature (272)..(272): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcgatcaccatctcctgcactggaaccagcagcgattggttggggttatgaccttgtctcctgtatcaacngcaccaggacaaacgccccaaatcatgtatttangatgtacagtaacnccggccctcgaggggtccctgatcgcttctctgcctacagtctacgacaacaccggtcccttaccccttaccgtctcgtcgggcctaccgagtaccgtggaggtatggacggtcttagtaacttttaacgttacgtggacgtagtaccgttactaacgtttagtacgtaccgtacgggacctaacggtaacccgttaaacccggttttagtaccgggttttaccgggtttacccgggggaaccgggtaaaccgggtaaccggtttaaccggttacccggtaaacccggtttaacgtaaacccgggtaccgtaaccccggtaaccccgggtaaccgttcccggtacccccccgttccccggtaccggttaccccttaccccggttcccggtttacccccccgttccccttccccgttaacccgtacccggttaaccttccgttaccgttaccgtacgggttacgggtacccggggtaccggttcggggaaccggtaaccgggtaaccgg

SEQ ID NO: 187013 - DNA, 593 bp, Homo sapiens
  misc_feature: GYAE6OF01BKAJA.35.28.C06.1.454.CMB.1.raw
tcagtacagatcgtcacgaccggtgctcgatttagagctcacgtattgggtttgggggctctgctcctcctcaccctcctcactcagggcacagggtcctgggcccagtctgtcctgactcagcctccctccgcggtccgggtctcctggacagtcagtcaccatctcctgcactggaaccaacaatgacgttggtggttataattctgtctcatggtaccaacaatacccaggcagacgacccccaaatcatgtatttttgagtcagtaagcgcctgaggggtccctgactcgctttctctaggctccaagtctagacaacgaccggtccctcccttacgtctacgtcgggctccagcgtggaggactggacgtctagtattatacgtgcagctacatatgcgaggcacgtaccgttaaacggtttcgtagttttccgggacggtaacgggaaccgtaaggttccgaccgttaccgtaggacaccggaccgaaggtccgtacccgccccgttcgtaccacgttcctccgtccccaccctcctcgaccgtctcgtagtactcggacgcggcgttcggacgaaggctgagtacg

SEQ ID NO: 187014 - DNA, 582 bp, Homo sapiens
  misc_feature: GYAE6OF01AMWM6.35.28.C06.1.454.CMB.1.raw
  modified_base (382)..(382): a, c, t, g, unknown or other
  misc_feature (382)..(382): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtggttatattctgtctcatggtaccaacaactacccaggcagacgacccccaaactcatgtatttttgaggtcagtaagcggccctgacgggtccctgatcgcttctcgtggcctcaagtctcgacacgcgtccctcccttacgtctctggcctaccagcgtgaggatggacgctagatttatctgcngtctactatatcgacgagctacgtaccgtaacgtttgtacgtttcgggacgggacggtacctaggttcgaccgtacctaagtcgacgccgaaggtcctccggccccgttcggtcctaccgttcccgtccgttccccctccctccctacgaccgtagtccttagtaccgtcggcgggcggtcgtcggacgaggcacgagtg

SEQ ID NO: 187015 - DNA, 614 bp, Homo sapiens
  misc_feature: GYAE6OF01BVXAJ.35.28.C06.1.454.CMB.1.raw
  modified_base (605)..(605): a, c, t, g, unknown or other
  misc_feature (605)..(605): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtgttataattctgtctcatgtaccaacaactacccaggcacgacgacccccaaactcatgtattttgaggtcagtaacgcggccctcgacggggtccctgatcgtcttctctggcctaccaagtctacgaacaaccgaccggtccctaccccttaccgtcctccgtcgggccttccacgtactcggaggtagtggaggtctagatttactactgacagtctacatagtcgacgagacacgtacgtaacgtttgtagtttcgggacggacggactagtcgtaccgtactaacgtcgacgtaccgaacggtcctccggtcccctcggtcctaccgttcctacccgttcccctaccctccgtaccaccgtacgtccgtagtacgtcggacggtcggccgtcggaccgacggccngtacgtacg

SEQ ID NO: 187016 - DNA, 595 bp, Homo sapiens
  misc_feature: GYAE6OF01CUPRD.35.28.C06.1.454.CMB.1.raw
  modified_base (326)..(326): a, c, t, g, unknown or other
  misc_feature (326)..(326): n is a, c, g, or t
  modified_base (376)..(376): a, c, t, g, unknown or other
  misc_feature (376)..(376): n is a, c, g, or t
  modified_base (392)..(392): a, c, t, g, unknown or other
  misc_feature (392)..(392): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtggttataattctgtctcatggtaaccaacaatacccaggcagacgaccccaaactcatgtatttttgagtcagtaagcgcctcgacggggtccctgactcgtcttctctggctaccaagtctagacaaccncggcctccctacgtctcgtcggctcagactgaggatgagctgtatatacngcagctacatatcganacggacacgacgtaacgtttcgtagtttacgggacgggacggtacgaaggttcgaccgtactaacgacgtacgaccgtaacggccgtccgtccccgtcgtcctaccttcgtccgttccccgcccttcctaccgtacgtacgtcctagtacggtacggacggtccggtacgtacgggtaacaacgggtccgaacgtacgtaacg

SEQ ID NO: 187017 - DNA, 710 bp, Homo sapiens
  misc_feature: GYAE6OF01C7GM2.35.28.C06.1.454.CMB.1.raw
  modified_base (134)..(134): a, c, t, g, unknown or other
  misc_feature (134)..(134): n is a, c, g, or t
  modified_base (157)..(157): a, c, t, g, unknown or other
  misc_feature (157)..(157): n is a, c, g, or t
  modified_base (224)..(224): a, c, t, g, unknown or other
  misc_feature (224)..(224): n is a, c, g, or t
  modified_base (336)..(336): a, c, t, g, unknown or other
  misc_feature (336)..(336): n is a, c, g, or t
  modified_base (471)..(471): a, c, t, g, unknown or other
  misc_feature (471)..(471): n is a, c, g, or t
  modified_base (511)..(511): a, c, t, g, unknown or other
  misc_feature (511)..(511): n is a, c, g, or t
  modified_base (608)..(608): a, c, t, g, unknown or other
  misc_feature (608)..(608): n is a, c, g, or t
  modified_base (623)..(623): a, c, t, g, unknown or other
  misc_feature (623)..(623): n is a, c, g, or t
tcagtacagatcgtcacgaccggtgctcgatttagagctcacgtattggggtttgggggctctgctcctcctcaccctcctcactcagggcacagggtcctgggcccagcctgtgctgactcgacgccaccctnagcgtcgtcggggacccccgggnaggacgggtccacctatccttcgttgttacgtagggaagcgtagttacccaaactagtacgggaaancctaaagttaccgtaggtaaaaccgtcgggtaacccgacctaaccgttccgaacggggaaacccggacccccctaaaattcctactaacgtttaacgagttcgtaaataacncgaacggtccggccctaggcggggttccctggtaccgtacttcgtacgtcggcctaccgaaggttccgcggttaccaccctccgaccgtccctccgtcggacctactcgaacgtcgggaccctcgtacgttacgnggtaaacggcttagggagtctagtaacttagtacgttcgngccgaagtcgtatcgggacacgtagactacgtcgtcggtcgttacggttggttcgggtggtcggacgggtagaccgagtctccgcgtaccgcgtacnccgacgtcggtaccnccgtacccgcgtcaccgttcgtccgtcccctccttccgccgtacgtcttcggctacggtcggcgggtaccgtggacggcgtacgtcg

SEQ ID NO: 187018 - DNA, 628 bp, Homo sapiens
  misc_feature: GYAE6OF01BN9YQ.35.28.C06.1.454.CMB.1.raw
  modified_base (253)..(253): a, c, t, g, unknown or other
  misc_feature (253)..(253): n is a, c, g, or t
  modified_base (305)..(305): a, c, t, g, unknown or other
  misc_feature (305)..(305): n is a, c, g, or t
tcagtacagatcgtcacgaccggtgctcgatttagagctcacgtattgggtttgggggctctgctcctcctcaccctcctcactcagggcacagggtcctgggcccagtctgccctgattcagcctccctccgtgtccggtctccgtggacagtcagtcaccatctcctgcactggaacctgcagtgagttggttaggaattatgacttatcgtctcgtacgtacctacttcaccagacacacgtacccaacntcatcactatgtactaatcgtccgcctagacggtacctcctattccgtttcnctcggacctacgagttcgtacggtctagtcgccgtcctccgtacgccctattcgtcgtacgtactcgacgtcgtaggacggacgtagtctagtacgtttaggtcggatcgttagttacttaataagtagacgtacgtagtccgtaccgtacgttacgtaacgtagtacggtcggacggaacgtcaggtctacggtaccgtcgtacggactaccggacgtacggtccgtacccgtcccgtgtacctccgttcgttacccgtcccctacccgttacccgtccgtacgtccgtacgttacgcgggtaacgccggtagtcggaccgg

SEQ ID NO: 187019 - DNA, 696 bp, Homo sapiens
  misc_feature: GYAE6OF01BIHO6.35.28.C06.1.454.CMB.1.raw
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtggttataattctgtctcatggtaccaacaactacccaggcagacgcccccaaatcatgtattttgagtcagtaacgcggcctcgaggggtccctgactcgcttctcgtggctccgaagttccgtagaacaaccgaccggtcccttaccccgttaccgtctcgtcggcctccgagactggagatgaggctgtaattatactgactagtctactatagtcgacgtaggacgtacgtaccgttaaccgtttaggttacgttttcggggacgggtaacgggtaaccgttaacggttaccggtaacccgttaccgttaacggtacccgaaccggtaccccgtaacggtcccgttaccccggacccccccggttacgggttaccctacccgtttacccgtccccgttaccccctacccctcccgtacccgttaaccgtaccgttccgttaccggtacgttcgggacgggtcccgggacgtcgggacctaagggccgtcgtaggtacg

SEQ ID NO: 187020 - DNA, 726 bp, Homo sapiens
  misc_feature: GYAE6OF01BEFK3.35.28.C06.1.454.CMB.1.raw
  modified_base (306)..(306): a, c, t, g, unknown or other
  misc_feature (306)..(306): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagccctccctccgcggtccgggtctcctggacagtcagtcaccatctcctgcactggaaaccaacgaatgtacggttggtggttaataattcgtgtctactagtacgtaaccaaacaactaccgagcagaccgaccccaactcatagtattttgagtacagtaacgccgcctcggacgggtcccngactcgtcttcgtcgtgactccgagtccgtagaaccaacgtacccggtacccttaccccgttaccgtctccggtcggtacctaccgacgtacgtaggagtagtcggaggtcttagtactttaacgtactcgacgtacgtactaactagttacgagaccgtaacgggacctaacggtaacgtttaacggtttaggttaaccgggttacgggaacgggtaacggggtaaccttaacggtaccggtaacccgttacgttaacgaccgtaaccgggtaccacggtcccgtacccccggtccccgttaaccggtcttaccgtcccctttacccgaacccccttacctacccgttacgaaccgttctccgttaggtaccggtcgggacccggcgggtctaccgggactaccgggctacgtagtacg

SEQ ID NO: 187021 - DNA, 720 bp, Homo sapiens
  misc_feature: GYAE6OF01AZ5ZB.35.28.C06.1.454.CMB.1.raw
  modified_base (211)..(211): a, c, t, g, unknown or other
  misc_feature (211)..(211): n is a, c, g, or t
  modified_base (358)..(358): a, c, t, g, unknown or other
  misc_feature (358)..(358): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtccaccatcctcctgcactggaaccaacaatgacgttggtgttatattctgtcncatgtaccaacaatacccaggcagacgacccccaaactcatcgtagtttttgagtccaagtaacgcggccctgtacggggtttctaattcgtcttctccgtaggtcctacctaacgtcgttcggacaaccgaccgggcccttccccncgtacctacttctaccgtcgggcctaccgcggtacgtcggaacgacggaggcttcggtaatttacttactgtcaacgtctacaagttaactaccaaaccgacgacgactacgacccttattacgggtccggttacggggtcccgggaagggaaccctaacgtcgtaccgtaacccggtccgtacgtaccgacccggtaaccgaacggtcctaccccgggcccctttacgggaccctaccctttaccggtcccctttacccccaacccccttccccgttacgtaacccctacggttacctcggtaccgttacgggaacccgggttcgggaacctaggggtaacccggaaggtcccgtaacggg

SEQ ID NO: 187022 - DNA, 664 bp, Homo sapiens
  misc_feature: GYAE6OF01C9WW7.35.28.C06.1.454.CMB.1.raw
tcagtacagatcgtcacgaccggtgctcgatttagagctcacgtattgggtttgggggctctgctcctcctcaccctcctcactcagggcacagggtcctggcccagtctgtcctgactcagcctccctccgcgtccgggtctaccgtggacagtcagtcaccatctcctgcactgaaccacatgacgttgtgttatatctgtctcatcggtacaacaactacccgaggcagaccgaccccaagtcatgtattttgaggtcagtaacgccgacctcgacgggtccagacgtcgtcttctcgtggcctcgagttcacgaccaaccgaccggtccttacccgttaccgtcgtccgtacgggtccctaccgacgtacgtcggaggtacgtcggaacggtcttacgtaatttacgtacgtcggacctagtccttacgtagttacgtacgaccgacggtactacggttacccttaacggtttgtacggtttaccgggacgggttaaccggtacttaacggtaccgtacccgtacgtaacgcgtaccgacccggaagtccccgtaccggtccccgtggacccttactacgttacccgtaccctccccgttcgtaccacggtactaccgttgtacgtcggacgcggtacgtcggactacggcgtatcggac

SEQ ID NO: 187023 - DNA, 795 bp, Homo sapiens
  misc_feature: GYAE6OF01CG0YS.35.28.C06.1.454.CMB.1.raw
  modified_base (284)..(284): a, c, t, g, unknown or other
  misc_feature (284)..(284): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctgcctccgtgtctgggtctcctggacagtcgatcaccatctcctgcactaggaaccagcaggtgacggttggtgctagactaactatcgttcctccgtacggtaacccaaccaacccacccgacggaccaaaccgacccccaaactcatagtactttangtaatcgtactaacgttaccgtccgtaccgttacggttacgggtttcctaagtccgttcctttccgtcgttcgtacccgtaccgaaggttccgacggaccaacccgcccggtcccctcccgacgtaacctacttccgtcgtaccggccctaacggcggtacgtaccggaccgggaacggtcggtacgttaacgttaatttaacgttcgtacgaccgtacgtacctaacgtaaccttaaaccgtacccaaacgacgactaacgtaccgtacccgtttacggttccgggttaccgggtcggggaacccgggtaaacggaaccggtaacgtccggtaacccgtacccggttacggtaccgggtaccgacccgggttacccgtaaccgggtccctaccccggttccccggtaccgttacccttacccgttcccccgttcccgttacccccctacccctttccgaaccttaccggtacctttcgtaccgggttagccgggtaggcccggggttacg

SEQ ID NO: 187024 - DNA, 691 bp, Homo sapiens
  misc_feature: GYAE6OF01BAR77.35.28.C06.1.454.CMB.1.raw
  modified_base (212)..(212): a, c, t, g, unknown or other
  misc_feature (212)..(212): n is a, c, g, or t
  modified_base (453)..(453): a, c, t, g, unknown or other
  misc_feature (453)..(453): n is a, c, g, or t
  modified_base (675)..(675): a, c, t, g, unknown or other
  misc_feature (675)..(675): n is a, c, g, or t
  modified_base (685)..(685): a, c, t, g, unknown or other
  misc_feature (685)..(685): n is a, c, g, or t
tcagtacagatcgtcacgaccggtgctcgatttagagctcacgtattggggtttgggggctctgctcctcctcaccctcctcactcagggcacagggtcctgggcccagtctgtcctgactcagcctccctccgcgtccgggtctcctggacagtcagtcacctatctccgtgcactggaaccaacaatgacgttggtgttatattctgtcnatggtaccaaacaactacccaggcagaccgtacccccaaactcaatgttatttttggacggtacaggttaacgccggcccttcggacggggttccctagacgtcggtcttcgtctcggcctaccaagtctagaacaccgaccggtccctacccttaccgtcttcgtcggtctaccgagacgtgagtatacgggagtcttaagtatttacgtacgtcgacgtacgcttacgaatttacgcgngtaaccggacgacggtaccgtttaacggtttaggtacgttcggggacgggtaacggtaccgttaacggttacgacccggttactaacgtcgaacccggtacctacgggtcccttcccggtacccgttccgtaactcctttccgtacccgtcccctacgttccctacgaccggttctccgttacggtacgcgggtccgtacgggtacgtcgggtacgaccggntaacccggtntaccgg

SEQ ID NO: 187025 - DNA, 853 bp, Homo sapiens
  misc_feature: GYAE6OF01DQ9KP.35.28.C06.1.454.CMB.1.raw
tcagtacagatcgtcacgaccggtgctcgatttagagctcacgtattggggtttgggggggggtctcaggaggcagcgctctcaggacgtcaccaccatggcctgggctctgctcctcctccaccctcctcactcgagggcacgacgggtcctcgggcccagtctgtcctgactcacgcctcccgtccgcggtcccgggtctccgtggacacgtcacgtcaccatcctcctcgacaaccgtacggaaaccaacgtaaacgtcggtacggtttgggtacggtttaaattaacttccgttcgtacctaccgtaacgttaccggttaaacccaaacctaaaccgtaacccggtaacggaaccgtaacggaaccccgtaaccccctaaaactcctaacgttacggttttacgtttttacggacggttacgaacgggtaacggcccggtacccgtcggtaaccggggttccctacggtacctccggtcttccgtactcggacctaccgtaacgtctacgaactaccgtacccggttccctacccgttaccgtctccggtaccggctaccgaacgacgtggaacggtagtacggtacgggtctagttaactttacgtacgtcgacgtacgtctatacgtatcggacgacgtaccgtaacggtaccgtttaacgtttaggttacccgggttacgggaccggggtaaacggtacccggttaaacggttacccggtaacccgtttaccgtaaaccgggtaaccctaaccggggtaccccggtaacgggtccccgttacccccggttacccccgggtacgttaccccgttacccggtttccccggttccccgttacccccccg

SEQ ID NO: 187026 - DNA, 515 bp, Homo sapiens
  misc_feature: GYAE6OF02G2HLW.35.28.C06.1.454.CMB.1.raw
  modified_base (323)..(323): a, c, t, g, unknown or other
  misc_feature (323)..(323): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
  modified_base (452)..(452): a, c, t, g, unknown or other
  misc_feature (452)..(452): n is a, c, g, or t
tcagtacagatcgtcacgaccggtgctcgatttagagctcacgtattgggtttgggggggtctcaggaggcagcgctctcaggacgtcaccaccatggcctgggctctgctcctcctcaccctcctcactcagggcacagggtcctgggcccagtctgtcctgactcagcctccctccgcgtccgggtctcctggacagtcagtcaccatctcctgcactggaacctgcagtgatgttgggaattatgactatgtctcctggtaccaacttcacccagacacagtccccaaaccatgatctacaatgtcaatattcggccctnaggagtccctaatcgttctctgctcaagtctggctatgcgcctccgtgcccatctctggactccaggctgaggcgaggctgattagtgganctgcttanatagaagcagttgcctacttcaacgtttanagttcggcggagggacccaagtctagacccgttctaggtccagcccaaggcctcggtcccccg

SEQ ID NO: 187027 - DNA, 801 bp, Homo sapiens
  misc_feature: GYAE6OF02ILXUH.35.28.C06.1.454.CMB.1.raw
  modified_base (331)..(331): a, c, t, g, unknown or other
  misc_feature (331)..(331): n is a, c, g, or t
tcagtacagatcgtcacgaccggtgctcgatttagagctcacgtattgggtttgggggctctgctcctcctcaccctcctcgactcagggcacagggtcctgggcccagtctgtcctgactccagcctccctccgtggtctgggtctcctgggaccagtcgatccaccatctcctgcactggaaccagcgagtgacgttggtggttataactatgtctcctggtaccaacaccacccgaggcaaagccccaaactcatgtatttatgatgtcagtaatcggaccctgagggttctaatccgacttctctggtctccgaagtctggacaacnccggccctccgtgacctatccgtcgtcgggctccgacggtctaggtaaccgacggaacggtctacggtaacttttaactttaaccgtcgtacctaacgggtcccttaccgaactttaacgtaaacccgtaaaggtacccgaaacgggtccgaaacggtccgtaaaccgtttccgttaccgggtttacgggtttcccggggtaaccggggtaacggggtaaacccgtaaacggtcccgtaaccgggtaacccggtttacccgttaacggggttacccgtaaccgggtaccccggtaaacggggttccccgttacccgggtaccccccggttccgggttacccgttaacccgttcccgtttaccgggtttccccccctaaccccgtttccccgtacccggaacccggttaccgttcccgtttacggttaacccgttcggaccgggtcccgggtcccgtacgggtaaccccgg

SEQ ID NO: 187028 - DNA, 541 bp, Homo sapiens
  misc_feature: GYAE6OF02GK2IA.35.28.C06.1.454.CMB.1.raw
  modified_base (336)..(336): a, c, t, g, unknown or other
  misc_feature (336)..(336): n is a, c, g, or t
tcagtacagatcgtcacgaccggtgctcgatttagagctcacgtattggggtttgggggctctgctcctcctcaccctcctcactcagggcacagggtcctgggcccagtctgtcctgactcagccctccctccgcgtccgggtctcctggacagtcagtcaccatctcctgcactggaaccaacaatgacgttggtgttataattctgtctcactggtaccaacaatacccaggcagacgcccccaaactcatgtattttgaggtcagtaagcggcctcaggggtccctgatcgcttctctggctccaagtctgacaacacgctcctacgtctcnggctccagctgagatgagctgattatactgcagctacatactcgcaggcagactaacgtttcgtagtttcgggacggtaagggaccgtaaggttcgaccgtctaagtcagtcccaaggctccgccccgtcggtccactctcgttcccgcctcctcacgtctcgtgtacgtggacgtcggcgtcggacgaacggcgtaccagtacg

SEQ ID NO: 187029 - DNA, 538 bp, Homo sapiens
  misc_feature: GYAE6OF02IBLIU.35.28.C06.1.454.CMB.1.raw
  modified_base (321)..(321): a, c, t, g, unknown or other
  misc_feature (321)..(321): n is a, c, g, or t
  modified_base (376)..(376): a, c, t, g, unknown or other
  misc_feature (376)..(376): n is a, c, g, or t
  modified_base (386)..(386): a, c, t, g, unknown or other
  misc_feature (386)..(386): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtggttataatttctgtctcatggtaccaacaatacccaggcagagcccccaaaactcatgatttttgaggtcagtaagcggcctcgaggggtccctgatcgcttctctggctccaagtctgacaacnccggcctcccttaccgtctctgggctcagactgagatgaggctgtattattactncagctcatanacaacagcagcactctcgtggttcggacggacggaccaagctgaccgtcaggtcacgaccgagcctccgccccttcgtccactctccgttcccgccctcctccgcgtactcgtccgttactggacggccgggtcctgggcgtacggctaacg

SEQ ID NO: 187030 - DNA, 644 bp, Homo sapiens
  misc_feature: GYAE6OF02IDH31.35.28.C06.1.454.CMB.1.raw
  modified_base (371)..(371): a, c, t, g, unknown or other
  misc_feature (371)..(371): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtggttataattctgtctcatggtaccaacaatacccaggcagacgacccccaaactcatgtattttgaggtcagtaagcggcctgacgggtccctgatcgcttctctggctcagtctgacacacgtcctccctacgtctcgtggcctcagactgagatgaggctgtacgttattacngacacgtctactatatgcacggcacgtacgtaaccgtttgtagtttacggcgggtaacggaccgtaaggttcgtaccgtaccgtaagtccgaacggtcccgtaacgggcctaccggccccccgttcggggtacccctacgttacccggttcccgttaccccgtacccccgttacctacccgtaccgtaccgttacgttcccggttaacgttacgggtaccgggtccgggttccggtacgggtaccggtaaccgggacggtaccgacgtaacgg

SEQ ID NO: 187031 - DNA, 504 bp, Homo sapiens
  misc_feature: GYAE6OF02G8B8J.35.28.C06.1.454.CMB.1.raw
  modified_base (375)..(375): a, c, t, g, unknown or other
  misc_feature (375)..(375): n is a, c, g, or t
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
  modified_base (451)..(451): a, c, t, g, unknown or other
  misc_feature (451)..(451): n is a, c, g, or t
  modified_base (462)..(462): a, c, t, g, unknown or other
  misc_feature (462)..(462): n is a, c, g, or t
  modified_base (494)..(494): a, c, t, g, unknown or other
  misc_feature (494)..(494): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtggttataattctgtctcatggtaccaacaatacccaggcagacgcccccaaatcatgatttttgaggtcagtaatcggccctgaggggtttctaatcgcttctctggctcaagtctggcaacacggcctccctgaccatctctgggcctccgaggctgacgacgaggctgatttattacngcagctcatactacaaccagcagcactctcgtgtcggcggaggaccagcngcctcngtcngccagcncgccctgcnctctcgtcccnccctctccgactctctcgtactgacgcggcgnggcaggcacg

SEQ ID NO: 187032 - DNA, 655 bp, Homo sapiens
  misc_feature: GYAE6OF02HXI3N.35.28.C06.1.454.CMB.1.raw
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtggttataattctgtctcatggtaccaaacaatacccaggcagacgcccccaaaactcatgatttttgaggttcagtaagcggccctgaggggtccctgatcgcttctctgctcaagtctgacaacacgcctcccttaccgtctcgtgggcctcgagactgaggatggaggctgtattattactgcagctcatatgcaggctacgactaaccgtttgtacgtttcggacgggtagggaacctaaaggtttccgaacccgttaccgtaacgttcgaaccgtacccgtaacggtccgtacccgtccccccgttccggttacctaacccgttccgttccggttaccccctacccccgttcccgtacccgtaaccgttacgttcccttacggttaaccgttacggaccgggtcccgggtccggtaccgggtaccgtaaccgggtaccggtaccgtaaggttacgg

SEQ ID NO: 187033 - DNA, 538 bp, Homo sapiens
  misc_feature: GYAE6OF02HNTQO.35.28.C06.1.454.CMB.1.raw
  modified_base (361)..(361): a, c, t, g, unknown or other
  misc_feature (361)..(361): n is a, c, g, or t
  modified_base (427)..(427): a, c, t, g, unknown or other
  misc_feature (427)..(427): n is a, c, g, or t
tcagtacagatcgtcacgaccggtgctcgatttagagctcacgtattgggtttggggggggtctcaggaggcagcgctctcaggacgtcaccaccatggcctgggctctgctcctcctcaccctcctcactcagggcacagggtcctgggcccagtctgtcctgactcagcctccctccgcgtccgggtctcctggacagtcagtcaccatctcctgcactggaaccaacaatgacgttggtgttataattctgtctcatggtaccaacaataccaggcagacgcccccaaactcaatgatttttgaggtcagtaagcggccctcacggggtccctgatcgcttctctggctccaagtctnacaacacggcctcccttaccgtctctgggctcagactgaggatgaggctgtattattatgcagctnatatgcaggcagcaaccgtttgtacgtttcggacggaaggacctaaggttcgaccgttaccgtaagtccacgacccaaggcctcgcccctcggtccactcctcgttccccg

SEQ ID NO: 187034 - DNA, 605 bp, Homo sapiens
  misc_feature: GYAE6OF02HJT3L.35.28.C06.1.454.CMB.1.raw
  modified_base (298)..(298): a, c, t, g, unknown or other
  misc_feature (298)..(298): n is a, c, g, or t
tcagtacagatcgtcacgaccggtgctcgatttagagctcacgtattgggtttgggggctctgctcctcctcaccctcctcactcagagcacaggctcttgggcccagtctgccctgattcagcctccctccgtgtccgggtctcctggacagtcagtcaccatctcctgcactggaacctgcagtgatgttgggaattatgactatgtctcctggtaccaacttcacccagacacacgtccccaaaccatgatctacaatgtacaatattcgccctcaggactccctaatcgtttcnctggctccaagtctggctatgcggcctccgtcgccatctctggacctccgaggtctggaggacgagctgacttagtggagctgtacttatagtaagagcaggtcgacctacttctaacggttacgacgttcgggacggacgggacccgaaggtccgtacggtacccgtaccgtacggtaccaacgacccgaaacggtccgtcccgtacccccgttcggtacctacccgtccgttcccgttaccccctaccccgttcccgttaccgacccggtacttcccgttacggtaccgtaggaccggtccgggg

SEQ ID NO: 187035 - DNA, 900 bp, Homo sapiens
  misc_feature: GYAE6OF02IFCH2.35.28.C06.1.454.CMB.1.raw
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtggttataattctgtctcatggtaccaacaactaccaggcagacgaccccaaactcatgtattttgaggtcagtaagcggtcctcgacggggtccctgactcgtctttcgtctggcctaccgaagtctagaaccaaccgtaccggcccttcccgtttaccgtcctcgtcgggcctaccgacgtactacggaggtacgtcggaacggtcgtaggtaactttaagttacgttcgccgtaacgtccgttactaacgttaacgtacggtaccgtaacggggaccaacgggttaacccgttaaaccgggtttttaacgggtttacggtttttaccgggggacccgggggttaaacggggtaaacccggttaaaacggggttttacccgggtaaacccccggttttaaacccggttaaaccgggttacccggaaacccgggtaaaccccccgggttaaacggggtccccggtttaccccccgggtaccccccccggtttaccggggttaacccccgtttaacccgtttccccggggttttccccggtttacccccccgttccccccggttttaaccccccgtaccggtttaacccgttaccggtttcccgttttaaccgggttaaccggttaccggggtacccggggtaccgggggttccccgtacggggaacccgggttaacccggggtccggtacccgtaagttaccggg

SEQ ID NO: 187036 - DNA, 756 bp, Homo sapiens
  misc_feature: GYAE6OF02HE9K6.35.28.C06.1.454.CMB.1.raw
tcagtacagatcgtcacgaccggtgctcgatttagagctcacgtattggggtttgggggcgtctggctccctccctcgtacccctccgtcactcagggtcacagggtcctgggcccagtctgtcctgactcagcctccctccgcggtccgggttcgtcctggacagttcgtacgtctaccatcttaccgtgcactggaaccaacaatgacgttggtggttataatttcgtggtctctagtcggtaccaacgtaacggtaccccaggacacgaccgaccccccaaacgtcactgtactttagtggtattcgtacctaagttaactccggtcctcggtaacgggtttactaacgtccgtcttcgtccgtcggcctaccgtaacgtcggtacggaccaacgaccggtccctccgtcgacctattccgtacgtacggtactccgaggtaccgtacgaacgtacggtaggtcttaggtaactttaacgttacgtggacgacggtcctacgtaacttaactaacaacgtccaacgtacgaacgtacctaccgttaccgtcggttacggtaccgggtacggtaaccgggtacctaaggtccgtaccgggtaacccgttacgtacggtaccgaccggacccgtaacgggtccgtacccggtcccgtaccggtctaacccgttcttacccgtacccctccggttcctacgtacgtaccgtacgttacggtacggtcggtcgggtccggttacggacggaaccggg

SEQ ID NO: 187037 - DNA, 648 bp, Homo sapiens
  misc_feature: GYAE6OF02HQKFX.35.28.C06.1.454.CMB.1.raw
  modified_base (361)..(361): a, c, t, g, unknown or other
  misc_feature (361)..(361): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtggttataattctgtctcatggtaccaacaatacccaggcagacgacccccaaactcatgtattttgagtcagtaagcggccctgacgggtccctgactccgcttctactggcctccgaagtctagaacaacacggcccttcccttaccgtctcgtgggcctccganacgtgaggagtggacggctacgtaatttacgttactgacctagtacctatacgttatcgacgaggacaacgtaccgttaaccggtttgttacgtttcgggacgggtaacgggtaaccgtaaggttacgacccggttaccgtaagtccacgacccgtaaggccgtacccggacccccttcggtacctaccgttccgtccgttcccccgtacccttcccgtaccgaaccgttacgtcgttacggtacctacggtacggccggtcgtcggccgtaacggcgtacgagtcg

SEQ ID NO: 187038 - DNA, 616 bp, Homo sapiens
  misc_feature: GYAE6OF02HIZDJ.35.28.C06.1.454.CMB.1.raw
  modified_base (320)..(320): a, c, t, g, unknown or other
  misc_feature (320)..(320): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtggttataattctgtctcatggtaccaacaactacccaggcagacgacccccaaactcatgtattttgaggtcagtaagcggccctcgacggggtccctgatcgcttctctgctcagtctgacacnccgcctcccttacgtctcgtcggctccagctgaggatgaggctgtattattactgctagtctacatagtgacgaggcacgtccgttaaccggtttgtaacgtttcgggacggtaacgggtaccgtaaggttacggtacccgttaccgtaacgtccaacggtacccgaggtcccgtccgtcccccgtacggtcctaccgttccgttcccgttccccgtcccttcccgacctacgtccttcgtaccgtacgtcggaccggtcgggtacgtcgggaccgaacgggtccgagtacgtacg

SEQ ID NO: 187039 - DNA, 773 bp, Homo sapiens
  misc_feature: GYAE6OF02HVX14.35.28.C06.1.454.CMB.1.raw
tcagtacagatcgtcacgaccggtgctcgatttagagctcacgtattgggtttgggggctctgctcctcctcaccctcctcactcagggcacagggtcctgggcccagtctgtcctgactcagcctccctccgcggtccgggtctcctggacagtcagtcaccatctcctgcactggaaccaacaatgacgttggtggttataattctgtctcatggtaccaaacaatacccaggcagacgaccccaaatcatgtattttgagtcagtaagcgcctcgacgggtcctgatcgtcttctcgtggtctaccgtaagtctaggaaccaaccgtaccggtcccttaccccgtttaccgtcgtcgtcgggccttccgaagtacgtaggaaggtactgggaacggtcttaggtaaacttttaacgttacgtaggtaccaggttacctacgtaagttaacgtcggtacgacgggacctaacgtaacccgtttaaacggttttacggttacgggttttaccggggaacggggttaaaccgggtaaccgtaaagggttttcccggaacccgtttaaccgttaaaggtccgaacccggttacccggaaaccgggtccttaccccggtacccccgttacggtaccccgttaaccggttccccttacccggttaacccccctaccccgttcccgtaacccgtacggttacccttacgttaccggtaaccgtcgggtaaccgggccggttacggtaccggaccgtaacgggcgtaaccgtagtacg

SEQ ID NO: 187040 - DNA, 613 bp, Homo sapiens
  misc_feature: GYAE6OF02G9BJV.35.28.C06.1.454.CMB.1.raw
  modified_base (358)..(358): a, c, t, g, unknown or other
  misc_feature (358)..(358): n is a, c, g, or t
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtggttatattctgtctcatgtaccaacaatacccaggcagacgacccccaaactcatgtattttgagtcagtaagcgcctcgacgggtcctgactcgcttctctggctccaagtctgacaacaccggcctcccttaccgtctcgtcggctccagactgagatgngctgattatactncagctacatngacagcacgtccgtaacgttgtacgtttcgggacggacggtaaccgtaagtcgtaccgtacgtaacgtccgacgacccgtaaggtcccgtccgtaccccgtcggtacctaccgttccgttcccggttcccctaccccgtcccgttaccgtaccgtaaccgttccggttaccgttaccggtcggaccgggtccgggtaccggtacgggaccgaacgggcccgtagtagtacgg

SEQ ID NO: 187041 - DNA, 705 bp, Homo sapiens
  misc_feature: GYAE6OF02IBRK6.35.28.C06.1.454.CMB.1.raw
  modified_base (260)..(260): a, c, t, g, unknown or other
  misc_feature (260)..(260): n is a, c, g, or t
tcagtacagatcgtcacgaccggtgctcgatttagagctcacgtattgggtttggggggggtctcaggaggcagcgctctcaggacgtcaccaccatggcctgggctctgctcctcctcaccctcctcactcagggcacagggtcctgggcccagtctgtcctgactcagccctccctccgcgtccgggtctcctggacagtcagtcaccatctcctgcactcggaaccaacaatgacgttggtagttatattctgtctnatgtaccaacaactaccagcagaccgacccccaaactcatgtatttttggaggtcagtacgccgccgtcgacgggtcctgtactcgcttctctcgcctacgaacgtctacgaaccaacgaccggtccccttaccccgttacccgttccttaccggtcgggtcccttaccgtaacggtaccgtagggaacgggtagtacgggacggttcctaggttaatttaacgtttaccgtcggtaccgtacgtaccttacgtaagttaaactaaccgaaacggtacgaacggtaccaacgtaccctaaccgttccgtttccgggttacggttacccggggaccgggtaaccgggacccgtaacggtccgtaccggtacccgttaccggtacggtaccgaccggtaccccgaacggtcccgttccccggtacccccgttacggtaccctacccg

SEQ ID NO: 187042 - DNA, 590 bp, Homo sapiens
  misc_feature: GYAE6OF02IPCNK.35.28.C06.1.454.CMB.1.raw
  modified_base (380)..(380): a, c, t, g, unknown or other
  misc_feature (380)..(380): n is a, c, g, or t
  modified_base (527)..(527): a, c, t, g, unknown or other
  misc_feature (527)..(527): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtggttataattctgtctcatggtaccaacaatacccaggcagacgcccccaaactcatgattttgaggtcagtaagcggcctgacgggtcctgatcgcttctcgtggctaccagtctgacacacgcctccctacgtctcgtggcctcagactgagatgagtctagtattatacgtagcagtcctanatatcgctaggacgacgaccgtaacgtttagtacgtttacgggacggtacggtaaccgtaacggttacgtacccgttacgtaacgtacgaccgaccgaacgtccgtaccgccccgttcgtacctcgtccgttccgtcccgtcctccncgtaccgtacgtcttacgtacgtcgtacggtcggccgtggtaccgaacggcgtacgtagtacg

SEQ ID NO: 187043 - DNA, 727 bp, Homo sapiens
  misc_feature: GYAE6OF02J25OY.35.28.C06.1.454.CMB.1.raw
  modified_base (205)..(205): a, c, t, g, unknown or other
  misc_feature (205)..(205): n is a, c, g, or t
  modified_base (209)..(209): a, c, t, g, unknown or other
  misc_feature (209)..(209): n is a, c, g, or t
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
  modified_base (434)..(434): a, c, t, g, unknown or other
  misc_feature (434)..(434): n is a, c, g, or t
  modified_base (687)..(687): a, c, t, g, unknown or other
  misc_feature (687)..(687): n is a, c, g, or t
  modified_base (723)..(723): a, c, t, g, unknown or other
  misc_feature (723)..(723): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatctcctgcactggaaccaacaatgacgttggtgttatactangtcnctgtaccacnccaccngccaaacgccccaactcactacgtatttacgtagattcgtactagtaacgtccgccgtcgtaggggttctagtcgtcttctcgtacgtccttaccgagttccgtacgaccacgaccggtccctcccgtacaaccgtcttccgtaccggtcggcctccggacggtcgacgggtaaccgacggaggtaccgtgttaacgttacgtttaccnggacccgtaacgtcctaacaactttaccgtaaacccaaccggtacggaaccttaccgggactacccgttccggttacgggttccggggttaccgggaccggtacgggaacccgtacggtcccggttaacggtcccgtaccggttaccgaccggtacccgacccacgggttccgccccgtaccccgttcgtccctacccgtccctaccgtacccgccctacgtacctaacggttcctacgtcggttaacccggnggtacccgggtcggtccggtacgggtccgaccggtntacg

SEQ ID NO: 187044 - DNA, 697 bp, Homo sapiens
  misc_feature: GYAE6OF02HJXX7.35.28.C06.1.454.CMB.1.raw
tcagtacagatcgtcacgaccggtgctcgatttagagctcacgtattgggtttgggggctctgctcctcctcaccctcctcactcagggcacagggtcctgggcccagtctgtcctgactcagcctccctccgcgtccgggtctcctggacagtcagtcaccatcctcctgcactggaaccaacaatgacgttggtgttataattctgtctcatcgtaccaacaactaccaggcagacgaccccaactcatgtattttgagtcgagtacgcgcctcgacgggtcctgatcgtcttctcgtcggcctaccgtagtcgtacgaccaaccgaccggtcccttacccgttaccgtctccgtcgggcctaccgagtcgtaggagagtggacgtcttagtatttacgttactacgctacgccttacacttagtcgcgacgaccgtacgtacgtttaaccgtttagttacggtttaccgggacgggtacgggtaacgttaacggttaccggtaacccgttaccgtaacgtccgaaccggacccgtaacggtacccgtcccgtcccccgttaccgtacccgtccgtttcccgttacccgttacccccacccttcccgaccgtaccgtaccgttcgttaaccgttcgtaccggtacgggtcccgggtacggttccgggaaccgaaccgggtccgtaccgtagtcgg

SEQ ID NO: 187045 - DNA, 649 bp, Homo sapiens
  misc_feature: GYAE6OF02IJ61W.35.28.C06.1.454.CMB.1.raw
  modified_base (372)..(372): a, c, t, g, unknown or other
  misc_feature (372)..(372): n is a, c, g, or t
tcagtacagatcgtcacgaccggtgctcgatttagagctcacgtattggggtttgggggggggtctcaggaggcagcgctctcaggacgtcaccaccatggcctgggctctgctcctcctcaccctcctcactcagggcacagggtcctgggcccagtctgtcctgactcagcctccctccgcgtccgggtctcctggacagtcagtcaccatctcctgcactggaaccacaatgacgttgtggttataattctgtctactatacggtaaccaaacaactacccgagcaagaccaccccaaactcatgttatttagagtacagtacgccgcctcgcgggtacctgtactcgtctctctcgtctactagtctnacaacacgtcctccgttacctctcgtcggcctcgacgtcgtacgaggagtggacgtcgtagttaatttaacttacgtacgtacgacgtctacgtatacgtcgtacgacggtacaacgtaccgttaaaccggttttggttaacgtttccgggacggtaacgggtacccgtaaggttaccggtacccgttaccgtaacggttacccgaccggtaacccgtacgaccccgttcccgtaccccgtaccggtaccccttaccgttccgttacccgttccccg

SEQ ID NO: 187046 - DNA, 720 bp, Homo sapiens
  misc_feature: GYAE6OF02GY1SO.35.28.C06.1.454.CMB.1.raw
  modified_base (170)..(170): a, c, t, g, unknown or other
  misc_feature (170)..(170): n is a, c, g, or t
  modified_base (420)..(420): a, c, t, g, unknown or other
  misc_feature (420)..(420): n is a, c, g, or t
  modified_base (667)..(667): a, c, t, g, unknown or other
  misc_feature (667)..(667): n is a, c, g, or t
tcagtacagatcgtcacgaccggtgctcgatttagagctcacgtattgggtttgggggctctgctcctcctcaccctcctcactcagggcacagggtcctgggcccagtctgtcctgactcagcctccctccgcggtccgggtctcctggacagtcagtcaccatctctncactgaacaacaatgacgttggtggttataattctgtctcatcgtaccaaacaactacccgaggacagaccgacccccaaactcagttagtacgtttttgacggtacaggtaacgccggccctacgacggggtccctagatccgtcctttctactcggcctaccgtaacgtcttagaaccaaccgcccggtaccccttaccccgttaacccgtcgttccgttccgggctacccgacgaccgtgaagggtntacgggacgtctagttatttaaacgttactgcctagtaccttacgtaataacctaaccgaaacctcggacgacgacccttacgttcgttacggttaccgggtacggggcgggaaaccgggtaaccgaaggttcccgtaacggtaccccgttacggtaacggtcgaaacccgtacccggtaaggaccctacccggccccgttaacgtcccgtaacctccgttcccgttcccccgcctaccgttaacgngttaacctcgttacgtacgaggtaccggcggccgttcggaacgcggtactcgg

SEQ ID NO: 187047 - DNA, 816 bp, Homo sapiens
  misc_feature: GYAE6OF02JWP12.35.28.C06.1.454.CMB.1.raw
tcagtacagatcgtcacgaccggtgctcgatttagagctcacgtattgggtttgggggctctgctcctcctcaccctcctcactcagggcacagggtcctgggcccagtcctgtcctgactcagcctccctccgcgtccgggtctcctggactacgtcagtaccaccatctcctgcactacggaaccaacaatgtacgttggttagttaatacttctcgtctctagttacgaacaaacgaactaccgaggacaacgaaccgaccccaaactcgtagttcgttaagtttttacggacggttacgtaacggtaaccggtaccggtccccgttacggtaccgggttccttacgtaacgttccggtacctttacggtccgtaccggtacccgtaaccggttaaacgttccgtaacggaaccctaaccggtacccgtacccctttaaccccgtttaccggtccttccggtaccggtacccttaccgacgtacggtacggacgtacggtacgacggtcttaagttactttacgttacgtagcggttacgtctacgtaattacggcgtaacggtcggacgttaaccggtccgttaacgtttcggtacgggttacggaaccgggtacgtacggtacgttaccgtaaccggttacgtaccggtactaaccgaccgggttactcccgtacccgtacccggtacttaccgtacccgttcgtaccccgttacctccctactaccggttccctacggttccggttaacgtcggtaccggtaacgggttaccgacgggttaccgacgtaaccgggttccagttaggtccg

SEQ ID NO: 187048 - DNA, 578 bp, Homo sapiens
  misc_feature: GYAE6OF02GFRCU.35.28.C06.1.454.CMB.1.raw
  modified_base (414)..(414): a, c, t, g, unknown or other
  misc_feature (414)..(414): n is a, c, g, or t
  modified_base (544)..(544): a, c, t, g, unknown or other
  misc_feature (544)..(544): n is a, c, g, or t
tcagtacagatcgtcacgaccggtgctcgatttagagctcacgtattgggtttgggggctctgctcctcctcaccctcctcactcagggcacagggtcctgggcccaatctgtcctgactcagcctccctccgcgtccgggtctcctggacagtcagtcaccatctcctgcactggaaccaacaatgacgttggtggttataattctgtctcatggtaccaacaatacccaggcagacgccccaaactcatgtattttgagtcagtaacgcggccctcgacggggtccctgactcgcttctctggtctcctagtctgaccaacgaccggtccctacccttaccgtctcgtcgggcctccgagacgtggaggtacgtggacggctagtaatttacttacgtgctagctacatagngcgagcagtccgtaacgttgtacgttccggaggtacggtactaagttcgaccgtctaacgcacgaccgaggtcctccgccccgtcgtacctctccgtcctaccctccctcacgacgtctcctgttaccgngtacggccggtctcggcgacggtcgtacgagtcg

SEQ ID NO: 187049 - DNA, 218 bp, Homo sapiens
  misc_feature: GYAE6OF01D8M8R.1.79.H02.1.454.CMB.1.raw
  modified_base (216)..(218): a, c, t, g, unknown or other
  misc_feature (216)..(218): n is a, c, g, or t
tcagacgagtgcgtcacgaccggtgctcgatttagtgtcacacgatcgcggggaagaagagctgctcagttaggacccagagggaaccatggaaaccccagcacagcttctcttcctcctgctactctggctcccaggaactgtggctgcaccatctgtcttcatcttcccaccctcctcacgcactcgtctgagcgggctggcaaggcgcatagnnn

SEQ ID NO: 187050 - DNA, 218 bp, Homo sapiens
  misc_feature: GYAE6OF01B8XCE.1.79.H02.1.454.CMB.1.raw
  modified_base (216)..(218): a, c, t, g, unknown or other
  misc_feature (216)..(218): n is a, c, g, or t
tcagacgagtgcgtcacgaccggtgctcgatttagtgtcacacgatcgcggggaagaagagctgctcagttaggacccagagggaaccatggaaaccccagcacagcttctcttcctcctgctactctggctcccaggaactgtggctgcaccatctgtcttcatcttcccgccctcctcacgcactcgtctgagcgggctggcaaggcgcatagnnn

SEQ ID NO: 187051 - DNA, 223 bp, Homo sapiens
  misc_feature: GYAE6OF01DPNUY.1.79.H02.1.454.CMB.1.raw
  modified_base (218)..(223): a, c, t, g, unknown or other
  misc_feature (218)..(223): n is a, c, g, or t
tcagacgagtgcgtcacgaccggtgctcgatttagtgtcacacgatcgcgggggaagaagagctgctcagttaggacccagagggaaccatggaaaccccagcacagcttctcttcctcctgctactctggctcccaggaactgtggctgcaccatctgtcttcatccttcccaccctcctcacgcactcgtctgagcgggctggcaaggcgcatagnnnnnn

SEQ ID NO: 187052 - DNA, 223 bp, Homo sapiens
  misc_feature: GYAE6OF01DQC0D.1.79.H02.1.454.CMB.1.raw
  modified_base (218)..(223): a, c, t, g, unknown or other
  misc_feature (218)..(223): n is a, c, g, or t
tcagacgagtgcgtcacgaccggtgctcgatttagtgtcacacgatcgcgggggaagaagagctgctcagttaggacccagagggaaccatggaaaccccagcacagcttctcttcctcctgctactctggctcccaggaactgtggctgcaccatctgtcttcatccttcccgccatctgaacgcactcgtctgagcgggctggcaaggcgcaatgnnnnnn

SEQ ID NO: 187053 - DNA, 215 bp, Homo sapiens
  misc_feature: GYAE6OF01A8BMQ.24.57.F02.1.454.CMB.1.raw
  modified_base (214)..(215): a, c, t, g, unknown or other
  misc_feature (214)..(215): n is a, c, g, or t
tcagactactatgtcacgaccggtgctcgatttagctcgatatagttggttgggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnn

SEQ ID NO: 187054 - DNA, 168 bp, Homo sapiens
  misc_feature: GYAE6OF01EKNAK.24.57.F02.1.454.CMB.1.raw
  modified_base (168)..(168): a, c, t, g, unknown or other
  misc_feature (168)..(168): n is a, c, g, or t
tcagactactatgtcacgaccggtgctcgatttagctcgatatagttgggttgggaggtgtgtcacaagatttgggccaggagcacctctggggcacagcggccctgggctgcctggtcaaggactacttccacatagtagtctgagcgggctggcaaggcgcatagn

SEQ ID NO: 187055 - DNA, 124 bp, Homo sapiens
  misc_feature: GYAE6OF01E3TGS.24.57.F02.1.454.CMB.1.raw
  modified_base (124)..(124): a, c, t, g, unknown or other
  misc_feature (124)..(124): n is a, c, g, or t
tcagactactatgtcacgaccggtgctcgatttagctcgatatagttggttggcacagcggcctggctgcctggtcaaggactacttccacatagtagtctgagcggctggcaaggcgcatagn

SEQ ID NO: 187056 - DNA, 220 bp, Homo sapiens
  misc_feature: GYAE6OF01D2JNO.24.57.F02.1.454.CMB.1.raw
  modified_base (218)..(220): a, c, t, g, unknown or other
  misc_feature (218)..(220): n is a, c, g, or t
tcagactactatgtcacgaccggtgctcgatttagctcgatatagttgggtttgggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnnn

SEQ ID NO: 187057 - DNA, 218 bp, Homo sapiens
  misc_feature: GYAE6OF01DGXYI.24.57.F02.1.454.CMB.1.raw
  modified_base (217)..(218): a, c, t, g, unknown or other
  misc_feature (217)..(218): n is a, c, g, or t
tcagactactatgtcacgaccggtgctcgatttagctcgatatagttgggtttggggaagaggaagactgacggtcctcccaggagttcaggtgctgggcaccttgggcacggggaggtgtgtcacaagatttgggctctgggcacagcggccctgggatgcctggtcaaggactacttccacatagtagtctgagcgggctggcaaggcgcatagnn

SEQ ID NO: 187058 - DNA, 263 bp, Homo sapiens
  misc_feature: GYAE6OF01ELA1Y.24.57.F02.1.454.CMB.1.raw
  modified_base (260)..(263): a, c, t, g, unknown or other
  misc_feature (260)..(263): n is a, c, g, or t
tcagactactatgtcacgaccggtgctcgatttagctcgatatagttgggtttggggaagaggaagactgacggtcctcccaggagttcaggtgctgggcaccttgggcacggggaggtgtgtcacaagatttgggctctgggcaccgtgggcatggggaggtgtgtcacaagatttgggctctgggcacagcggcctgggctgcctggtcaaggactacttccacatagtagtctgagcgggctggcaaggcgcatagnnnn

SEQ ID NO: 187059 - DNA, 132 bp, Homo sapiens
  misc_feature: GYAE6OF01CTMWM.24.57.F02.1.454.CMB.1.raw
  modified_base (130)..(132): a, c, t, g, unknown or other
  misc_feature (130)..(132): n is a, c, g, or t
tcagactactatgtcacgaccggtgctcgatttagctcgatatagttgggtttgcgcacagcggccctgggctgcctggtcaaggactacttcctgtcgagcgtctgagcgggctggcaaggcgcatagnnn

SEQ ID NO: 187060 - DNA, 218 bp, Homo sapiens
  misc_feature: GYAE6OF01BOVNR.24.57.F02.1.454.CMB.1.raw
  modified_base (217)..(218): a, c, t, g, unknown or other
  misc_feature (217)..(218): n is a, c, g, or t
tcagactactatgtcacgaccggtgctcgatttagctcgatatagttgggtttggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnn

SEQ ID NO: 187061 - DNA, 252 bp, Homo sapiens
  misc_feature: GYAE6OF01D07CW.24.57.F02.1.454.CMB.1.raw
  modified_base (221)..(222): a, c, t, g, unknown or other
  misc_feature (221)..(222): n is a, c, g, or t
  modified_base (224)..(252): a, c, t, g, unknown or other
  misc_feature (224)..(252): n is a, c, g, or t
tcagactactatgtcacgaccggtgctcgatttagctcgatatagttgggtttagggggaagaggaagactgacggtcctcccaggagttcaggtgctcgggcaccttgggcacggggaggtgtgtcacaagatttgggctctgggcacagcggccctgggctgcctggtcaaggactacttccacatagtagtctgagcgggctggcaaggccgcatagnngnnnnnnnnnnnnnnnnnnnnnnnnnnnnn

SEQ ID NO: 187062 - DNA, 266 bp, Homo sapiens
  misc_feature: GYAE6OF01ENMVV.24.57.F02.1.454.CMB.1.raw
  modified_base (263)..(266): a, c, t, g, unknown or other
  misc_feature (263)..(266): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcaccgtgggcatgggggagtgtgtcacaagatttgggctctgggcacagcggccctgggctgcctggtcaaggactacttccacatagtagtctgagcgggctggcaaggcgcatagnnnn

SEQ ID NO: 187063 - DNA, 224 bp, Homo sapiens
  misc_feature: GYAE6OF01ARYEL.24.57.F02.1.454.CMB.1.raw
  modified_base (218)..(224): a, c, t, g, unknown or other
  misc_feature (218)..(224): n is a, c, g, or t
tcagactactatgtcacgaccggtgctcgatttagctcgatatagttgggtttgggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnnnnnnn

SEQ ID NO: 187064 - DNA, 228 bp, Homo sapiens
  misc_feature: GYAE6OF01AW2FJ.24.57.F02.1.454.CMB.1.raw
  modified_base (213)..(228): a, c, t, g, unknown or other
  misc_feature (213)..(228): n is a, c, g, or t
tcagactactatgtcacgaccggtgctcgatttagctcgatatagttggttggggaagaggaagactgacggtcctccaggagttcaggtgctgggcaccttgggcacggggaggtgtgtcacaagatttgggctctgggcacagcggcctgggctgcctggtcaaggactacttccacatagtagtctgagcgggctggcaaggcgcatagnnnnnnnnnnnnnnnn

SEQ ID NO: 187065 - DNA, 268 bp, Homo sapiens
  misc_feature: GYAE6OF01D9HS9.24.57.F02.1.454.CMB.1.raw
  modified_base (263)..(268): a, c, t, g, unknown or other
  misc_feature (263)..(268): n is a, c, g, or t
tcagactactatgtcacgaccggtgctcgatttagctcgatatagttgggtttgggggaagaggaagactgacggtcctcccaggagttcaggtgctgggcaccttgggcacggggaggtgtgtcacaagatttgggctctgggcaccgtgggcatgggggaggtgtgtcacaagatttgggctctgggcacagcggccctgggctgcctggtcaaggactacttccacatagtagtctgagcgggctggcaaggcgcatagnnnnnn

SEQ ID NO: 187066 - DNA, 130 bp, Homo sapiens
  misc_feature: GYAE6OF01BOQWL.24.57.F02.1.454.CMB.1.raw
  modified_base (130)..(130): a, c, t, g, unknown or other
  misc_feature (130)..(130): n is a, c, g, or t
tcagactactatgtcacgaccggtgctcgatttagctcgatatagttgggtttgggcacagcggccctgggctgcctggtcaaggactacttcctgtcgagcgtctgagcgggctggcaaggcgcatagn

SEQ ID NO: 187067 - DNA, 232 bp, Homo sapiens
  misc_feature: GYAE6OF01A5HU2.24.57.F02.1.454.CMB.1.raw
  modified_base (217)..(232): a, c, t, g, unknown or other
  misc_feature (217)..(232): n is a, c, g, or t
tcagactactatgtcacgaccggtgctcgatttagctcgatatagttgggtttggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnnnnnnnnnnnnnnnn

SEQ ID NO: 187068 - DNA, 226 bp, Homo sapiens
  misc_feature: GYAE6OF01EAOQB.24.57.F02.1.454.CMB.1.raw
  modified_base (218)..(226): a, c, t, g, unknown or other
  misc_feature (218)..(226): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggctgcctggtcaaggctacttccacatagtagtctgagcgggctggcaaggcgcatagnnnnnnnnn

SEQ ID NO: 187069 - DNA, 160 bp, Homo sapiens
  misc_feature: GYAE6OF01C7224.24.57.F02.1.454.CMB.1.raw
  modified_base (159)..(160): a, c, t, g, unknown or other
  misc_feature (159)..(160): n is a, c, g, or t
tcagactactatgtcacgaccggtgctcgatttagctcgatatagttgggtttgggtgaggtgtgtcacaagatttgggctctgggcacagcggccctgggctgcctggtcaaggactacttccacatagtagtctgagcggctggcaaggcgcatagnn

SEQ ID NO: 187070 - DNA, 221 bp, Homo sapiens
  misc_feature: GYAE6OF01DC7CZ.24.57.F02.1.454.CMB.1.raw
  modified_base (219)..(221): a, c, t, g, unknown or other
  misc_feature (219)..(221): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggctgcctggtcaaggactacttccacatagtagtctgagcgggctggcaaggcgcatagnnn

SEQ ID NO: 187071 - DNA, 130 bp, Homo sapiens; identical to SEQ ID NO: 187066
  misc_feature: GYAE6OF01AI6WN.24.57.F02.1.454.CMB.1.raw
  modified_base (130)..(130): a, c, t, g, unknown or other
  misc_feature (130)..(130): n is a, c, g, or t

SEQ ID NO: 187072 - DNA, 219 bp, Homo sapiens
  misc_feature: GYAE6OF01BHK8F.24.57.F02.1.454.CMB.1.raw
  modified_base (217)..(219): a, c, t, g, unknown or other
  misc_feature (217)..(219): n is a, c, g, or t
tcagactactatgtcacgaccggtgctcgatttagctcgatatagttgggtttggggaagaggaagactgacggtcctcccaggagttcaggtgctgggcaccttgggcacggggaggtgtgtcacaagatttgggctctgggcacagcgaccctgggctgcctggtcaaggactacttccacatagtagtctgagcgggctggcaaggcgcatagnnn

SEQ ID NO: 187073 - DNA, 221 bp, Homo sapiens
  misc_feature: GYAE6OF01CTLLJ.24.57.F02.1.454.CMB.1.raw
  modified_base (217)..(221): a, c, t, g, unknown or other
  misc_feature (217)..(221): n is a, c, g, or t
tcagactactatgtcacgaccggtgctcgatttagctcgatatagttgggtttggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnnnnn

SEQ ID NO: 187074 - DNA, 219 bp, Homo sapiens
  misc_feature: GYAE6OF01CHB2D.24.57.F02.1.454.CMB.1.raw
  modified_base (219)..(219): a, c, t, g, unknown or other
  misc_feature (219)..(219): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggctgcctggtcaaggactacttccacatagtagtctgagcgggctggcaaggcgcatagn

SEQ ID NO: 187075 - DNA, 220 bp, Homo sapiens
  misc_feature: GYAE6OF01A7UXK.24.57.F02.1.454.CMB.1.raw
  modified_base (219)..(220): a, c, t, g, unknown or other
  misc_feature (219)..(220): n is a, c, g, or t
tcagactactatgtcacgaccggtgctcgatttagctcgatatagttgggtttgggggaagaggaagactgacggtcctcccgggagttcaggtgctgggcaccttgggcacgggggaggtgtgtcacaagatttgggctctgggcacagcggccctgggctgcctggtcaaggactacttccacatagtagtctgagcgggctggcaaggcgcatagnn

SEQ ID NO: 187076 - DNA, 219 bp, Homo sapiens
  misc_feature: GYAE6OF01EVGLS.24.57.F02.1.454.CMB.1.raw
  modified_base (217)..(219): a, c, t, g, unknown or other
  misc_feature (217)..(219): n is a, c, g, or t
tcagactactatgtcacgaccggtgctcgatttagctcgatatagttgggttgggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnnn

SEQ ID NO: 187077 - DNA, 129 bp, Homo sapiens
  misc_feature: GYAE6OF01BCGNT.24.57.F02.1.454.CMB.1.raw
  modified_base (129)..(129): a, c, t, g, unknown or other
  misc_feature (129)..(129): n is a, c, g, or t
tcagactactatgtcacgaccggtgctcgatttagctcgatatagttggtttgggcacagcggccctgggctgcctggtcaaggactacttcctgtcgagcgtctgagcgggctggcaaggcgcatagn

SEQ ID NO: 187078 - DNA, 234 bp, Homo sapiens
  misc_feature: GYAE6OF01ECOKX.24.57.F02.1.454.CMB.1.raw
  modified_base (234)..(234): a, c, t, g, unknown or other
  misc_feature (234)..(234): n is a, c, g, or t
tcagactactatgtcacgaccggtgctcgatttagctcgatatagttgggtttggggaagtagtccttggccagggatccctggtcaccgtctcctcagcttccaccaagggcccatcggtcttccccctggcgccctgctccaggagcacctctgggggcacagcggccctgggctgcctggtcaaggactacttccacatagtagtctgagcgggctggcaaggcgcatagn

SEQ ID NO: 187079 - DNA, 161 bp, Homo sapiens
  misc_feature: GYAE6OF01DFGS1.24.57.F02.1.454.CMB.1.raw
  modified_base (159)..(161): a, c, t, g, unknown or other
  misc_feature (159)..(161): n is a, c, g, or t
tcagactactatgtcacgaccggtgctcgatttagctcgatatagttgggtttggggaggtgtgtcacaagatttgggctctgggcacagcggccctgggctgcctggtcaaggactacttccacatagtagtctgagcgggctggcaaggcgcatagnnn

SEQ ID NO: 187080 - DNA, 220 bp, Homo sapiens; identical to SEQ ID NO: 187056
  misc_feature: GYAE6OF01E1OXD.24.57.F02.1.454.CMB.1.raw
  modified_base (218)..(220): a, c, t, g, unknown or other
  misc_feature (218)..(220): n is a, c, g, or t

SEQ ID NO: 187081 - DNA, 247 bp, Homo sapiens
  misc_feature: GYAE6OF01B7JY6.24.57.F02.1.454.CMB.1.raw
  modified_base (219)..(247): a, c, t, g, unknown or other
  misc_feature (219)..(247): n is a, c, g, or t
tcagactactatgtcacgaccggtgctcgatttagctcgatataggttgggtttggggaagaggaagactgacggtcctcccgaggagttcaggtgctgggcaccttgggcacggggaggtgtgtcacaagatttgggctctgggcacagcggccctgggctgcctggtcaaggactacttccacatagtagtctgagcgggctggcaaggcgcatagnnnnnnnnnnnnnnnnnnnnnnnnnnnnn

SEQ ID NO: 187082 - DNA, 220 bp, Homo sapiens; identical to SEQ ID NO: 187056
  misc_feature: GYAE6OF01BV8IQ.24.57.F02.1.454.CMB.1.raw
  modified_base (218)..(220): a, c, t, g, unknown or other
  misc_feature (218)..(220): n is a, c, g, or t

SEQ ID NO: 187083 - DNA, 222 bp, Homo sapiens
  misc_feature: GYAE6OF01A2NO8.24.57.F02.1.454.CMB.1.raw
  modified_base (218)..(222): a, c, t, g, unknown or other
  misc_feature (218)..(222): n is a, c, g, or t
tcagactactatgtcacgaccggtgctcgatttagctcgatatagttgggtttgggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnnnnn

SEQ ID NO: 187084 - DNA, 253 bp, Homo sapiens
  misc_feature: GYAE6OF01ATQVN.24.57.F02.1.454.CMB.1.raw
  modified_base (218)..(253): a, c, t, g, unknown or other
  misc_feature (218)..(253): n is a, c, g, or t
tcagactactatgtcacgaccggtgctcgatttagctcgatatagttgggtttgggggaagaggaagactgacggtcctcccaggagttcaggtgctgggcaccttgggcacggggagggtgtgtcacaagatttgggctctgggcacagcggccctgggctgcctggtcaaggactacttccacatagtagtctgagcggctggcaaggcgcatagnnnnnnnnnnnnnnnnnnnnnnnnnnnnnnnnnnnn

SEQ ID NO: 187085 - DNA, 245 bp, Homo sapiens
  misc_feature: GYAE6OF01D2KSI.24.57.F02.1.454.CMB.1.raw
  modified_base (234)..(245): a, c, t, g, unknown or other
  misc_feature (234)..(245): n is a, c, g, or t
tcagactactatgtcacgaccggtgctcgatttagctcgatatagttgggtttggggaaggtagtccttggccagggatccctggtcaccgtctcctcagcttccaccaagggcccatcggtcttccccctggcgccctgctccaggagcacctctggggcacagcggccctgggctgcctggtcaaggactacttccacatagtagtctgagcgggctggcaaggcgcatagnnnnnnnnnnnn

SEQ ID NO: 187086 - DNA, 224 bp, Homo sapiens
  misc_feature: GYAE6OF01D0KTE.24.57.F02.1.454.CMB.1.raw
  modified_base (219)..(224): a, c, t, g, unknown or other
  misc_feature (219)..(224): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggctgcctggtcaaggactacttccacatagtagtctgagcgggctggcaaggcgcatagnnnnnn

SEQ ID NO: 187087 - DNA, 273 bp, Homo sapiens
  misc_feature: GYAE6OF01BMVVJ.24.57.F02.1.454.CMB.1.raw
  modified_base (261)..(273): a, c, t, g, unknown or other
  misc_feature (261)..(273): n is a, c, g, or t
tcagactactatgtcacgaccggtgctcgatttagctcgatatagttgggtttgggggaagaggaagactgacggtcctcccaggagttcaggtgctgggcaccttgggcacggggaggtgtgtcacaagatttgggctctgggcaccgtgggcatgggggagtgtgtcacaagatttgggctctgggcacagcggcctgggctgcctggtcaaggactacttccacatagtagtctgagcgggctggcaaggcgcatagnnnnnnnnnnnnn

SEQ ID NO: 187088 - DNA, 267 bp, Homo sapiens
  misc_feature: GYAE6OF01ALXMS.24.57.F02.1.454.CMB.1.raw
  modified_base (263)..(267): a, c, t, g, unknown or other
  misc_feature (263)..(267): n is a, c, g, or t
tcagactactatgtcacgaccggtgctcgatttagctcgatatagttgggtttgggggaagaggaagactgacggtcctcccaggagttcaggtgctgggcaccttgggcacggggaggtgtgtcacaagatttgggctctgggcaccgtgggcatgggggaggtgtgtcacaagatttgggctctgggcacagcggccctgggctgcctggtcaaggactacttccacatagtagtctgagcgggctggcaaggcgcatagnnnnn

SEQ ID NO: 187089 - DNA, 218 bp, Homo sapiens
  misc_feature: GYAE6OF01A5U6O.24.57.F02.1.454.CMB.1.raw
  modified_base (218)..(218): a, c, t, g, unknown or other
  misc_feature (218)..(218): n is a, c, g, or t
tcagactactatgtcacgaccggtgctcgatttagctcgatatagttgggtttgggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagn

SEQ ID NO: 187090 - DNA, 167 bp, Homo sapiens
  misc_feature: GYAE6OF01ADEPV.24.57.F02.1.454.CMB.1.raw
  modified_base (133)..(167): a, c, t, g, unknown or other
  misc_feature (133)..(167): n is a, c, g, or t
tcagactactatgtcacgaccggtgctcgatttagctcgatatagttgggtttgggcacagcggccctgggcctgccgtggtcaaggactaccttccacatagtagtctgagcgggctggcaaggcgcatagnnnnnnnnnnnnnnnnnnnnnnnnnnnnnnnnnnn

SEQ ID NO: 187091 - DNA, 296 bp, Homo sapiens
  misc_feature: GYAE6OF01DAFPO.24.57.F02.1.454.CMB.1.raw
  modified_base (264)..(296): a, c, t, g, unknown or other
  misc_feature (264)..(296): n is a, c, g, or t
tcagactactatgtcacgaccggtgctcgatttagctcgatatagttgggtttggggggaagaggaagactgacggtcctcccaggagttcaggtgctgggcacccttgggcacggggaggtgtgtcgacaagatttggctctgggcaccgtgggcatgggggagtgtgtcacaagatttgggctctgggcacagcggccctgggctgcctggtcaaggactacgttccacatagtagtctgagcggctggcaaggcgcatagnnnnnnnnnnnnnnnnnnnnnnnnnnnnnnnnn

SEQ ID NO: 187092 - DNA, 260 bp, Homo sapiens
  misc_feature: GYAE6OF01A09N1.24.57.F02.1.454.CMB.1.raw
  modified_base (222)..(223): a, c, t, g, unknown or other
  misc_feature (222)..(223): n is a, c, g, or t
  modified_base (225)..(260): a, c, t, g, unknown or other
  misc_feature (225)..(260): n is a, c, g, or t
tcagactactatgtcacgaccggtgctcgatttagctcgatatagttgggttggggaagaggaagactgacggtcctcccaggacgttcgaggtgcttgggcaccttgggcacggggaggtgtgtcacaagatttggggctctgggcacagcggccctgggctgccctggtcaaggactacttccacgatagtagtctgagcgggctggcaaggcgcatagnntnnnnnnnnnnnnnnnnnnnnnnnnnnnnnnnnnnnn

SEQ ID NO: 187093 - DNA, 223 bp, Homo sapiens
  misc_feature: GYAE6OF01DCHKB.24.57.F02.1.454.CMB.1.raw
  modified_base (219)..(223): a, c, t, g, unknown or other
  misc_feature (219)..(223): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggctgcctggtcaaggactacttccacatagtagtctgagcgggctggcaaggcgcatagnnnnn

SEQ ID NO: 187094 - DNA, 130 bp, Homo sapiens; identical to SEQ ID NO: 187066
  misc_feature: GYAE6OF01E4UFQ.24.57.F02.1.454.CMB.1.raw
  modified_base (130)..(130): a, c, t, g, unknown or other
  misc_feature (130)..(130): n is a, c, g, or t

SEQ ID NO: 187095 - DNA, 219 bp, Homo sapiens
  misc_feature: GYAE6OF01BOQY7.24.57.F02.1.454.CMB.1.raw
  modified_base (218)..(219): a, c, t, g, unknown or other
  misc_feature (218)..(219): n is a, c, g, or t
tcagactactatgtcacgaccggtgctcgatttagctcgatatagttgggtttgggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnn

SEQ ID NO: 187096 - DNA, 220 bp, Homo sapiens
  misc_feature: GYAE6OF01EH8L6.24.57.F02.1.454.CMB.1.raw
  modified_base (219)..(220): a, c, t, g, unknown or other
  misc_feature (219)..(220): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggctgcctggtcaaggactacttccacatagtagtctgagcgggctggcaaggcgcatagnn

SEQ ID NO: 187097 - DNA, 265 bp, Homo sapiens
  misc_feature: GYAE6OF01AJQ7Q.24.57.F02.1.454.CMB.1.raw
  modified_base (262)..(265): a, c, t, g, unknown or other
  misc_feature (262)..(265): n is a, c, g, or t
tcagactactatgtcacgaccggtgctcgatttagctcgatatagttgggtttgggggaagaggaagactgacggtcctcccaggagttcaggtgctgggcaccttgggcacggggaggtgtgtcacaagatttgggctctgggcaccgtgggcatggggaggtgtgtcacaagatttgggctctgggcacagcggccctgggctgcctggtcaaggactacttccacatagtagtctgagcgggctggcaaggcgcatagnnnn

SEQ ID NO: 187098 - DNA, 270 bp, Homo sapiens
  misc_feature: GYAE6OF01COIWT.24.57.F02.1.454.CMB.1.raw
  modified_base (264)..(270): a, c, t, g, unknown or other
  misc_feature (264)..(270): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcaccgtgggcatgggggaggtgtgtcacaagatttgggctctgggcacagcggccctgggctgcctggtcaaggactacttccacatagtagtctgagcgggctggcaaggcgcatagnnnnnnn

SEQ ID NO: 187099 - DNA, 129 bp, Homo sapiens
  misc_feature: GYAE6OF01A5PB2.24.57.F02.1.454.CMB.1.raw
tcagactactatgtcacgaccggtgctcgatttagctcgatatagttgggtttgggcacagcggccctgggctgcctggtcaaggactacttcctgtcgagcgtctgagcgggctggcaaggcgcatag

SEQ ID NO: 187100 - DNA, 265 bp, Homo sapiens
  misc_feature: GYAE6OF01D620Y.24.57.F02.1.454.CMB.1.raw
  modified_base (264)..(265): a, c, t, g, unknown or other
  misc_feature (264)..(265): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcaccgtgggcatgggggaggtgtgtcacaagatttgggctctgggcacagcggccctgggctgcctggtcaaggactacttccacatagtagtctgagcgggctggcaaggcgcatagnn

SEQ ID NO: 187101 - DNA, 226 bp, Homo sapiens
  misc_feature: GYAE6OF01AEAZM.24.57.F02.1.454.CMB.1.raw
  modified_base (217)..(226): a, c, t, g, unknown or other
  misc_feature (217)..(226): n is a, c, g, or t
tcagactactatgtcacgaccggtgctcgatttagctcgatatagttgggtttggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnnnnnnnnnn

SEQ ID NO: 187102 - DNA, 242 bp, Homo sapiens
  misc_feature: GYAE6OF01BMH4S.24.57.F02.1.454.CMB.1.raw
  modified_base (134)..(134): a, c, t, g, unknown or other
  misc_feature (134)..(134): n is a, c, g, or t
  modified_base (223)..(242): a, c, t, g, unknown or other
  misc_feature (223)..(242): n is a, c, g, or t
tcagactactatgtcacgaccggtgctcgatttagctcgatatagttgggtttgggggaagaggaagactggacggtcctcccaggagttcaggtgctgggcaccttgggccacgggggaggtgtgtcacaagntttgggctctgggcacagcggccctgggctgcctggtcaaaggctacttccacatagtagtctgaagcgggctggcaaggcgcaatagnnnnnnnnnnnnnnnnnnnn

SEQ ID NO: 187103 - DNA, 221 bp, Homo sapiens; identical to SEQ ID NO: 187070
  misc_feature: GYAE6OF01AO5H0.24.57.F02.1.454.CMB.1.raw
  modified_base (219)..(221): a, c, t, g, unknown or other
  misc_feature (219)..(221): n is a, c, g, or t

SEQ ID NO: 187104 - DNA, 130 bp, Homo sapiens
  misc_feature: GYAE6OF01EIEFE.24.57.F02.1.454.CMB.1.raw
  modified_base (130)..(130): a, c, t, g, unknown or other
  misc_feature (130)..(130): n is a, c, g, or t
tcagactactatgtcacgaccggtgctcgatttagctcgatatagttgggtttgggcacagcggccctgggctgcctggtcaaggactacttccacatagtagtctgagcgggctggcaaggcgcatagn

SEQ ID NO: 187105 - DNA, 221 bp, Homo sapiens; identical to SEQ ID NO: 187070
  misc_feature: GYAE6OF01CC12Q.24.57.F02.1.454.CMB.1.raw
  modified_base (219)..(221): a, c, t, g, unknown or other
  misc_feature (219)..(221): n is a, c, g, or t

SEQ ID NO: 187106 - DNA, 224 bp, Homo sapiens
  misc_feature: GYAE6OF01BRXFJ.24.57.F02.1.454.CMB.1.raw
  modified_base (216)..(224): a, c, t, g, unknown or other
  misc_feature (216)..(224): n is a, c, g, or t
tcagactactatgtcacgaccggtgctcgatttagctcgatatagttgggttggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnnnnnnnnn

SEQ ID NO: 187107 - DNA, 219 bp, Homo sapiens; identical to SEQ ID NO: 187095
  misc_feature: GYAE6OF01EXXDT.24.57.F02.1.454.CMB.1.raw
  modified_base (218)..(219): a, c, t, g, unknown or other
  misc_feature (218)..(219): n is a, c, g, or t

SEQ ID NO: 187108 - DNA, 163 bp, Homo sapiens
  misc_feature: GYAE6OF01EGQH6.24.57.F02.1.454.CMB.1.raw
  modified_base (159)..(163): a, c, t, g, unknown or other
  misc_feature (159)..(163): n is a, c, g, or t
tcagactactatgtcacgaccggtgctcgatttagctcgatatagttgggtttggggaggtgtgtcacaagatttgggctctgggcacagcggccctgggctgcctggtcaaggactacttccacatagtagtctgagcgggctggcaaggcgcatagnnnnn

SEQ ID NO: 187109 - DNA, 266 bp, Homo sapiens
  misc_feature: GYAE6OF01BHMHS.24.57.F02.1.454.CMB.1.raw
  modified_base (262)..(266): a, c, t, g, unknown or other
  misc_feature (262)..(266): n is a, c, g, or t
tcagactactatgtcacgaccggtgctcgatttagctcgatatagttgggtttgggggaagaggaagactgacggtcctcccaggagttcaggtgctgggcaccttgggcacggggaggtgtgtcacaagatttgggctctgggcaccgtgggcatgggggaggtgtgtcacaagatttgggctctgggcacagcggcctgggctgcctggtcaaggactacttccacatagtagtctgagcgggctggcaaggcgcatagnnnnn

SEQ ID NO: 187110 - DNA, 130 bp, Homo sapiens; identical to SEQ ID NO: 187066
  misc_feature: GYAE6OF01AZF73.24.57.F02.1.454.CMB.1.raw
  modified_base (130)..(130): a, c, t, g, unknown or other
  misc_feature (130)..(130): n is a, c, g, or t

SEQ ID NO: 187111 - DNA, 361 bp, Homo sapiens
  misc_feature: GYAE6OF01D9R5K.24.57.F02.1.454.CMB.1.raw
  modified_base (286)..(286): a, c, t, g, unknown or other
  misc_feature (286)..(286): n is a, c, g, or t
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
  modified_base (298)..(300): a, c, t, g, unknown or other
  misc_feature (298)..(300): n is a, c, g, or t
  modified_base (303)..(303): a, c, t, g, unknown or other
  misc_feature (303)..(303): n is a, c, g, or t
  modified_base (305)..(361): a, c, t, g, unknown or other
  misc_feature (305)..(361): n is a, c, g, or t
tcagactactatgtcacgaccggtgctcgatttagctcgatatagttgggtttggggggggaagaggaagactgacggtcctcccaggagttcaggtgcctgggcaccgttgggcgacgggggaggtgtgtccacaagatttgggctctgggcaccggtgggcagtgggggaggtgtgtcacaagatttgggctctgggccacgaggccggccctggggctgcctggtcaaggacctacttccacatagtagtctgagcgggctgggctaagggcgtacaattagntnctgacanacnnnacncnnnnnnnnnnnnnnnnnnnnnnnnnnnnnnnnnnnnnnnnnnnnnnnnnnnnnnnnn

SEQ ID NO: 187112 - DNA, 219 bp, Homo sapiens; identical to SEQ ID NO: 187074
  misc_feature: GYAE6OF01E4QEH.24.57.F02.1.454.CMB.1.raw
  modified_base (219)..(219): a, c, t, g, unknown or other
  misc_feature (219)..(219): n is a, c, g, or t

SEQ ID NO: 187113 - DNA, 135 bp, Homo sapiens
  misc_feature: GYAE6OF01ELSHA.24.57.F02.1.454.CMB.1.raw
  modified_base (130)..(135): a, c, t, g, unknown or other
  misc_feature (130)..(135): n is a, c, g, or t
tcagactactatgtcacgaccggtgctcgatttagctcgatatagttgggtttgggcacagcggccctgggctgcctggtcaaggactacttcctgtcgagcgtctgagcgggctggcaaggcgcatagnnnnnn

SEQ ID NO: 187114 - DNA, 270 bp, Homo sapiens
  misc_feature: GYAE6OF01CRN0P.24.57.F02.1.454.CMB.1.raw
  modified_base (264)..(270): a, c, t, g, unknown or other
  misc_feature (264)..(270): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcaccgtgggcagtgggggaggtgtgtcacaagatttgggctctgggcacagcggccctgggctgcctggtcaaggctacttccacatagtagtctgagcgggctggcaaggcgcatagnnnnnnn

SEQ ID NO: 187115 - DNA, 225 bp, Homo sapiens
  misc_feature: GYAE6OF01EZFNY.24.57.F02.1.454.CMB.1.raw
  modified_base (219)..(225): a, c, t, g, unknown or other
  misc_feature (219)..(225): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggctgcctggtcaaggactacttccacatagtagtctgagcgggctggcaaggcgcatagnnnnnnn

SEQ ID NO: 187116 - DNA, 239 bp, Homo sapiens
  misc_feature: GYAE6OF01BAAXW.24.57.F02.1.454.CMB.1.raw
  modified_base (234)..(239): a, c, t, g, unknown or other
  misc_feature (234)..(239): n is a, c, g, or t
tcagactactatgtcacgaccggtgctcgatttagctcgatatagttgggtttggggaagtagtccttggccagggatccctggtcaccgtctcctcagcttccaccaagggcccatcggtcatccccctggcgccctgctccaggagcacctctgggggcacagcggccctgggctgcctggtcaaggactacttccacatagtagtctgagcgggctggcaaggcgcatagnnnnnn

SEQ ID NO: 187117 - DNA, 223 bp, Homo sapiens; identical to SEQ ID NO: 187093
  misc_feature: GYAE6OF01DFRBS.24.57.F02.1.454.CMB.1.raw
  modified_base (219)..(223): a, c, t, g, unknown or other
  misc_feature (219)..(223): n is a, c, g, or t

SEQ ID NO: 187118 - DNA, 268 bp, Homo sapiens
  misc_feature: GYAE6OF01AOKZ2.24.57.F02.1.454.CMB.1.raw
  modified_base (263)..(268): a, c, t, g, unknown or other
  misc_feature (263)..(268): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctggcaccgtgggcatgggggaggtgtgtcacaagatttgggctctgggcacagcggccctgggctgcctggtcaaggactacttccacatagtagtctgagcgggctggcaaggcgcatagnnnnnn

SEQ ID NO: 187119 - DNA, 167 bp, Homo sapiens
  misc_feature: GYAE6OF01AZGQJ.24.57.F02.1.454.CMB.1.raw
  modified_base (111)..(111): a, c, t, g, unknown or other
  misc_feature (111)..(111): n is a, c, g, or t
  modified_base (134)..(167): a, c, t, g, unknown or other
  misc_feature (134)..(167): n is a, c, g, or t
tcagactactatgtcacgaccggtgctcgatttagctcgatatagttgggtttggggcacagcggccctgggctgcctgggtcaaggactacttcctgtcgagcgtctgancgggctggccaaggcgcataggnnnnnnnnnnnnnnnnnnnnnnnnnnnnnnnnnn

SEQ ID NO: 187120 - DNA, 273 bp, Homo sapiens
  misc_feature: GYAE6OF01BTO6X.24.57.F02.1.454.CMB.1.raw
  modified_base (267)..(273): a, c, t, g, unknown or other
  misc_feature (267)..(273): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctggggcaccggtgggcagtgggggaggtgtgtcacaagatttgggctctgggcacagcggccctgggctgcctggtcaaggactacttccacatagtagtctgagcgggctggcaaggcgcatagnnnnnnn

SEQ ID NO: 187121 - DNA, 220 bp, Homo sapiens
  misc_feature: GYAE6OF01BMOTR.24.57.F02.1.454.CMB.1.raw
  modified_base (220)..(220): a, c, t, g, unknown or other
  misc_feature (220)..(220): n is a, c, g, or t
tcagactactatgtcacgaccggtgctcgatttagctcgatatagttgggtttggggggaagaggaagactgacggtcctcccaggagttcaggtgctgggcaccttgggcacgggggaggtgtgtcacaagatttgggctctgggcacagcggccctgggctgcctggtcaaggactacttccacatagtagtctgagcgggctggcaaggcgcatagn

SEQ ID NO: 187122 - DNA, 235 bp, Homo sapiens
  misc_feature: GYAE6OF01ER4SD.24.57.F02.1.454.CMB.1.raw
  modified_base (232)..(235): a, c, t, g, unknown or other
  misc_feature (232)..(235): n is a, c, g, or t
tcagactactatgtcacgaccggtgctcgatttagctcgatatagttgggtttggggaagtagtccttggccagggatccctggtcaccgtctcctcagcttccaccaagggcccatcggtcttcccctggcgccctgctccaggagcacctctgggggcacagcggccctgggctgcctggtcaaggactacttcccatagtagtctgagcgggctggcaaggcgcatagnnnn

SEQ ID NO: 187123 - DNA, 130 bp, Homo sapiens; identical to SEQ ID NO: 187066
  misc_feature: GYAE6OF01BA5BN.24.57.F02.1.454.CMB.1.raw
  modified_base (130)..(130): a, c, t, g, unknown or other
  misc_feature (130)..(130): n is a, c, g, or t

SEQ ID NO: 187124 - DNA, 269 bp, Homo sapiens
  misc_feature: GYAE6OF01DHILS.24.57.F02.1.454.CMB.1.raw
  modified_base (264)..(269): a, c, t, g, unknown or other
  misc_feature (264)..(269): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcaccgtgggcatgggggaggtgtgtcacaagatttgggctctgggcacagcggccctgggctgcctggtcaaggactacttccacatagtagtctgagcgggctggcaaggcgcatagnnnnnn

SEQ ID NO: 187125 - DNA, 222 bp, Homo sapiens; identical to SEQ ID NO: 187083
  misc_feature: GYAE6OF01DSURV.24.57.F02.1.454.CMB.1.raw
  modified_base (218)..(222): a, c, t, g, unknown or other
  misc_feature (218)..(222): n is a, c, g, or t

SEQ ID NO: 187126 - DNA, 228 bp, Homo sapiens
  misc_feature: GYAE6OF01CDMXD.24.57.F02.1.454.CMB.1.raw
  modified_base (223)..(228): a, c, t, g, unknown or other
  misc_feature (223)..(228): n is a, c, g, or t
tcagactactatgtcacgaccggtgctcgatttagctcgatatagttgggtttggggggaagaggaagactgacggtcctcccaggagttcaggttctgggcaccttgggccacgggggagtgtgtcacaagtatttgggctctgggcacagccggccctgggctgcctggtcaaggactacttccacatagtagtctgagcgggctggcaaaggcgcatagnnnnnn

SEQ ID NO: 187127 - DNA, 219 bp, Homo sapiens; identical to SEQ ID NO: 187074
  misc_feature: GYAE6OF01C74YL.24.57.F02.1.454.CMB.1.raw
  modified_base (219)..(219): a, c, t, g, unknown or other
  misc_feature (219)..(219): n is a, c, g, or t

SEQ ID NO: 187128 - DNA, 223 bp, Homo sapiens
  misc_feature: GYAE6OF01DPLIO.24.57.F02.1.454.CMB.1.raw
  modified_base (220)..(223): a, c, t, g, unknown or other
  misc_feature (220)..(223): n is a, c, g, or t
tcagactactatgtcacgaccggtgctcgatttagctcgatatagttgggtttggggggaagaggaagactgacggtcctcccaggagttcaggtgctgggcaccttgggcacgggggaggtgtgtcacaagatttgggctctgggcacagcggccctgggctgcctggtcaaggactacttccacatagtagtctgagcgggctggcaaggcgcatagnnnn

SEQ ID NO: 187129 - DNA, 225 bp, Homo sapiens; identical to SEQ ID NO: 187115
  misc_feature: GYAE6OF01DPNCS.24.57.F02.1.454.CMB.1.raw
  modified_base (219)..(225): a, c, t, g, unknown or other
  misc_feature (219)..(225): n is a, c, g, or t

SEQ ID NO: 187130 - DNA, 218 bp, Homo sapiens
  misc_feature: GYAE6OF01AW9XM.24.57.F02.1.454.CMB.1.raw
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctggggtgcctggtcaaggactacttccacatagtagtctgagcgggctggcaaggcgcatag

SEQ ID NO: 187131 - DNA, 130 bp, Homo sapiens; identical to SEQ ID NO: 187066
  misc_feature: GYAE6OF01E1PKG.24.57.F02.1.454.CMB.1.raw
  modified_base (130)..(130): a, c, t, g, unknown or other
  misc_feature (130)..(130): n is a, c, g, or t

SEQ ID NO: 187132 - DNA, 181 bp, Homo sapiens
  misc_feature: GYAE6OF01DRM68.24.57.F02.1.454.CMB.1.raw
  modified_base (180)..(181): a, c, t, g, unknown or other
  misc_feature (180)..(181): n is a, c, g, or t
tcagactactatgtcacgaccggtgctcgatttagctcgatatagttgggtttggctctgggcaccgtgggcacgggggaggtgtgtcacaagatttgggctctggcacagcggccctgggctgcctggtcaaggactacttccacatagtagtctgagcgggctggcaaggcgcatagnn

SEQ ID NO: 187133 - DNA, 599 bp, Homo sapiens
  misc_feature: GYAE6OF01D47KI.24.57.F02.1.454.CMB.1.raw
  modified_base (242)..(243): a, c, t, g, unknown or other
  misc_feature (242)..(243): n is a, c, g, or t
  modified_base (245)..(245): a, c, t, g, unknown or other
  misc_feature (245)..(245): n is a, c, g, or t
  modified_base (248)..(248): a, c, t, g, unknown or other
  misc_feature (248)..(248): n is a, c, g, or t
  modified_base (252)..(252): a, c, t, g, unknown or other
  misc_feature (252)..(252): n is a, c, g, or t
  modified_base (284)..(284): a, c, t, g, unknown or other
  misc_feature (284)..(284): n is a, c, g, or t
  modified_base (287)..(287): a, c, t, g, unknown or other
  misc_feature (287)..(287): n is a, c, g, or t
  modified_base (295)..(295): a, c, t, g, unknown or other
  misc_feature (295)..(295): n is a, c, g, or t
  modified_base (327)..(327): a, c, t, g, unknown or other
  misc_feature (327)..(327): n is a, c, g, or t
  modified_base (349)..(349): a, c, t, g, unknown or other
  misc_feature (349)..(349): n is a, c, g, or t
  modified_base (363)..(363): a, c, t, g, unknown or other
  misc_feature (363)..(363): n is a, c, g, or t
tcagactactatgtcacgaccggtgctcgatttagctcgatatagttggggtttgggggggaagaggaagactgacggtcctccaggtaggttccaggtggactgggcgaacccttgggcacggggaggtgttgtctacacgatttggctctgggcacagcggcctcgggctagtctggtcaacggactacttccacatacgtacgtctgagtcgggctcggacgaaaggcgccactacgcnncngcngcanctacacacgtctctcgctgaccagcagagccngcnggcaaccncgctctctctcgtgtcgcgtcgacgacgcacncgcacacacgacgtacgtacgngcgcgtgtcgtcgngacgacgtactactctcacacactacgacgacacgtacgtacgaccccgtacgtagtagtagtacgtacgtatattactacgtactactactactaagtactacgacgacgtacgtacggtacggtcgggtacggtaccggtaaccgggtaacgggtaacggtaacggtaaacggtaaacgtaacgaacggtaacgtacggtacgtacgtaccgacctaacctacgttcgtcgttc

SEQ ID NO: 187134 - DNA, 223 bp, Homo sapiens; identical to SEQ ID NO: 187093
  misc_feature: GYAE6OF01DF9WY.24.57.F02.1.454.CMB.1.raw
  modified_base (219)..(223): a, c, t, g, unknown or other
  misc_feature (219)..(223): n is a, c, g, or t

SEQ ID NO: 187135 - DNA, 225 bp, Homo sapiens
  misc_feature: GYAE6OF01EBGSH.24.57.F02.1.454.CMB.1.raw
  modified_base (220)..(225): a, c, t, g, unknown or other
  misc_feature (220)..(225): n is a, c, g, or t
tcagactactatgtcacgaccggtgctcgatttagctcgatatagttgggtttggggggaagaggaagactgacggtcctcccaggagttcgggtgctgggcaccttgggcacgggggaggtgtgtcacaagatttgtgctctgggcacagcggccctgggctgcctggtcaaggactacttccacatagtagtctgagcgggctggcaaggcgcatagnnnnnn

SEQ ID NO: 187136 - DNA, 160 bp, Homo sapiens
  misc_feature: GYAE6OF01EZOLG.24.57.F02.1.454.CMB.1.raw
  modified_base (159)..(160): a, c, t, g, unknown or other
  misc_feature (159)..(160): n is a, c, g, or t
tcagactactatgtcacgaccggtgctcgatttagctcgatatagttgggtttggggaggtgtgtcacaagatttgggctctgggcacagcggccctgggctgcctggtcaaggactacttccacatagtagtctgagcgggctggcaaggcgcatagnn

SEQ ID NO: 187137 - DNA, 137 bp, Homo sapiens
  misc_feature: GYAE6OF01DM447.24.57.F02.1.454.CMB.1.raw
  modified_base (123)..(123): a, c, t, g, unknown or other
  misc_feature (123)..(123): n is a, c, g, or t
  modified_base (129)..(137): a, c, t, g, unknown or other
  misc_feature (129)..(137): n is a, c, g, or t
tcagactactatgtcacgaccggtgctcgatttagctcgatatagttgggttgggcacagcggccctgggctgcctggtcaaggactacttcctgtcgagcgtctgagcgggctggcaaggcncatagnnnnnnnnn

SEQ ID NO: 187138 - DNA, 282 bp, Homo sapiens
  misc_feature: GYAE6OF01CUQKL.24.57.F02.1.454.CMB.1.raw
  modified_base (267)..(267): a, c, t, g, unknown or other
  misc_feature (267)..(267): n is a, c, g, or t
  modified_base (272)..(282): a, c, t, g, unknown or other
  misc_feature (272)..(282): n is a, c, g, or t
tcagactactatgtcacgaccggtgctcgatttagctcgatatagttgggtttgggggaagaggaagactgacggtcctcccaggagttcaggtgctgggcaccgttgggcacgggggaggtgtgtcacaagatttgggctctgggcaccggtgggcagtgggggagtgtgtcacaagatttgggctctgggcacaggccggccctgggctgccgtggtcaaggctacttccacatagtagtcgtgagcgggctggacaaggccgtnatagnnnnnnnnnnn

SEQ ID NO: 187139 - DNA, 268 bp, Homo sapiens
  misc_feature: GYAE6OF01D1ZH3.24.57.F02.1.454.CMB.1.raw
  modified_base (259)..(259): a, c, t, g, unknown or other
  misc_feature (259)..(259): n is a, c, g, or t
  modified_base (265)..(268): a, c, t, g, unknown or other
  misc_feature (265)..(268): n is a, c, g, or t
tcagactactatgtcacgaccggtgctcgatttagctcgatatagttgggtttggggggaagaggaagactgacggtcctcccaggagttcaggtgctgggcaccttgggcacgggggaggtgtgtcacaagatttgggctctgggcaccgtgggcagtgggggaggtgtgtcacaagatttgggctctgggcacagcggccctgggctgcctggtcaaggactacttcacatagtagtctgagcgggctggcaaggcncatagnnnn

SEQ ID NO: 187140 - DNA, 162 bp, Homo sapiens
  misc_feature: GYAE6OF01CY415.24.57.F02.1.454.CMB.1.raw
  modified_base (160)..(162): a, c, t, g, unknown or other
  misc_feature (160)..(162): n is a, c, g, or t
tcagactactatgtcacgaccggtgctcgatttagctcgatatagttgggtttgggggaggtgtgtcacaagatttgggctctgggcacagcggccctgggctgcctggtcaaggactacttccacatagtagtctgagcgggctggcaaggcgcatagnnn

SEQ ID NO: 187141 - DNA, 232 bp, Homo sapiens
  misc_feature: GYAE6OF01CLCKF.24.57.F02.1.454.CMB.1.raw
  modified_base (189)..(189): a, c, t, g, unknown or other
  misc_feature (189)..(189): n is a, c, g, or t
  modified_base (225)..(232): a, c, t, g, unknown or other
  misc_feature (225)..(232): n is a, c, g, or t
tcagactactatgtcacgaccggtgctcgatttagctcgatatagttgggtttgggggaagaggaagactgacggtcctcccaggagttcaggtgctgggcaccttgggcgacgggggaggtgtgtcaacaagtatttgggctcgtgggcacagcggccctgggctgcctggtcaaggtctacttccanatagtagtctggagcgggctggcaaggcgacatagnnnnnnnn

SEQ ID NO: 187142 - DNA, 224 bp, Homo sapiens; identical to SEQ ID NO: 187086
  misc_feature: GYAE6OF01CRHOM.24.57.F02.1.454.CMB.1.raw
  modified_base (219)..(224): a, c, t, g, unknown or other
  misc_feature (219)..(224): n is a, c, g, or t

SEQ ID NO: 187143 - DNA, 226 bp, Homo sapiens
  misc_feature: GYAE6OF01CTTIR.24.57.F02.1.454.CMB.1.raw
  modified_base (220)..(226): a, c, t, g, unknown or other
  misc_feature (220)..(226): n is a, c, g, or t
tcagactactatgtcacgaccggtgctcgatttagctcgatatagttgggtttgggggaagaggaagactgacggtcctcccaggagttcaggtgctgggcaccttgggcgacgggggaggtgtgtcacaagatttgggctctgggcacagcggccctgggctgcctggtcaaggactacttccacatagtagtctgagcgggctggcaaggcgcatagnnnnnnn

SEQ ID NO: 187144 - DNA, 219 bp, Homo sapiens; identical to SEQ ID NO: 187074
  misc_feature: GYAE6OF01CHBJJ.24.57.F02.1.454.CMB.1.raw
  modified_base (219)..(219): a, c, t, g, unknown or other
  misc_feature (219)..(219): n is a, c, g, or t

SEQ ID NO: 187145 - DNA, 272 bp, Homo sapiens
  misc_feature: GYAE6OF01B9VYW.24.57.F02.1.454.CMB.1.raw
  modified_base (264)..(272): a, c, t, g, unknown or other
  misc_feature (264)..(272): n is a, c, g, or t
tcagactactatgtcacgaccggtgctcgatttagctcgatatagttgggtttggggggaagaggaagactgacggtcctcccaggagttcaggtgctgggcaccttgggcacgggggaggtgtgtcacaagatttgggctctgggcaccgtgggcatgggggagtgtgtcacaagatttgggctctgggcacagcggccctgggctgcctggtcaaggactacttccacatagtagtctgagcgggctggcaaggcgcatagnnnnnnnnn

SEQ ID NO: 187146 - DNA, 229 bp, Homo sapiens
  misc_feature: GYAE6OF01EEYLI.24.57.F02.1.454.CMB.1.raw
  modified_base (218)..(229): a, c, t, g, unknown or other
  misc_feature (218)..(229): n is a, c, g, or t
tcagactactatgtcacgaccggtgctcgatttagctcgatatagttgggtttggggggaagaggaagactgacggtcctcccaggagttcaggtgctgggcaccttgggcacgggggaggtgtgtcacaagatttgggctctgggcacagcggcctgggctgcctggtcaaggctacttccacatagtagtctgagcgggctggcaaggcgcatagnnnnnnnnnnnn

SEQ ID NO: 187147 - DNA, 223 bp, Homo sapiens
  misc_feature: GYAE6OF01EQ0SC.24.57.F02.1.454.CMB.1.raw
  modified_base (220)..(223): a, c, t, g, unknown or other
  misc_feature (220)..(223): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggctgcctggtcaaggactacttccacatagttagtctgagcgggctggcaaggcgcatagnnnn

SEQ ID NO: 187148 - DNA, 279 bp, Homo sapiens
  misc_feature: GYAE6OF01CJM9C.24.57.F02.1.454.CMB.1.raw
  modified_base (238)..(238): a, c, t, g, unknown or other
  misc_feature (238)..(238): n is a, c, g, or t
  modified_base (267)..(267): a, c, t, g, unknown or other
  misc_feature (267)..(267): n is a, c, g, or t
  modified_base (271)..(279): a, c, t, g, unknown or other
  misc_feature (271)..(279): n is a, c, g, or t
tcagactactatgtcacgaccggtgctcgatttagctcgatatagttgggtttggggggaagaggaagactgacggtcctcccaggagttcaggtgctgggcaccttgggcgacgggggaggtgtgtcacaagatttgggctcgtgggccaccggtgggcagtgggggaggtgtgtcacaagagtttgggctcgtgggcacagcggccctgggctgcctaggtcaaggctacttccanatagtagtctgagcggctggcaaggccgnatgnnnnnnnnn

SEQ ID NO: 187149 - DNA, 301 bp, Homo sapiens
  misc_feature: GYAE6OF01D8B99.24.57.F02.1.454.CMB.1.raw
  modified_base (238)..(239): a, c, t, g, unknown or other
  misc_feature (238)..(239): n is a, c, g, or t
  modified_base (243)..(301): a, c, t, g, unknown or other
  misc_feature (243)..(301): n is a, c, g, or t
tcagactactatgtcacgaccggtgctcgatttagctcgatatagtttgggtttggggggaagaggaagactgacggtcctcccaggagttcaggtgctgggcaccgttggggcacggggggaggtgtgtcaacaagatttgggctctggggcacagcggccctgggctgcctggtcaaaggactacttccacattagtagtctggacgcgggtctgggacaaaggcgacaagtagcnncatnnnnnnnnnnnnnnnnnnnnnnnnnnnnnnnnnnnnnnnnnnnnnnnnnnnnnnnnnnn

SEQ ID NO: 187150 - DNA, 223 bp, Homo sapiens
  misc_feature: GYAE6OF01COC1G.24.57.F02.1.454.CMB.1.raw
  modified_base (184)..(184): a, c, t, g, unknown or other
  misc_feature (184)..(184): n is a, c, g, or t
  modified_base (213)..(213): a, c, t, g, unknown or other
  misc_feature (213)..(213): n is a, c, g, or t
  modified_base (219)..(223): a, c, t, g, unknown or other
  misc_feature (219)..(223): n is a, c, g, or t
tcagactactatgtcacgaccggtgctcgatttagctcgatatagttgggtttgggggaagaggaagactgacggtcctcccaggagttcaggtgctgggcaccttgggcgacgggggaggtgtgtcacaagatttgggctctgggcacagcggccctgggctgcctggtcaaggctactccanatagtatctgagcgggtctggcaaaggcncatagnnnnn

SEQ ID NO: 187151 - DNA, 231 bp, Homo sapiens
  misc_feature: GYAE6OF01CJB6L.24.57.F02.1.454.CMB.1.raw
  modified_base (220)..(231): a, c, t, g, unknown or other
  misc_feature (220)..(231): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggctgcctggtcaaggctacttccacagtagtagtctgagcgggctggcaaggcgcagtagnnnnnnnnnnnn

SEQ ID NO: 187152 - DNA, 193 bp, Homo sapiens
  misc_feature: GYAE6OF01BNEKI.24.57.F02.1.454.CMB.1.raw
  modified_base (145)..(145): a, c, t, g, unknown or other
  misc_feature (145)..(145): n is a, c, g, or t
  modified_base (173)..(173): a, c, t, g, unknown or other
  misc_feature (173)..(173): n is a, c, g, or t
  modified_base (179)..(193): a, c, t, g, unknown or other
  misc_feature (179)..(193): n is a, c, g, or t
tcagactactatgtcacgaccggtgctcgatttagctcgatatagttgggtttggctctgggcaccgtgggcacgggggagtgtgtcacaagatttgggctctgggcacagcggccctgggctgcctggtcaaggctacttccanatagtagtctgagcgggctggcaaggcncatagnnnnnnnnnnnnnnn

SEQ ID NO: 187153 - DNA, 333 bp, Homo sapiens
  misc_feature: GYAE6OF01BZVLE.24.57.F02.1.454.CMB.1.raw
  modified_base (268)..(268): a, c, t, g, unknown or other
  misc_feature (268)..(268): n is a, c, g, or t
  modified_base (299)..(333): a, c, t, g, unknown or other
  misc_feature (299)..(333): n is a, c, g, or t
tcagactactatgtcacgaccggtgctcgatttagctcgatatagttgggtttggggggaagaggaagactgacggtcctcccaggagttcaggtgctgggcaccttgggcacgggggaggtgtgtcacaagattgggtcgtcctgggcgaccgtgggcgagtggggggagggtggtggttcacgaagaagtttggggtcgtctgggcgacacggccggcccgtgggcgtcgccgtggtcgaaggactacttccacatagtagtctgnggaaaacggcgtcggacgaggcgacagtagnnnnnnnnnnnnnnnnnnnnnnnnnnnnnnnnnnn

SEQ ID NO: 187154 - DNA, 260 bp, Homo sapiens
  misc_feature: GYAE6OF01BO1RZ.24.57.F02.1.454.CMB.1.raw
  modified_base (186)..(186): a, c, t, g, unknown or other
  misc_feature (186)..(186): n is a, c, g, or t
  modified_base (221)..(260): a, c, t, g, unknown or other
  misc_feature (221)..(260): n is a, c, g, or t
tcagactactatgtcacgaccggtgctcgatttagctcgatatagttgggtttggggggaagaggaagactgacggtcctcccaggagttcaggtgctgggcaccttgggcacgggggaggtgtgtcacaagatttgggctctgggcacgagcggccctgggctgcctggcaaggactacttccanatagtagtctgagcgggctggacaaggcacatagnnnnnnnnnnnnnnnnnnnnnnnnnnnnnnnnnnnnnnnn

SEQ ID NO: 187155 - DNA, 233 bp, Homo sapiens
  misc_feature: GYAE6OF01D9LW9.24.57.F02.1.454.CMB.1.raw
  modified_base (186)..(186): a, c, t, g, unknown or other
  misc_feature (186)..(186): n is a, c, g, or t
  modified_base (216)..(216): a, c, t, g, unknown or other
  misc_feature (216)..(216): n is a, c, g, or t
  modified_base (222)..(233): a, c, t, g, unknown or other
  misc_feature (222)..(233): n is a, c, g, or t
tcagactactatgtcacgaccggtgctcgatttagctcgatatagttgggtttggggggaagaggaagactgacggtcctcccaggagttcaggtgctgggcaccgttgggcacgggggaggtgtgtcacaagatttgggctctgggcaacagcggcctgggctgcctggtcaaggctacttccanatagtagtctgacgcgggctggcaagggcncaatgnnnnnnnnnnnn

SEQ ID NO: 187156 - DNA, 231 bp, Homo sapiens
  misc_feature: GYAE6OF01CKYI6.24.57.F02.1.454.CMB.1.raw
  modified_base (220)..(231): a, c, t, g, unknown or other
  misc_feature (220)..(231): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggctgcctggtcaaggactacttccacatagtagtctgagcgggctggcaaggcgacatagnnnnnnnnnnnn

SEQ ID NO: 187157 - DNA, 219 bp, Homo sapiens
  misc_feature: GYAE6OF02G2F3Q.24.57.F02.1.454.CMB.1.raw
  modified_base (216)..(219): a, c, t, g, unknown or other
  misc_feature (216)..(219): n is a, c, g, or t
tcagactactatgtcacgaccggtgctcgatttagctcgatatagttgggtttgggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnnnn

SEQ ID NO: 187158 - DNA, 129 bp, Homo sapiens
  misc_feature: GYAE6OF02G3RQP.24.57.F02.1.454.CMB.1.raw
  modified_base (129)..(129): a, c, t, g, unknown or other
  misc_feature (129)..(129): n is a, c, g, or t
tcagactactatgtcacgaccggtgctcgatttagctcgatatagttgggttgggcacagcggccctgggctgcctggtcaaggactacttccacatagtagtctgagcgggctggcaaggcgcatagn

SEQ ID NO: 187159 - DNA, 218 bp, Homo sapiens; identical to SEQ ID NO: 187060
  misc_feature: GYAE6OF02HK5U7.24.57.F02.1.454.CMB.1.raw
  modified_base (217)..(218): a, c, t, g, unknown or other
  misc_feature (217)..(218): n is a, c, g, or t

SEQ ID NO: 187160 - DNA, 130 bp, Homo sapiens
  misc_feature: GYAE6OF02FRDTM.24.57.F02.1.454.CMB.1.raw
  modified_base (130)..(130): a, c, t, g, unknown or other
  misc_feature (130)..(130): n is a, c, g, or t
tcagactactatgtcacgaccggtgctcgatttagctcgatatagttgggtttgggcacagcggccctgggctgactggtcaaggactacttcctgtcgagcgtctgagcgggctggcaaggcgcatagn

SEQ ID NO: 187161 - DNA, 130 bp, Homo sapiens
  misc_feature: GYAE6OF02HJ3DN.24.57.F02.1.454.CMB.1.raw
  modified_base (128)..(130): a, c, t, g, unknown or other
  misc_feature (128)..(130): n is a, c, g, or t
tcagactactatgtcacgaccggtgctcgatttagctcgatatagttgggttggcacagcggccctgggctgcctggtcaaggactacttccacatagtagtctgagcgggctggcaaggcgcatagnnn

SEQ ID NO: 187162 - DNA, 130 bp, Homo sapiens; identical to SEQ ID NO: 187066
  misc_feature: GYAE6OF02GWSW0.24.57.F02.1.454.CMB.1.raw
  modified_base (130)..(130): a, c, t, g, unknown or other
  misc_feature (130)..(130): n is a, c, g, or t

SEQ ID NO: 187163 - DNA, 219 bp, Homo sapiens; identical to SEQ ID NO: 187095
  misc_feature: GYAE6OF02IZ4FK.24.57.F02.1.454.CMB.1.raw
  modified_base (218)..(219): a, c, t, g, unknown or other
  misc_feature (218)..(219): n is a, c, g, or t

SEQ ID NO: 187164 - DNA, 275 bp, Homo sapiens
  misc_feature: GYAE6OF02IEH9H.24.57.F02.1.454.CMB.1.raw
  modified_base (230)..(275): a, c, t, g, unknown or other
  misc_feature (230)..(275): n is a, c, g, or t
tcagactactatgtcacgaccggtgctcgatttagctcgatataggttaggggtttgggggaacgaggaagactggacggtcctcccaggagttcaggtgctgggcaccttgggcacgggggaggtgtgtcacaagatttgggctctgggcacagcggccctgggctggcctggtcaaggactacgttccacatagtagtcctgagcgggctgggcaaggcgcgataggnnnnnnnnnnnnnnnnnnnnnnnnnnnnnnnnnnnnnnnnnnnnnn

SEQ ID NO: 187165 - DNA, 264 bp, Homo sapiens
  misc_feature: GYAE6OF02I9EGT.24.57.F02.1.454.CMB.1.raw
  modified_base (262)..(264): a, c, t, g, unknown or other
  misc_feature (262)..(264): n is a, c, g, or t
tcagactactatgtcacgaccggtgctcgatttagctcgatatagttgggtttgggggaagaggaagactgacggtcctcccaggagttcaggtgctgggcaccttgggcacggggaggtgtgtcacaagatttgggctctgggcaccgtgggcatggggaggtgtgtcacaagatttgggctctgggcacagcggccctgggctgcctggtcaaggactacttccacatagtagtctgagcgggctggcaaggcgcatagnnn

SEQ ID NO: 187166 - DNA, 220 bp, Homo sapiens
  misc_feature: GYAE6OF02I06OP.24.57.F02.1.454.CMB.1.raw
  modified_base (217)..(220): a, c, t, g, unknown or other
  misc_feature (217)..(220): n is a, c, g, or t
tcagactactatgtcacgaccggtgctcgatttagctcgatatagttgggtttggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnnnn

SEQ ID NO: 187167 - DNA, 219 bp, Homo sapiens
  misc_feature: GYAE6OF02JAM7F.24.57.F02.1.454.CMB.1.raw
  modified_base (217)..(219): a, c, t, g, unknown or other
  misc_feature (217)..(219): n is a, c, g, or t
tcagactactatgtcacgaccggtgctcgatttagctcgatatagttgggtttggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnnn

SEQ ID NO: 187168 - DNA, 135 bp, Homo sapiens; identical to SEQ ID NO: 187113
  misc_feature: GYAE6OF02IDTIW.24.57.F02.1.454.CMB.1.raw
  modified_base (130)..(135): a, c, t, g, unknown or other
  misc_feature (130)..(135): n is a, c, g, or t

SEQ ID NO: 187169 - DNA, 221 bp, Homo sapiens
  misc_feature: GYAE6OF02I9NSG.24.57.F02.1.454.CMB.1.raw
  modified_base (218)..(221): a, c, t, g, unknown or other
  misc_feature (218)..(221): n is a, c, g, or t
tcagactactatgtcacgaccggtgctcgatttagctcgatatagttgggtttgggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnnnn

SEQ ID NO: 187170 - DNA, 218 bp, Homo sapiens; identical to SEQ ID NO: 187089
  misc_feature: GYAE6OF02IKEIR.24.57.F02.1.454.CMB.1.raw
  modified_base (218)..(218): a, c, t, g, unknown or other
  misc_feature (218)..(218): n is a, c, g, or t

SEQ ID NO: 187171 - DNA, 263 bp, Homo sapiens
  misc_feature: GYAE6OF02FIGT9.24.57.F02.1.454.CMB.1.raw
  modified_base (261)..(263): a, c, t, g, unknown or other
  misc_feature (261)..(263): n is a, c, g, or t
tcagactactatgtcacgaccggtgctcgatttagctcgatatagttgggtttggggaagaggaagactgacggtcctcccaggagttcaggtgctgggcaccttgggcacggggaggtgtgtcacaagatttgggctctgggcaccgtgggcatggggaggtgtgtcacaagatttgggctctgggcacagcggccctgggctgcctggtcaaggactacttccacatagtagtctgagcgggctggcaaggcgcatagnnn

SEQ ID NO: 187172 - DNA, 234 bp, Homo sapiens
  misc_feature: GYAE6OF02FKOUM.24.57.F02.1.454.CMB.1.raw
  modified_base (220)..(234): a, c, t, g, unknown or other
  misc_feature (220)..(234): n is a, c, g, or t
tcagactactatgtcacgaccggtgctcgatttagctcgatatagttgggtttgggggaagaggaagactgacggtcctcccaggagttcaggtgctcgggcaccttgggcacggggaggtgtgtcacaagatttgggctctgggcacagcggccctgggctgcctggtcaaggactacttccacatacgtagtctgagcgggctggcaaggcgcatagnnnnnnnnnnnnnnn

SEQ ID NO: 187173 - DNA, 220 bp, Homo sapiens; identical to SEQ ID NO: 187056
  misc_feature: GYAE6OF02IGIZS.24.57.F02.1.454.CMB.1.raw
  modified_base (218)..(220): a, c, t, g, unknown or other
  misc_feature (218)..(220): n is a, c, g, or t

SEQ ID NO: 187174 - DNA, 228 bp, Homo sapiens
  misc_feature: GYAE6OF02I4CZF.24.57.F02.1.454.CMB.1.raw
  modified_base (220)..(228): a, c, t, g, unknown or other
  misc_feature (220)..(228): n is a, c, g, or t
tcagactactatgtcacgaccggtgctcgatttagctcgatatagttgggtttgggggtaaggaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnnnnnnnnn

SEQ ID NO: 187175 - DNA, 237 bp, Homo sapiens
  misc_feature: GYAE6OF02F97J6.24.57.F02.1.454.CMB.1.raw
  modified_base (218)..(237): a, c, t, g, unknown or other
  misc_feature (218)..(237): n is a, c, g, or t
tcagactactatgtcacgaccggtgctcgatttagctcgatatagttgggtttgggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnnnnnnnnnnnnnnnnnnnn

SEQ ID NO: 187176 - DNA, 159 bp, Homo sapiens
  misc_feature: GYAE6OF02I4LQY.24.57.F02.1.454.CMB.1.raw
  modified_base (158)..(159): a, c, t, g, unknown or other
  misc_feature (158)..(159): n is a, c, g, or t
tcagactactatgtcacgaccggtgctcgatttagctcgatatagttgggtttgggaggtgtgtcacaagatttgggctctgggcacagcggccctgggctgcctggtcaaggactacttccacatagtagtctgagcgggctggcaaggcgcatagnn

SEQ ID NO: 187177 - DNA, 266 bp, Homo sapiens
  misc_feature: GYAE6OF02HDIT3.24.57.F02.1.454.CMB.1.raw
  modified_base (262)..(266): a, c, t, g, unknown or other
  misc_feature (262)..(266): n is a, c, g, or t
tcagactactatgtcacgaccggtgctcgatttagctcgatatagttgggtttgggggaagaggaagactgacggtcctcccaggagttcaggtgctgggcaccttgggcacggggaggtgtgtcacaagatttgggctctgggcaccgtgggcatggggaggtgtgtcacaagatttgggctctgggcacagcggccctgggctgcctggtcaaggactacttccacatagtagtctgagcgggctggcaaggcgcatagnnnnn

SEQ ID NO: 187178 - DNA, 181 bp, Homo sapiens
  misc_feature: GYAE6OF02G1WLT.24.57.F02.1.454.CMB.1.raw
  modified_base (181)..(181): a, c, t, g, unknown or other
  misc_feature (181)..(181): n is a, c, g, or t
tcagactactatgtcacgaccggtgctcgatttagctcgatatagttgggtttgggctctgggcaccgtgggcacggggaggtgtgtcacaagatttgggctctgggcacagcggccctgggctgcctggtcaaggactacttccacatagtagtctgagcgggctggcaaggcgcatagn

SEQ ID NO: 187179 - DNA, 242 bp, Homo sapiens
  misc_feature: GYAE6OF02HTCGY.24.57.F02.1.454.CMB.1.raw
  modified_base (235)..(242): a, c, t, g, unknown or other
  misc_feature (235)..(242): n is a, c, g, or t
tcagactactatgtcacgaccggtgctcgatttagctcgatatagttgggtttgggggaagaggaagactgacggtcctcccaggagttcaggtgctgggcaccttgggcacggggaggtgtgtcacaagatttgggctctgggcacagcggccctggggcctcgccgtggtacgaaggacttaccttccacatagtagtctgaggcgggcgtggacgaagggccgataagtagnnnnnnnn

SEQ ID NO: 187180 - DNA, 222 bp, Homo sapiens; identical to SEQ ID NO: 187083
  misc_feature: GYAE6OF02GGIVQ.24.57.F02.1.454.CMB.1.raw
  modified_base (218)..(222): a, c, t, g, unknown or other
  misc_feature (218)..(222): n is a, c, g, or t

SEQ ID NO: 187181 - DNA, 220 bp, Homo sapiens; identical to SEQ ID NO: 187096
  misc_feature: GYAE6OF02G2F7L.24.57.F02.1.454.CMB.1.raw
  modified_base (219)..(220): a, c, t, g, unknown or other
  misc_feature (219)..(220): n is a, c, g, or t

SEQ ID NO: 187182 - DNA, 218 bp, Homo sapiens; identical to SEQ ID NO: 187089
  misc_feature: GYAE6OF02IQVTG.24.57.F02.1.454.CMB.1.raw
  modified_base (218)..(218): a, c, t, g, unknown or other
  misc_feature (218)..(218): n is a, c, g, or t

SEQ ID NO: 187183 - DNA, 219 bp, Homo sapiens; identical to SEQ ID NO: 187095
  misc_feature: GYAE6OF02INZC4.24.57.F02.1.454.CMB.1.raw
  modified_base (218)..(219): a, c, t, g, unknown or other
  misc_feature (218)..(219): n is a, c, g, or t

SEQ ID NO: 187184 - DNA, 263 bp, Homo sapiens
  misc_feature: GYAE6OF02HXDPT.24.57.F02.1.454.CMB.1.raw
  modified_base (262)..(263): a, c, t, g, unknown or other
  misc_feature (262)..(263): n is a, c, g, or t
tcagactactatgtcacgaccggtgctcgatttagctcgatatagttgggtttgggggaagaggaagactgacggtcctcccaggagttcaggtgctgggcaccttgggcacggggaggtgtgtcacaagatttgggctctgggcaccgtgggcatggggaggtgtgtcacaagatttgggctctgggcacagcggccctgggctgcctggtcaaggactacttccacatagtagtctgagcgggctggcaaggcgcatagnn

SEQ ID NO: 187185 - DNA, 218 bp, Homo sapiens; identical to SEQ ID NO: 187089
  misc_feature: GYAE6OF02I0SP9.24.57.F02.1.454.CMB.1.raw
  modified_base (218)..(218): a, c, t, g, unknown or other
  misc_feature (218)..(218): n is a, c, g, or t

SEQ ID NO: 187186 - DNA, 183 bp, Homo sapiens
  misc_feature: GYAE6OF02ITYH6.24.57.F02.1.454.CMB.1.raw
  modified_base (182)..(183): a, c, t, g, unknown or other
  misc_feature (182)..(183): n is a, c, g, or t
tcagactactatgtcacgaccggtgctcgatttagctcgatatagttgggtttgggctctgggcaccgtgggcacgggggaggtgtgtcacaagatttgggctctgggcacagcggccctgggctgcctggtcaaggactacttccacatagtagtctgagcgggctggcaaggcgcatagnn

SEQ ID NO: 187187 - DNA, 320 bp, Homo sapiens
  misc_feature: GYAE6OF02JCDOF.24.57.F02.1.454.CMB.1.raw
  modified_base (306)..(320): a, c, t, g, unknown or other
  misc_feature (306)..(320): n is a, c, g, or t
tcagactactatgtcacgaccggtgctcgatttagctcgatatagttgggtttgggggaagaggaagactgacggtcctcccaggagttcaggtgctgggcaccttgggcacggggaggtgtgtcacaagatttgggctctgggcaccgtgggcatgggggagtgtgtcacaagatttgggctctgggcaccgtgggcacggggaggtgtgtcacaagatttgggctctgggcacagcggccctgggctgcctggtcaaggactacttccacatagtagtctgagcgggctggcaaggcgcatagnnnnnnnnnnnnnnn

SEQ ID NO: 187188 - DNA, 222 bp, Homo sapiens; identical to SEQ ID NO: 187083
  misc_feature: GYAE6OF02H0YDX.24.57.F02.1.454.CMB.1.raw
  modified_base (218)..(222): a, c, t, g, unknown or other
  misc_feature (218)..(222): n is a, c, g, or t

SEQ ID NO: 187189 - DNA, 130 bp, Homo sapiens; identical to SEQ ID NO: 187066
  misc_feature: GYAE6OF02FPAYS.24.57.F02.1.454.CMB.1.raw
  modified_base (130)..(130): a, c, t, g, unknown or other
  misc_feature (130)..(130): n is a, c, g, or t

SEQ ID NO: 187190 - DNA, 267 bp, Homo sapiens; identical to SEQ ID NO: 187088
  misc_feature: GYAE6OF02GXZHT.24.57.F02.1.454.CMB.1.raw
  modified_base (263)..(267): a, c, t, g, unknown or other
  misc_feature (263)..(267): n is a, c, g, or t

SEQ ID NO: 187191 - DNA, 219 bp, Homo sapiens; identical to SEQ ID NO: 187095
  misc_feature: GYAE6OF02HMZ47.24.57.F02.1.454.CMB.1.raw
  modified_base (218)..(219): a, c, t, g, unknown or other
  misc_feature (218)..(219): n is a, c, g, or t

SEQ ID NO: 187192 - DNA, 265 bp, Homo sapiens
  misc_feature: GYAE6OF02GSEOK.24.57.F02.1.454.CMB.1.raw
  modified_base (263)..(265): a, c, t, g, unknown or other
  misc_feature (263)..(265): n is a, c, g, or t
tcagactactatgtcacgaccggtgctcgatttagctcgatatagttgggtttgggggaagaggaagactgacggtcctcccaggagttcaggtgctgggcaccttgggcacggggaggtgtgtcacaagatttgggctctgggcaccgtgggcatgggggaggtgtgtcacaagatttgggctctgggcacagcggccctgggctgcctggtcaaggactacttccacatagtagtctgagcgggctggcaaggcgcatagnnn

SEQ ID NO: 187193 - DNA, 129 bp, Homo sapiens
  misc_feature: GYAE6OF02GBLP0.24.57.F02.1.454.CMB.1.raw
  modified_base (129)..(129): a, c, t, g, unknown or other
  misc_feature (129)..(129): n is a, c, g, or t
tcagactactatgtcacgaccggtgctcgatttagctcgatatagttgggtttggcacagcggccctgggctgcctggtcaaggactacttcctgtcgagcgtctgagcgggctggcaaggcgcatagn

SEQ ID NO: 187194 - DNA, 223 bp, Homo sapiens
  misc_feature: GYAE6OF02I7L36.24.57.F02.1.454.CMB.1.raw
  modified_base (216)..(223): a, c, t, g, unknown or other
  misc_feature (216)..(223): n is a, c, g, or t
tcagactactatgtcacgaccggtgctcgatttagctcgatatagttgggtttgggggaagaggaagactgacggtcctccaggagttcaggtgctgggcaccttgggcacggggaggtgtgtcacaagatttgggctctgggcacagcggccctgggctgcctggtcaaggctacttccacatagtagtctgagcgggctggcaaggcgcatagnnnnnnnn

SEQ ID NO: 187195 - DNA, 220 bp, Homo sapiens; identical to SEQ ID NO: 187096
  misc_feature: GYAE6OF02GN2Q5.24.57.F02.1.454.CMB.1.raw
  modified_base (219)..(220): a, c, t, g, unknown or other
  misc_feature (219)..(220): n is a, c, g, or t

SEQ ID NO: 187196 - DNA, 281 bp, Homo sapiens
  misc_feature: GYAE6OF02HA3TP.24.57.F02.1.454.CMB.1.raw
  modified_base (229)..(229): a, c, t, g, unknown or other
  misc_feature (229)..(229): n is a, c, g, or t
  modified_base (263)..(281): a, c, t, g, unknown or other
  misc_feature (263)..(281): n is a, c, g, or t
tcagactactatgtcacgaccggtgctcgatttagctcgatatagttgggtttggggggaagaggaagactgacggtcctcccaggagttcaggtgctgggcaccttgggcacgggggaggtgtgtcacaagatttgggctctgggcaccgtgggcatgggggagtgtgtcacaagatttgggctctgggcacagcggccctgggctgcctggtcaaggctacttccanatagtagtctgagcgggctggcaaggcgcatagnnnnnnnnnnnnnnnnnnn

SEQ ID NO: 187197 - DNA, 233 bp, Homo sapiens
  misc_feature: GYAE6OF02GSMQX.24.57.F02.1.454.CMB.1.raw
  modified_base (221)..(233): a, c, t, g, unknown or other
  misc_feature (221)..(233): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggcttgcctggtcaaggtactacttccacatagtagtctgagcgggctggcaaggcgcatagnnnnnnnnnnnnn

SEQ ID NO: 187198 - DNA, 186 bp, Homo sapiens
  misc_feature: GYAE6OF02HPVVW.24.57.F02.1.454.CMB.1.raw
  modified_base (181)..(186): a, c, t, g, unknown or other
  misc_feature (181)..(186): n is a, c, g, or t
tcagactactatgtcacgaccggtgctcgatttagctcgatatagttgggtttgggctctgggcaccgtgggcacggggaggtgtgtcacaagatttgggctctgggcacagcggccctgggctgcctggtcaaggactacttccacatagtagtctgagcgggctggcaaggcgcatagnnnnnn

SEQ ID NO: 187199 - DNA, 270 bp, Homo sapiens
  misc_feature: GYAE6OF02GDF29.24.57.F02.1.454.CMB.1.raw
  modified_base (264)..(270): a, c, t, g, unknown or other
  misc_feature (264)..(270): n is a, c, g, or t
tcagactactatgtcacgaccggtgctcgatttagctcgatatagttgggtttgggggaagaggaagactgactgtcctcccaggagttcaggtgctgggcaccttgggcacgggggaggtgtgtcacaagatttgggctctgggcaccgtgggcatgggggaggtgtgtcacaagatttgggctctgggcacagcggccctgggctgcctggtcaaggactacttccacatagtagtctgagcgggctggcaaggcgcatagnnnnnnn

SEQ ID NO: 187200 - DNA, 174 bp, Homo sapiens
  misc_feature: GYAE6OF02JB1DB.24.57.F02.1.454.CMB.1.raw
  modified_base (172)..(174): a, c, t, g, unknown or other
  misc_feature (172)..(174): n is a, c, g, or t
tcagactactatgtcacgaccggtgctcgatttagctcgatatagttgggtttgggggaggtgtgtcacaagatttgggccaggagcacctctgggggcacagcggccctgggctgcctggtcaaggactacttccacatagtagtctgagcgggctggcaaggcgcatagnnn

SEQ ID NO: 187201 - DNA, 220 bp, Homo sapiens; identical to SEQ ID NO: 187056
  misc_feature: GYAE6OF02H4X1M.24.57.F02.1.454.CMB.1.raw
  modified_base (218)..(220): a, c, t, g, unknown or other
  misc_feature (218)..(220): n is a, c, g, or t

SEQ ID NO: 187202 - DNA, 220 bp, Homo sapiens; identical to SEQ ID NO: 187056
  misc_feature: GYAE6OF02FLVVU.24.57.F02.1.454.CMB.1.raw
  modified_base (218)..(220): a, c, t, g, unknown or other
  misc_feature (218)..(220): n is a, c, g, or t

SEQ ID NO: 187203 - DNA, 229 bp, Homo sapiens
  misc_feature: GYAE6OF02G4CUK.24.57.F02.1.454.CMB.1.raw
  modified_base (219)..(229): a, c, t, g, unknown or other
  misc_feature (219)..(229): n is a, c, g, or t
tcagactactatgtcacgaccggtgctcgatttagctcgatataggttgggtttgggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnnnnnnnnnnn

SEQ ID NO: 187204 - DNA, 220 bp, Homo sapiens; identical to SEQ ID NO: 187096
  misc_feature: GYAE6OF02F24OQ.24.57.F02.1.454.CMB.1.raw
  modified_base (219)..(220): a, c, t, g, unknown or other
  misc_feature (219)..(220): n is a, c, g, or t

SEQ ID NO: 187205 - DNA, 268 bp, Homo sapiens
  misc_feature: GYAE6OF02HAAD2.24.57.F02.1.454.CMB.1.raw
  modified_base (239)..(239): a, c, t, g, unknown or other
  misc_feature (239)..(239): n is a, c, g, or t
  modified_base (241)..(246): a, c, t, g, unknown or other
  misc_feature (241)..(246): n is a, c, g, or t
  modified_base (250)..(257): a, c, t, g, unknown or other
  misc_feature (250)..(257): n is a, c, g, or t
  modified_base (259)..(268): a, c, t, g, unknown or other
  misc_feature (259)..(268): n is a, c, g, or t
tcagactactatgtcacgaccggtgctcgatttagctcgatatagttaggggtttgggggaacgaggaagactgtacggtcctcccgaggacgttacagggtagcctgggccaccttgggcacggggaggtgtagtcacaagatttgggctctgggtcacagcggccctgggctgcctaggtcaaggctacgttccactagtagtagtcctaggagcgggctggctaaggcgcaatagncnnnnnncacnnnnnnnngnnnnnnnnnn

SEQ ID NO: 187206 - DNA, 269 bp, Homo sapiens; identical to SEQ ID NO: 187124
  misc_feature: GYAE6OF02IHYM6.24.57.F02.1.454.CMB.1.raw
  modified_base (264)..(269): a, c, t, g, unknown or other
  misc_feature (264)..(269): n is a, c, g, or t

SEQ ID NO: 187207 - DNA, 184 bp, Homo sapiens
  misc_feature: GYAE6OF02HSNTT.24.57.F02.1.454.CMB.1.raw
  modified_base (182)..(184): a, c, t, g, unknown or other
  misc_feature (182)..(184): n is a, c, g, or t
tcagactactatgtcacgaccggtgctcgatttagctcgatatagttgggtttgggctctgggcaccgtgggcacgggggaggtgtgtcacaagatttgggctctgggcacagcggccctgggctgcctggtcaaggactacttccacatagtagtctgagcgggctggcaaggcgcatagnnn

SEQ ID NO: 187208 - DNA, 316 bp, Homo sapiens
  misc_feature: GYAE6OF02G2UZD.24.57.F02.1.454.CMB.1.raw
  modified_base (308)..(316): a, c, t, g, unknown or other
  misc_feature (308)..(316): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcaccgtgggcatgggggaggtgtgtcacaagatttgggctctgtgcaccgtgggcacgggggagtgtgtcacaagatttgggctctgggcacagcggccctgggctgcctggtcaaggactacttccacatagtagtctgagcgggctggcaaggcgcatagnnnnnnnnn

SEQ ID NO: 187209 - DNA, 161 bp, Homo sapiens
  misc_feature: GYAE6OF02G9NXC.24.57.F02.1.454.CMB.1.raw
  modified_base (160)..(161): a, c, t, g, unknown or other
  misc_feature (160)..(161): n is a, c, g, or t
tcagactactatgtcacgaccggtgctcgatttagctcgatatagttgggtttgggggaggtgtgtcacaagatttgggctctgggcacagcggccctgggctgcctggtcaaggactacttccacatagtagtctgagcgggctggcaaggcgcatagnn

SEQ ID NO: 187210 - DNA, 624 bp, Homo sapiens
  misc_feature: GYAE6OF02FKMXR.24.57.F02.1.454.CMB.1.raw
  modified_base (217)..(223): a, c, t, g, unknown or other
  misc_feature (217)..(223): n is a, c, g, or t
  modified_base (225)..(225): a, c, t, g, unknown or other
  misc_feature (225)..(225): n is a, c, g, or t
  modified_base (228)..(229): a, c, t, g, unknown or other
  misc_feature (228)..(229): n is a, c, g, or t
  modified_base (233)..(234): a, c, t, g, unknown or other
  misc_feature (233)..(234): n is a, c, g, or t
  modified_base (236)..(237): a, c, t, g, unknown or other
  misc_feature (236)..(237): n is a, c, g, or t
  modified_base (239)..(240): a, c, t, g, unknown or other
  misc_feature (239)..(240): n is a, c, g, or t
  modified_base (243)..(243): a, c, t, g, unknown or other
  misc_feature (243)..(243): n is a, c, g, or t
  modified_base (246)..(246): a, c, t, g, unknown or other
  misc_feature (246)..(246): n is a, c, g, or t
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (304)..(304): a, c, t, g, unknown or other
  misc_feature (304)..(304): n is a, c, g, or t
tcagactactatgtcacgaccggtgctcgatttagctcgatatagttgggtttgggggaagaggaagactgacggtcctcccaggagttcaggtgctgggcaccttgggcacgggggagtgtgtcacaagatttgggctctgggcacagcggccctgggctgcctggtcaaggctacttccacatagtagtctgagcgggctggcaaggcgcatagnnnnnnntncgnngacnncnnanngtnacngtncgangctagntcgatccgtagcgtatacgtcgtcgttacacggtctcggttaacncgttaacgtaccttaggtcctacggtacgtaaccgtggtaaccctgtaacgtcgtaacgtctaaccgtgtaaccgtactacgaccgtagtaacgtcgtacgtactacggtacgtacgtactacggtactacggttaacgtcgtacgtacgtcgtaacgtcggtacgtacgtacgtaccgtacgttacggtactaccgtacgttaacgtacgtcggttaccgtaggtacgtacgtacgtacgacgttacgtacggttacgtacgtaggttaacccgtgttaccgtacgttaccgtaacggttctaacggttcgttaaccgg

SEQ ID NO: 187211 - DNA, 267 bp, Homo sapiens
  misc_feature: GYAE6OF02HH1RZ.24.57.F02.1.454.CMB.1.raw
  modified_base (264)..(267): a, c, t, g, unknown or other
  misc_feature (264)..(267): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcaccgtgggcatgggggaggtgtgtcacaagatttgggctctgggcacagcggccctgggctgcctggtcaaggactacttccacatagtagtctgagcgggctggcaaggcgcatagnnnn

SEQ ID NO: 187212 - DNA, 221 bp, Homo sapiens; identical to SEQ ID NO: 187070
  misc_feature: GYAE6OF02H2DQJ.24.57.F02.1.454.CMB.1.raw
  modified_base (219)..(221): a, c, t, g, unknown or other
  misc_feature (219)..(221): n is a, c, g, or t

SEQ ID NO: 187213 - DNA, 268 bp, Homo sapiens
  misc_feature: GYAE6OF02HPY6P.24.57.F02.1.454.CMB.1.raw
  modified_base (264)..(268): a, c, t, g, unknown or other
  misc_feature (264)..(268): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcaccgtgggcatgggggaggtgtgtcacaagatttgggctctgggcacagcggccctgggctgcctggtcaaggactacttccacatagtagtctgagcgggctggcaaggcgcatagnnnnn

SEQ ID NO: 187214 - DNA, 272 bp, Homo sapiens
  misc_feature: GYAE6OF02IHQHF.24.57.F02.1.454.CMB.1.raw
  modified_base (263)..(272): a, c, t, g, unknown or other
  misc_feature (263)..(272): n is a, c, g, or t
tcagactactatgtcacgaccggtgctcgatttagctcgatatagttgggtttgggggaagaggaagactgacggtcctcccaggagttcaggtgctgggcaccttgggcacggggaggtgtgtcacaagatttgggctctgggcaccgtgggcatgggggaggtgtgtcacaagatttgggctctgggcacagcggccctgggctgcctggtcaaggactacttccacatagtagtctgagcgggctggcaaggcgcatagnnnnnnnnnn

SEQ ID NO: 187215 - DNA, 219 bp, Homo sapiens; identical to SEQ ID NO: 187095
  misc_feature: GYAE6OF02G0Q5K.24.57.F02.1.454.CMB.1.raw
  modified_base (218)..(219): a, c, t, g, unknown or other
  misc_feature (218)..(219): n is a, c, g, or t

SEQ ID NO: 187216 - DNA, 270 bp, Homo sapiens
  misc_feature: GYAE6OF02HV4II.24.57.F02.1.454.CMB.1.raw
  modified_base (263)..(270): a, c, t, g, unknown or other
  misc_feature (263)..(270): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcaccgtgggcatgggggaggtgtgtcacaagatttgggctctgggcacagcggccctgggctgcctggtcaaggctacttccacatagtagtctgagcgggctggcaaggcgcatagnnnnnnnn

SEQ ID NO: 187217 - DNA, 222 bp, Homo sapiens; identical to SEQ ID NO: 187083
  misc_feature: GYAE6OF02HZBK7.24.57.F02.1.454.CMB.1.raw
  modified_base (218)..(222): a, c, t, g, unknown or other
  misc_feature (218)..(222): n is a, c, g, or t

SEQ ID NO: 187218 - DNA, 219 bp, Homo sapiens; identical to SEQ ID NO: 187074
  misc_feature: GYAE6OF02GSOC1.24.57.F02.1.454.CMB.1.raw
  modified_base (219)..(219): a, c, t, g, unknown or other
  misc_feature (219)..(219): n is a, c, g, or t

SEQ ID NO: 187219 - DNA, 273 bp, Homo sapiens
  misc_feature: GYAE6OF02H3BE2.24.57.F02.1.454.CMB.1.raw
  modified_base (232)..(273): a, c, t, g, unknown or other
  misc_feature (232)..(273): n is a, c, g, or t
tcagactactatgtcacgaccggtgctcgatttagctcgatataggttagggggtttgggggaagaggaagactgacggtcctcccagggagttcaggtgctgggccaccgttgggcacgggggaggtcgtgtcacaagatttgggctctgggcacagcggcccctggggctgcctggtcaacggctacttcccacactagtagtctgagcggggctggcaaggcgcatagnnnnnnnnnnnnnnnnnnnnnnnnnnnnnnnnnnnnnnnnnn

SEQ ID NO: 187220 - DNA, 223 bp, Homo sapiens; identical to SEQ ID NO: 187093
  misc_feature: GYAE6OF02F4K8O.24.57.F02.1.454.CMB.1.raw
  modified_base (219)..(223): a, c, t, g, unknown or other
  misc_feature (219)..(223): n is a, c, g, or t

SEQ ID NO: 187221 - DNA, 129 bp, Homo sapiens; identical to SEQ ID NO: 187099
  misc_feature: GYAE6OF02G1NME.24.57.F02.1.454.CMB.1.raw

SEQ ID NO: 187222 - DNA, 221 bp, Homo sapiens; identical to SEQ ID NO: 187070
  misc_feature: GYAE6OF02IVFG8.24.57.F02.1.454.CMB.1.raw
  modified_base (219)..(221): a, c, t, g, unknown or other
  misc_feature (219)..(221): n is a, c, g, or t

SEQ ID NO: 187223 - DNA, 494 bp, Homo sapiens
  misc_feature: GYAE6OF02GK7E0.24.57.F02.1.454.CMB.1.raw
  modified_base (250)..(250): a, c, t, g, unknown or other
  misc_feature (250)..(250): n is a, c, g, or t
  modified_base (253)..(253): a, c, t, g, unknown or other
  misc_feature (253)..(253): n is a, c, g, or t
  modified_base (256)..(256): a, c, t, g, unknown or other
  misc_feature (256)..(256): n is a, c, g, or t
  modified_base (258)..(259): a, c, t, g, unknown or other
  misc_feature (258)..(259): n is a, c, g, or t
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
  modified_base (273)..(273): a, c, t, g, unknown or other
  misc_feature (273)..(273): n is a, c, g, or t
  modified_base (280)..(280): a, c, t, g, unknown or other
  misc_feature (280)..(280): n is a, c, g, or t
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (300)..(300): a, c, t, g, unknown or other
  misc_feature (300)..(300): n is a, c, g, or t
  modified_base (304)..(304): a, c, t, g, unknown or other
  misc_feature (304)..(304): n is a, c, g, or t
  modified_base (306)..(306): a, c, t, g, unknown or other
  misc_feature (306)..(306): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
  modified_base (321)..(321): a, c, t, g, unknown or other
  misc_feature (321)..(321): n is a, c, g, or t
  modified_base (323)..(323): a, c, t, g, unknown or other
  misc_feature (323)..(323): n is a, c, g, or t
  modified_base (325)..(325): a, c, t, g, unknown or other
  misc_feature (325)..(325): n is a, c, g, or t
  modified_base (327)..(327): a, c, t, g, unknown or other
  misc_feature (327)..(327): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (461)..(461): a, c, t, g, unknown or other
  misc_feature (461)..(461): n is a, c, g, or t
  modified_base (473)..(474): a, c, t, g, unknown or other
  misc_feature (473)..(474): n is a, c, g, or t
  modified_base (476)..(479): a, c, t, g, unknown or other
  misc_feature (476)..(479): n is a, c, g, or t
  modified_base (481)..(494): a, c, t, g, unknown or other
  misc_feature (481)..(494): n is a, c, g, or t
tcagactactatgtcacgaccggtgctcgattttagctcgatatagtttggggttttgggggggaagaggtaacgacgtgacggtcctcccctaggacgttcagggtgcctgggcacccttgggcacgggggagggtgtgtcacaacgatttgggcgtctgggtcacagcggccctgggctgacctggtcaaggtcctaacgttcccacacctaagtacgtctgagcgggctggaccaaggcgcactagngcngcntnngncatcngcactcngcctcgngcatcacncgcgccgcgngngagngngctntatatntgtgngngngngngngagacncgcgngagtgctctatagtcgtacgtacgtacgacgtacgtactcgtcgtacgacgacgaccgacgaccaccacgtcactactcctcctacctcctctctctactactacgtcgcgacgcgcgngacgacgcgcgnngnnnngnnnnnnnnnnnnnn

SEQ ID NO: 187224 - DNA, 268 bp, Homo sapiens; identical to SEQ ID NO: 187213
  misc_feature: GYAE6OF02FTCBK.24.57.F02.1.454.CMB.1.raw
  modified_base (264)..(268): a, c, t, g, unknown or other
  misc_feature (264)..(268): n is a, c, g, or t

SEQ ID NO: 187225 - DNA, 234 bp, Homo sapiens
  misc_feature: GYAE6OF02IAZ6V.24.57.F02.1.454.CMB.1.raw
  modified_base (233)..(234): a, c, t, g, unknown or other
  misc_feature (233)..(234): n is a, c, g, or t
tcagactactatgtcacgaccggtgctcgatttagctcgatatagttgggtttggggaagtagtccttggccagggatccctggtcaccgtctcctcagcttccaccaagggcccatcggtcttcccctggcgccctgctccaggagcacctctgggggcacagcggccctgggctgcctggtcaaggactacttccacatagtagtctgagcgggctggcaaggcgcatagnn

SEQ ID NO: 187226 - DNA, 268 bp, Homo sapiens; identical to SEQ ID NO: 187065
  misc_feature: GYAE6OF02IHIUD.24.57.F02.1.454.CMB.1.raw
  modified_base (263)..(268): a, c, t, g, unknown or other
  misc_feature (263)..(268): n is a, c, g, or t

SEQ ID NO: 187227 - DNA, 245 bp, Homo sapiens
  misc_feature: GYAE6OF02I8HKY.24.57.F02.1.454.CMB.1.raw
  modified_base (148)..(148): a, c, t, g, unknown or other
  misc_feature (148)..(148): n is a, c, g, or t
  modified_base (184)..(184): a, c, t, g, unknown or other
  misc_feature (184)..(184): n is a, c, g, or t
  modified_base (220)..(220): a, c, t, g, unknown or other
  misc_feature (220)..(220): n is a, c, g, or t
  modified_base (223)..(225): a, c, t, g, unknown or other
  misc_feature (223)..(225): n is a, c, g, or t
  modified_base (227)..(245): a, c, t, g, unknown or other
  misc_feature (227)..(245): n is a, c, g, or t
tcagactactatgtcacgaccggtgctcgatttagctcgatatagttgggtttgggggaagaggaagactgacggtcctccaggagttcaggtgctgggcaccttgggcacggggaggtgtgtcacaagatttgggctcgtgggcacngcggccctgggctgcctggtcaaaggctacttccanatagtagctgagcgggctggcaagggcgcagtagcnctnnntnnnnnnnnnnnnnnnnnnn

SEQ ID NO: 187228 - DNA, 220 bp, Homo sapiens; identical to SEQ ID NO: 187096
  misc_feature: GYAE6OF02GIJ71.24.57.F02.1.454.CMB.1.raw
  modified_base (219)..(220): a, c, t, g, unknown or other
  misc_feature (219)..(220): n is a, c, g, or t

SEQ ID NO: 187229 - DNA, 182 bp, Homo sapiens
  misc_feature: GYAE6OF02I39OD.24.57.F02.1.454.CMB.1.raw
  modified_base (178)..(182): a, c, t, g, unknown or other
  misc_feature (178)..(182): n is a, c, g, or t
tcagactactatgtcacgaccggtgctcgatttagctcgatatagttgggtttgggctctggcaccgtggcacggggaggtgtgtcacaagatttgggctctgggcacagcggccctggctgcctggtcaaggactacttccacatagtagtctgagcgggctggcaaggcgcatagnnnnn

SEQ ID NO: 187230 - DNA, 270 bp, Homo sapiens
  misc_feature: GYAE6OF02H8QTM.24.57.F02.1.454.CMB.1.raw
  modified_base (263)..(270): a, c, t, g, unknown or other
  misc_feature (263)..(270): n is a, c, g, or t
tcagactactatgtcacgaccggtgctcgatttagctcgatatagttgggtttgggggaagaggaagactgacggtcctcccaggagttcaggtgctgggcaccttgggcacggggaggtgtgtcacaagatttgggctctgggcaccgtgggcatgggggaggtgtgtcacaagatttgggctctgggcacagcggccctgggctgcctggtcaaggactacttccacatagtagtctgagcgggctggcaaggcgcatagnnnnnnnn

SEQ ID NO: 187231 - DNA, 222 bp, Homo sapiens
  misc_feature: GYAE6OF02FFZ37.24.57.F02.1.454.CMB.1.raw
  modified_base (219)..(222): a, c, t, g, unknown or other
  misc_feature (219)..(222): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggctgcctggtcaaggactacttccacatagtagtctgagcgggctggcaaggcgcatagnnnn

SEQ ID NO: 187232 - DNA, 230 bp, Homo sapiens
  misc_feature: GYAE6OF02GM88N.24.57.F02.1.454.CMB.1.raw
  modified_base (218)..(230): a, c, t, g, unknown or other
  misc_feature (218)..(230): n is a, c, g, or t
tcagactactatgtcacgaccggtgctcgatttagctcgatatagttgggtttgggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnnnnnnnnnnnnn

SEQ ID NO: 187233 - DNA, 268 bp, Homo sapiens; identical to SEQ ID NO: 187213
  misc_feature: GYAE6OF02FICOC.24.57.F02.1.454.CMB.1.raw
  modified_base (264)..(268): a, c, t, g, unknown or other
  misc_feature (264)..(268): n is a, c, g, or t

SEQ ID NO: 187234 - DNA, 183 bp, Homo sapiens; identical to SEQ ID NO: 187186
  misc_feature: GYAE6OF02IF87S.24.57.F02.1.454.CMB.1.raw
  modified_base (182)..(183): a, c, t, g, unknown or other
  misc_feature (182)..(183): n is a, c, g, or t

SEQ ID NO: 187235 - DNA, 158 bp, Homo sapiens
  misc_feature: GYAE6OF02FXXW4.24.57.F02.1.454.CMB.1.raw
  modified_base (134)..(158): a, c, t, g, unknown or other
  misc_feature (134)..(158): n is a, c, g, or t
tcagactactatgtcacgaccggtgctcgatttagctcgatatagttgggtttgggcacagcggtccctgggctgcccttggtcaaggacctacttcctgtcgagcgtctgagcgggctggcaaggcgcatagnnnnnnnnnnnnnnnnnnnnnnnnn

SEQ ID NO: 187236 - DNA, 269 bp, Homo sapiens; identical to SEQ ID NO: 187124
  misc_feature: GYAE6OF02IBBO8.24.57.F02.1.454.CMB.1.raw
  modified_base (264)..(269): a, c, t, g, unknown or other
  misc_feature (264)..(269): n is a, c, g, or t

SEQ ID NO: 187237 - DNA, 433 bp, Homo sapiens
  misc_feature: GYAE6OF02F5EFN.24.57.F02.1.454.CMB.1.raw
  modified_base (335)..(335): a, c, t, g, unknown or other
  misc_feature (335)..(335): n is a, c, g, or t
  modified_base (405)..(405): a, c, t, g, unknown or other
  misc_feature (405)..(405): n is a, c, g, or t
  modified_base (423)..(433): a, c, t, g, unknown or other
  misc_feature (423)..(433): n is a, c, g, or t
tcagactactatgtcacgaccggtgctcgatttagctcgatatagttgggtttgagtggctgggaatgatcgaccccagtggtggttacacaatcttcggacagaacttcaaggacagaatcaccatgaccagggacacgtccacgagctcagtctacatggagttgtacagcctgagatttgaggacacggccgtgtactactgtgcgagagttccgagagagtattactatgaaagtagtggtcacttctactggggccagggatccctggtcaccgtctcctcagcttccaccagggcccatcggtcttccccctgccgccctgctccagancacctctgggggcacagcggccctgggctgcctggtcaaggactacttccacatagtagtctgagcgggntggacaaggcgacatagnnnnnnnnnnn

SEQ ID NO: 187238 - DNA, 133 bp, Homo sapiens
  misc_feature: GYAE6OF02GFQC8.24.57.F02.1.454.CMB.1.raw
  modified_base (130)..(133): a, c, t, g, unknown or other
  misc_feature (130)..(133): n is a, c, g, or t
tcagactactatgtcacgaccggtgctcgatttagctcgatatagttgggtttgggcacagcggccctgggctgcctggtcaaggactacttcctgtcgagcgtctgagcgggctggcaaggcgcatagnnnn

SEQ ID NO: 187239 - DNA, 224 bp, Homo sapiens; identical to SEQ ID NO: 187086
  misc_feature: GYAE6OF02HK382.24.57.F02.1.454.CMB.1.raw
  modified_base (219)..(224): a, c, t, g, unknown or other
  misc_feature (219)..(224): n is a, c, g, or t

SEQ ID NO: 187240 - DNA, 165 bp, Homo sapiens
  misc_feature: GYAE6OF02H2WDN.24.57.F02.1.454.CMB.1.raw
  modified_base (159)..(165): a, c, t, g, unknown or other
  misc_feature (159)..(165): n is a, c, g, or t
tcagactactatgtcacgaccggtgctcgatttagctcgatatagttgggtttggggaggtgtgtcacaagatttgggctctgggcacagcggccctgggctgcctggtcaaggactacttccacatagtagtctgagcgggctggcaaggcgcatagnnnnnnn

SEQ ID NO: 187241 - DNA, 268 bp, Homo sapiens
  misc_feature: GYAE6OF02GA5HX.24.57.F02.1.454.CMB.1.raw
  modified_base (262)..(268): a, c, t, g, unknown or other
  misc_feature (262)..(268): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcaccgtgggcatggggagtgtgtcacaagatttgggctctgggcacagcggccctgggctgcctggtcaaggactacttccacatagtagtctgagcgggctggccaaggcgcatgnnnnnnn

SEQ ID NO: 187242 - DNA, 222 bp, Homo sapiens
  misc_feature: GYAE6OF02HM0J5.24.57.F02.1.454.CMB.1.raw
  modified_base (218)..(222): a, c, t, g, unknown or other
  misc_feature (218)..(222): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggctgcctggtcaaggctacttccacatagtagtctgagcgggctggcaaggcgcatagnnnnn

SEQ ID NO: 187243 - DNA, 307 bp, Homo sapiens
  misc_feature: GYAE6OF02JYXFU.24.57.F02.1.454.CMB.1.raw
  modified_base (286)..(307): a, c, t, g, unknown or other
  misc_feature (286)..(307): n is a, c, g, or t
tcagactactatgtcacgaccggtgctcgatttagctcgatatagttgggtttggggggaagaggaagactgacggtcctcccaggagttcaggtgctgggcaccttgggcacgggggagtgtgtcacaagatttgggctctgggcaccgtgggcagtgggggagtgtgtcacaagatttgggctcgtgggcacaggccggccgtgggcctgccttggtacaagggaccttacttccaactagtacgtagtcgtaggacggcgggctggacgaagggcacagtagnnnnnnnnnnnnnnnnnnnnnn

SEQ ID NO: 187244 - DNA, 285 bp, Homo sapiens
  misc_feature: GYAE6OF02IG1J7.24.57.F02.1.454.CMB.1.raw
  modified_base (270)..(285): a, c, t, g, unknown or other
  misc_feature (270)..(285): n is a, c, g, or t
tcagactactatgtcacgaccggtgctcgatttagctcgatatagttgggtttggggggaagaggaagactgacggtcctcccaggagttcaggtgcgtgggcaccttgggcacgggggaggtgtgtcacaagatttgggctctgggcacgtgggcagtgggggaggtgtgtcacaagatttgggctcgtgggcacagcggccctgggctgcctggtcaaggctactccacatagtagtctggagcgggctgggcaacggcgacagtagnnnnnnnnnnnnnnnn

SEQ ID NO: 187245 - DNA, 240 bp, Homo sapiens
  misc_feature: GYAE6OF02FQACI.24.57.F02.1.454.CMB.1.raw
  modified_base (219)..(240): a, c, t, g, unknown or other
  misc_feature (219)..(240): n is a, c, g, or t
tcagactactatgtcacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggctgcctggtcaaggactacttccacatagtagtctgagcgggctggcaaggcgcatagnnnnnnnnnnnnnnnnnnnnnn

SEQ ID NO: 187246 - DNA, 354 bp, Homo sapiens
  misc_feature: GYAE6OF02G0M80.24.57.F02.1.454.CMB.1.raw
  modified_base (183)..(183): a, c, t, g, unknown or other
  misc_feature (183)..(183): n is a, c, g, or t
  modified_base (201)..(201): a, c, t, g, unknown or other
  misc_feature (201)..(201): n is a, c, g, or t
  modified_base (291)..(291): a, c, t, g, unknown or other
  misc_feature (291)..(291): n is a, c, g, or t
  modified_base (297)..(298): a, c, t, g, unknown or other
  misc_feature (297)..(298): n is a, c, g, or t
  modified_base (300)..(301): a, c, t, g, unknown or other
  misc_feature (300)..(301): n is a, c, g, or t
  modified_base (304)..(305): a, c, t, g, unknown or other
  misc_feature (304)..(305): n is a, c, g, or t
  modified_base (307)..(310): a, c, t, g, unknown or other
  misc_feature (307)..(310): n is a, c, g, or t
  modified_base (312)..(354): a, c, t, g, unknown or other
  misc_feature (312)..(354): n is a, c, g, or t
tcagactactatgtcacgaccggtgctcgatttagctcgatatagttggggtttgggggggaagaggaagactgacggtcctcccaggtagttcaggtgctgggcaccttgggcacgggggtaggtgtgtcacaagatttgggctctgggcaccgtgggcagtgggggagtgtgtcacaagtntttgggctctgggcacgnggccggtcccgtgggctcggcctggaccaaaggtcctaccgttccacaagtaagtcgtctaggacggcggggtctaggacgaagggccanagtagnnanngcnngnnnntnnnnnnnnnnnnnnnnnnnnnnnnnnnnnnnnnnnnnnnnnnn

SEQ ID NO: 187247 - DNA, 319 bp, Homo sapiens
  misc_feature: GYAE6OF01C97YJ.41.80.H03.1.454.CMB.1.raw
  modified_base (316)..(319): a, c, t, g, unknown or other
  misc_feature (316)..(319): n is a, c, g, or t
tcagtctatactatcacgaccggtgctcgatttagctgtgcgtcgaagggaaaggggtgcgtgaagggaaagggttgagaacctatgaacattctgtaggggccactgtcttctccacggtgctcccttcatgcgtgacctggcagctgtagcttttgtgggactattactgctcagcatgggacagaagcatcacagcttgggtgtttggcggagggaccaagctgaccgtctaggtcagcccaaggctgcccctcggtcactctgtcccaccctcctcatagtatagactgagcgggctggcaaggcgcatagnnnn

SEQ ID NO: 187248 - DNA, 346 bp, Homo sapiens
  misc_feature: GYAE6OF01EUIH6.41.80.H03.1.454.CMB.1.raw
  modified_base (341)..(346): a, c, t, g, unknown or other
  misc_feature (341)..(346): n is a, c, g, or t
tcagtctatactatcacgaccggtgctcgatttagctgtgcgtcgaagggaaaggggggggtgagggttgagaacctatgaacattctgtaggggccactgtcttctccacggtgctcccttcatgcgtgacctggcagctgtagcttttgtgggacttccactgctcaggcgtcaggctcaggtagctgctggccgcgtacttgttgttgcttttgtttggagggtgtttggcggagggaccaagctgaccgtcctaggtcagcccaaggctgccccctcggtcactctgttcccgccctcctcatagtatagactgagcgggctggcaaggcgcatagnnnnnn

SEQ ID NO: 187249 - DNA, 345 bp, Homo sapiens
  misc_feature: GYAE6OF01BA9HU.41.80.H03.1.454.CMB.1.raw
  modified_base (339)..(345): a, c, t, g, unknown or other
  misc_feature (339)..(345): n is a, c, g, or t
tcagtctatactatcacgaccggtgctcgatttagctgtgcgtcgaagggaaaggggggggtgagggttgagaacctatgaacattctgtaggggccactgtcttctccacggtgctcccttcatgcgtgacctggcagctgtagcttttgtgggacttccactgctcaggcgtcaggctcaggtagctgctggccgcgtacttgttgttgcttttgtttggagggtgtttggcggaggaccaagctgaccgtcctaggtcagcccaaggctgcccctcggtcactctcgttcccacctcctcatagtatagactgagcgggctggcaaggcgcatagnnnnnnn

SEQ ID NO: 187250 - DNA, 341 bp, Homo sapiens
  misc_feature: GYAE6OF01BVV3D.41.80.H03.1.454.CMB.1.raw
  modified_base (331)..(331): a, c, t, g, unknown or other
  misc_feature (331)..(331): n is a, c, g, or t
  modified_base (337)..(341): a, c, t, g, unknown or other
  misc_feature (337)..(341): n is a, c, g, or t
tcagtctatactatcacgaccggtgctcgatttagctgtgcgtcgaagggaaaggggggggtgagggttgagaacctatgaacattctgtaggggccactgtcttctccacggtgctcccttcatgcgtgacctggcagctgtagcttttgtgggacttccactgctcaggcgtcaggctcaggtagctgctggccgcgtacttgttgttgcttttgtttggagggttgttggcggagggaccaagctgaccgtcctaggtcagcccaaggctgcccctggtcactctgttcccaccctctcatagtatagactgagcggctggcaaggcncatagnnnnn

SEQ ID NO: 187251 - DNA, 219 bp, Homo sapiens
  misc_feature: GYAE6OF01AV3I2.41.80.H03.1.454.CMB.1.raw
  modified_base (212)..(219): a, c, t, g, unknown or other
  misc_feature (212)..(219): n is a, c, g, or t
tcagtctatactatcacgaccggtgctcgatttagctgtgcgtcgaagggaaagggaccacggtcaccgtctcctcagcttccaccaagggcccatcggtcttccccctggcgccctgctccaggagcacctctgggggcacagcggccctgggctgcctggtcaaggctacttcacgtctactgctgagcgggctggcaaggcgcagtagnnnnnnnn

SEQ ID NO: 187252 - DNA, 321 bp, Homo sapiens
  misc_feature: GYAE6OF01CNBJJ.41.80.H03.1.454.CMB.1.raw
  modified_base (318)..(321): a, c, t, g, unknown or other
  misc_feature (318)..(321): n is a, c, g, or t
tcagtctatactatcacgaccggtgctcgatttagctgtgcgtcgaagggaaaggggtgcgtgaagggaaagggttgagaacctatgaacattctgtaggggccactgtcttctccacggtgctcccttcatgcgtgacctggcagctgtagcttttgtgggactattactgctcagcatgggacagaagcatcacagcttgggtgtttggcggagggaccaagctgaccgtcctaggtcagcccaaggctgccccctggtcactctgttcccaccctcctcatagtatagactgagcgggctggcaaggcgcatagnnnn

SEQ ID NO: 187253 - DNA, 349 bp, Homo sapiens
  misc_feature: GYAE6OF01DHVV5.41.80.H03.1.454.CMB.1.raw
  modified_base (337)..(349): a, c, t, g, unknown or other
  misc_feature (337)..(349): n is a, c, g, or t
tcagtctatactatcacgaccggtgctcgatttagctgtgcgtcgaagggaaaggggggggtgagggttgagaacctatgaacattctgtaggggccactgtcttctccacggtgctcccttcatgcgtgacctggcagctgtagcttttgtgggacttccactgctcaggcgtcaggctcaggtagctgctggccgcgtacttgttgttgctttgtttggagggttgttggcggaggaccaagctgaccgtcaggtcagccaaggctcgccccctggtcactctgttcccaccctcctcatagtatagactgagcgggctggcaaggcgcaatagnnnnnnnnnnnnn

SEQ ID NO: 187254 - DNA, 333 bp, Homo sapiens
  misc_feature: GYAE6OF01D7OD9.41.80.H03.1.454.CMB.1.raw
  modified_base (324)..(333): a, c, t, g, unknown or other
  misc_feature (324)..(333): n is a, c, g, or t
tcagtctatactatcacgaccggtgctcgatttagctgtgcgtcgaagggaaaggggtgcgtgaagggaaagggttgagaacctatgaacattctgtaggggccactgtcttctccacggtgctcccttcatgcgtgacctggcagctatagcttttgtgggactattactgctcagcatgggacagaagcatcacagcgttgggtgttggcggagggaccaagctgaccgtcctacggtcacgccaaggctcgcccctcggtcactctcgttcccaccctcctcatagtatagactgacgcgggctggcgaaggcgcgatagnnnnnnnnnn

SEQ ID NO: 187255 - DNA, 408 bp, Homo sapiens
  misc_feature: GYAE6OF01BLCHX.41.80.H03.1.454.CMB.1.raw
  modified_base (367)..(367): a, c, t, g, unknown or other
  misc_feature (367)..(367): n is a, c, g, or t
  modified_base (385)..(408): a, c, t, g, unknown or other
  misc_feature (385)..(408): n is a, c, g, or t
tcagtctatactatcacgaccggtgctcgatttagctgtgcgtcgaaggggaaagggggggggtgagggttgagaacctatgaacattctgtagggccactgtcttctccacggtgctcccttcatgcgtgacctggcagctgtagtcttttgtgggacttccatgctcgaggcgtcaggctcgaggtagctgcgtggccgtcgtacttgttgttgtgttttgttgggtagggttgtttgggcggtagggaacaagctcggtaccgtcgtaggtcacggcccgaaggtctccgtccccctcggtccactccttccgttccccgccccttcctcaacgttagtactacgacctaggacggcgggtacnggacgaaggcgcagtagnnnnnnnnnnnnnnnnnnnnnnnn

SEQ ID NO: 187256 - DNA, 391 bp, Homo sapiens
  misc_feature: GYAE6OF01CV5M3.41.80.H03.1.454.CMB.1.raw
  modified_base (373)..(391): a, c, t, g, unknown or other
  misc_feature (373)..(391): n is a, c, g, or t
tcagtctatactatcacgaccggtgctcgatttagctgtgcgtcgaagggaaaggggtgcgtgaagggaaagggttgagaacctatgaacattctgtagggccactgtcttctccacggtgctcccttcatgcgtgacctggcaggctgtagtcttttgtgggacttattactgctcagcagtgggacaagaagcaatcaacaggtcgttgggtggtttgggacgggacggaccaagctgaccgtcctaggtcacgcccgaaggcctccggtcccctcggtacctcgttccgttccgtccccgccctacctaccattacgtaatacggtactggacggccgggacgtacgggaccgaaggccgacgtaagagnnnnnnnnnnnnnnnnnnn

SEQ ID NO: 187257 - DNA, 493 bp, Homo sapiens
  misc_feature: GYAE6OF01EBG7A.41.80.H03.1.454.CMB.1.raw
  modified_base (119)..(119): a, c, t, g, unknown or other
  misc_feature (119)..(119): n is a, c, g, or t
  modified_base (128)..(128): a, c, t, g, unknown or other
  misc_feature (128)..(128): n is a, c, g, or t
  modified_base (449)..(493): a, c, t, g, unknown or other
  misc_feature (449)..(493): n is a, c, g, or t
tcagtctatactatcacgaccggtgctcgatttagctgtgcgtcggaaggggaaagggggggggtgagggttgagaacctatgaacatttctgtaggggccactgtcttctccacggtncctcccttnatgcgtgacctggcagctgtagtctttttggcggtaccttcccactgctcgaggcgtcacggctcgaggttgcctgctcggccctcgttactttggtttggttgtctttttggtttgggagggtttcggtttggggcgggacgggacccaaggtccgttcggaacccgttccgtagggtccacgcccgaaggtcctccgtccccccgttccgtacacccgttccgttccgttccccgcccccttcctacgtaattaacgtactaacggtactgggaccggccggggtcgttacgggccgtaaacggcgtactaagagtgcnnnnnnnnnnnnnnnnnnnnnnnnnnnnnnnnnnnnnnnnnnnnn

SEQ ID NO: 187258 - DNA, 365 bp, Homo sapiens
  misc_feature: GYAE6OF02GKAHZ.41.80.H03.1.454.CMB.1.raw
  modified_base (304)..(304): a, c, t, g, unknown or other
  misc_feature (304)..(304): n is a, c, g, or t
  modified_base (325)..(365): a, c, t, g, unknown or other
  misc_feature (325)..(365): n is a, c, g, or t
tcagtctatactatcacgaccggtgctcgatttagctgtgcgtcgaagggaaggggtgcgtgaaggaaggttgtaggaaccctatggaaccattcgtacgtaggggccactgtcttctccacggtgctcccttcatgcgtgacctggcagctgtagcttttgtgggactattactgctcagcatgggactagaagcagtcgacagcttgggtcgtttggcggagggaccaagctgaccgtctaggtcagcccaaggctgcccctggtcactctgttcccacctcctcatagtatagacctggancgggctggcaaggcgcatagnnnnnnnnnnnnnnnnnnnnnnnnnnnnnnnnnnnnnnnnn

SEQ ID NO: 187259 - DNA, 344 bp, Homo sapiens
  misc_feature: GYAE6OF02F3HDD.41.80.H03.1.454.CMB.1.raw
  modified_base (339)..(344): a, c, t, g, unknown or other
  misc_feature (339)..(344): n is a, c, g, or t
tcagtctatactatcacgaccggtgctcgatttagctgtgcgtcgaagggaaagggggggtgagggttgagaacctatgaacattctgtaggggccactgtcttctccacggtgctcccttcatgcgtgacctggcagctgtagcttttgtgggacttccactgctcaggcgtcaggctcaggtagctgctggccgcgtacttgttgttgctttgtttggagggtgtttggcggagggaccaagctgaccgtcctaggtcagcccaaggctgccccctcggtcactctgttcccgccctcctcatagtatagactgagcgggctggcaaggcgcatagnnnnnn

SEQ ID NO: 187260 - DNA, 345 bp, Homo sapiens
  misc_feature: GYAE6OF02JCP0M.41.80.H03.1.454.CMB.1.raw
  modified_base (337)..(345): a, c, t, g, unknown or other
  misc_feature (337)..(345): n is a, c, g, or t
tcagtctatactatcacgaccggtgctcgatttagctgtgcgtcgaagggaaaggggggtgagggttgagaacctatgaacattctgtaggggccactgtcttctccacggtgctcccttcatgcgtgacctggcagctgtagcttttgtgggacttccactgctcaggcgtcaggctcaggtagctgctggccgcgtacttgttgttgctttgtttggagggtgtttggcggagggaccaagctgaccgtcctaggtcagcccaaggctgccccctggtcactctgttcccgccctcctcatagtatagactgagcgggctggcaaggcgcatagnnnnnnnnn

SEQ ID NO: 187261 - DNA, 325 bp, Homo sapiens
  misc_feature: GYAE6OF02GGC2K.41.80.H03.1.454.CMB.1.raw
  modified_base (319)..(325): a, c, t, g, unknown or other
  misc_feature (319)..(325): n is a, c, g, or t
tcagtctatactatcacgaccggtgctcgatttagctgtgcgtcgaagggaaaggggtgcgtgaagggaaagggttgagaacctatgaacattctgtaggggccactgtcttctccacggtgctcccttcatgcgtgacctggcagctgtagcttttgtgggactattactgctcagcatgggacagaagcatcacagcttgggtgtttggcggagggaccaagctgaccgtcctaggtcagcccaaggctgccccctcggtcactctgttccccgcctcctcatagtatagactgagcgggctggcaaggcgcatagnnnnnnn

SEQ ID NO: 187262 - DNA, 614 bp, Homo sapiens
  misc_feature: GYAE6OF02I34MN.41.80.H03.1.454.CMB.1.raw
  modified_base (256)..(256): a, c, t, g, unknown or other
  misc_feature (256)..(256): n is a, c, g, or t
  modified_base (423)..(423): a, c, t, g, unknown or other
  misc_feature (423)..(423): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (448)..(448): a, c, t, g, unknown or other
  misc_feature (448)..(448): n is a, c, g, or t
  modified_base (468)..(468): a, c, t, g, unknown or other
  misc_feature (468)..(468): n is a, c, g, or t
tcagtctatactatcacgaccggtgctcgattttagctgtgcgtcgaaggggtaaagggggggggtgagggttgagaaccctatgaacattctgttagggccactgtcttctccacggtgctcccttcatcgtcgtgaccttggcacgctgtacgctttttggtagggactttccacttgctcaggcgtaccaaggctacgacggtagctgctggccgcgttacttcgtttgttgtcttttggttttggagggttntttggcggtagggaccaaggctgaccgtcgtagggtcacgtcccaaggccgacggacccccgtcggtccaacgttcttcgttaccccgacccttcctactattagttactaagacgttgacggacgggacttcgggacagggtaccgacttaattacgagtgactananacanacacgacacacgacgagtnacgatagcacacacgagcgngacgacgacgcacacgtatatatgtcacacgacacagactacgacgtaggacgtacgtacgacgtacacgtacgaccgaccgtacgacgtaccggtacgtacgtacgtacacacgtacgacgaccgaccgaccgtaccgtactacg

SEQ ID NO: 187263 - DNA, 367 bp, Homo sapiens
  misc_feature: GYAE6OF02HW7FT.41.80.H03.1.454.CMB.1.raw
  modified_base (352)..(367): a, c, t, g, unknown or other
  misc_feature (352)..(367): n is a, c, g, or t
tcagtctatactatcacgaccggtgctcgatttagctgtgcgtcgaaggggaaaggggggggggtgagggttgagaacctatgaacattctgtaggggccactgtcttctccacggtgctcccttcatgcgtgacctggcagctgtagctttttgtgggacttccactgctcaggcgtcaggcctcaggtagctgctggccgcgtacttgttgttgcttttgtttgggagggtgtttggcggagggaccagctgaccgtctaggtcagcccaaggcctgccccctggtcactctcgttccccgccctcctcatagtatagactggacgcggggctggcaaggccgcagtagnnnnnnnnnnnnnnnn

SEQ ID NO: 187264 - DNA, 175 bp, Homo sapiens
  misc_feature: GYAE6OF01CTPY5.17.35.D02.1.454.CMB.1.raw
  modified_base (175)..(175): a, c, t, g, unknown or other
  misc_feature (175)..(175): n is a, c, g, or t
tcagcgtagactagcacgaccggtgctcgatttagcacacgatagttgggtttgggggaagaggaagactgacggccctgctccaggagcacctccgagagcacagcggccctgggctgcctggtcaaggactacttccctagtctacgctgagcgggctggcaaggcgcatagn

SEQ ID NO: 187265 - DNA, 368 bp, Homo sapiens
  misc_feature: GYAE6OF01EGNA7.17.35.D02.1.454.CMB.1.raw
  modified_base (364)..(368): a, c, t, g, unknown or other
  misc_feature (364)..(368): n is a, c, g, or t
tcagcgtagactagcacgaccggtgctcgatttagcacacgatagttgggtttgggtgccgaagttgctggaggtcacggtcaccacgctgctgagggagtagagtcctgaggtctgtgaccgctgcggacacggccctttattactgtacgcgagggcccctatcgagcgactatgatcccaggccctttgactcctggggccagggaaccctggtcaccgtctcctcagcctccaccaagggcccatcggtcttcccctggcgccctgctccaggagcacctccgagagcacagcggccctgggctgcctggtcaaggctacttccctagtctacgctgagcgggctggcaaggcgcatagnnnnn

SEQ ID NO: 187266 - DNA, 225 bp, Homo sapiens
  misc_feature: GYAE6OF02IB2U3.17.35.D02.1.454.CMB.1.raw
  modified_base (219)..(225): a, c, t, g, unknown or other
  misc_feature (219)..(225): n is a, c, g, or t
tcagcgtagactagcacgaccggtgctcgatttagcacacgatagttgggtttggggccagggaaccctggtcaccgtctcctcagcctccaccaagggcccatcggtcttcccctggcgccctgctccaggagcacctccgagagcacagcggccctgggctgcctggtcaaggactacttccctagtctacgctgagcggctggcaaggcgcatagnnnnnnn

SEQ ID NO: 187267 - DNA, 177 bp, Homo sapiens
  misc_feature: GYAE6OF02GL03K.17.35.D02.1.454.CMB.1.raw
  modified_base (175)..(177): a, c, t, g, unknown or other
  misc_feature (175)..(177): n is a, c, g, or t
tcagcgtagactagcacgaccggtgctcgatttagcacacgatagttgggtttgggggaagaggaagactgacggccctgctccaggagcacctccgagagcacagcggccctgggctgcctggtcaaggactacttccctagtctacgctgagcgggctggcaaggcgcatagnnn

SEQ ID NO: 187268 - DNA, 371 bp, Homo sapiens
  misc_feature: GYAE6OF02F08R5.17.35.D02.1.454.CMB.1.raw
  modified_base (356)..(356): a, c, t, g, unknown or other
  misc_feature (356)..(356): n is a, c, g, or t
  modified_base (362)..(371): a, c, t, g, unknown or other
  misc_feature (362)..(371): n is a, c, g, or t
tcagcgtagactagcacgaccggtgctcgatttagcacacgatagttgggtttgggtgccgaagttgctggaggtcacggtcaccacgctgctgagggagtagagtcctgaggtctgtgaccgctgcggacacggccctttattactgtgcgcgagggcccctatcgagtgactatgatcccaggccctttgactcctggggccagggaccctggtcaccgtctcctcagcctccaccaagggcccatcggtcttccccctggcgccctgctccaggagcacctccgagagcacagcggccctgggctgcctggtcaaggctacttcctagtctacgctgagcggctggcaaggcncatagnnnnnnnnnn

SEQ ID NO: 187269 - DNA, 226 bp, Homo sapiens
  misc_feature: GYAE6OF02J1551.17.35.D02.1.454.CMB.1.raw
  modified_base (221)..(226): a, c, t, g, unknown or other
  misc_feature (221)..(226): n is a, c, g, or t
tcagcgtagactagcacgaccggtgctcgatttagcacacgatagttgggtttgggggccagggaaccctggtcaccgtctcctcagcctccaccaagggcccatcggtcttcccctggcgccctgctccaggagcacctccgagagcacagcggccctgggctgcctggtcaaggactacttccctagtctacgctgagcgggctggcaaggcgcatagnnnnnn

SEQ ID NO: 187270 - DNA, 606 bp, Homo sapiens
  misc_feature: GYAE6OF02FI92P.17.35.D02.1.454.CMB.1.raw
  modified_base (435)..(435): a, c, t, g, unknown or other
  misc_feature (435)..(435): n is a, c, g, or t
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
  modified_base (462)..(462): a, c, t, g, unknown or other
  misc_feature (462)..(462): n is a, c, g, or t
  modified_base (479)..(479): a, c, t, g, unknown or other
  misc_feature (479)..(479): n is a, c, g, or t
tcagcgtagactagcacgaccggtgctcgatttagcacacgatagttgggttttggggtgccgaagttgctcgaggtcacggtcaccacgctgctgagggagtaggacgtcctgaggtctcgtggaccgcctgccggacaccggcccttttattactcgtgcgccgagggcccctatcgagtgacctatgactccccaggcccctttgactccgtcggggtccacggaccctggtcaccgtctcctcacgcctccaccgaacggccctagtccggtccttcccccgtggccgtccctagcctaccaggacgtcacctccggagacgcacgagccggaccctggggcctccgcctggtacaacggtacttacttccctagtcctacgtctaggacggtccggcttcggacgtacggccgtcgacgttaggctgacngactgctactcaccngacncgcncncncacgacgacgtactctntactactctactctctactacgtactactactaccgtactacgtaccgacgtacgacgtacgtacgtacgtacgacgtacgtaactacgacgtacgtacgtcgacactacgtacgtactacctctac

SEQ ID NO: 187271 - DNA, 496 bp, Homo sapiens
  misc_feature: GYAE6OF01CE6XW.4.47.E03.1.454.CMB.1.raw
  modified_base (314)..(314): a, c, t, g, unknown or other
  misc_feature (314)..(314): n is a, c, g, or t
tcagagcactgtagcacgaccggtgctcgatttagactcgcgcacagagagaaggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgaccctccgggatccctgagagattcnctggctccagctcagggacaatggccacttgactatcagtgggccaggtggaggatgaacctgactactattgttactcaacagacagcagtgactaatcaatggggtgttcggcggagggatcaagctgaccgtctaggtcagcccaaggctcgccccctggccatcctgtcccctacccc

SEQ ID NO: 187272 - DNA, 524 bp, Homo sapiens
  misc_feature: GYAE6OF01CDM0C.4.47.E03.1.454.CMB.1.raw
tcagagcactgtagcacgaccggtgctcgatttagactcgcgcacagagagaagggggtgggctcaggaggcagagctctgggaatctcaccatggcctggaccctctcctgcctcccctcctcactttctgcacagtctctgaggcctcctatgagctgacacagccaccctcggtgtcagtgtccccaggacaaacggccaggatcacctactctggagatgcattgccataccagcagaagtcagaccaggccctgttctggtcatctgtggagacaccaaacgacccctccgggatccctgagagattctctggctccagctcagggacaatggccaccttgactatcaagtgggcccagggtggaggatggaacctgacttactattgttactcaacagacagccagtcataatcaagttggggtgttcggcgggagggatcaaggctgacccgtcctaggtcctaggcccaaggccctcgccccccgtcggtaccacgttcctcgttcccctaccccg

SEQ ID NO: 187273 - DNA, 518 bp, Homo sapiens
  misc_feature: GYAE6OF01AR14Y.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctcccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgccctccgggatccctgagagattctctggctccagctcgagggacaatcggccacttgactatcaggtcggggccagggtggagatgaacctgactactattgttactcaacagacagcagtgactaatcagtggggtgttcgggcggagggatcgaagcgtagcccgtcgtaggtcagcccaaggccctcggccccctcggtaccaccttccgttcgtccccgtccccg

SEQ ID NO: 187274 - DNA, 526 bp, Homo sapiens
  misc_feature: GYAE6OF01CHO2W.4.47.E03.1.454.CMB.1.raw
tcagagcactgtagcacgaccggtgctcgatttagactcgcgcacagagagaagggggtgggctcaggaggcagagctctgggaatctcaccatggcctggaccctctcctgctcccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgaccctccgggatccctgagagattctctggctccagctcagggacaatggccacttgactatcagtgggcccagggtggaggatgaacctgactatattgttactcaacagacagcagtgactaatcaagtggggtgttcgggcggagggatcgaagtctaggaccgtccgtaggtccaggaccccaagggcctacggccccccgttcgggtcccacttccttcgttccccctaccccc

SEQ ID NO: 187275 - DNA, 791 bp, Homo sapiens
  misc_feature: GYAE6OF01CKDHM.4.47.E03.1.454.CMB.1.raw
  modified_base (135)..(135): a, c, t, g, unknown or other
  misc_feature (135)..(135): n is a, c, g, or t
tcagagcactgtagcacgaccggtgctcgatttagactcgcgcacagagagaagggggtgggctcaggaggcagagctctgggaatctcaccatggcctggacccctctcctcgccctcccctcctctactttcngcactacgtctcgaggacggtccctctagtagacgctacgacacgacgcccctacccgtcggtcgtacgacgtcccgtaccccgaaggaaaccgaaaccggccgaaggtactacctaaccttacgtcgagggaatatcgactagtccgacctaactaccgagacgaaggtaacgtcgaaccgaaccgtaccggtcccttgttcgtggtacctagtcgtaggtacggaacaaccaacccgaaaacccgtcccggtacggtacctccgaggaacgtacgtctttcgtcggtcgtacctacgacggtcctaacgggacggaaactacggtaccggaacccttacgttaacgtaaacttacgacgggtacggggtacccgggaccggtaagggggtacgggaacggttacgtaacccgggtaaccgttaacggttaaaccctttaacttttaacggtttaaccgtaacctaaaccggaaacggacgtaaccgaaggtacctaacgggttactaaacccgttaagtcgtagggggttcggggtacggtaccgggaggtaaggtacctaggaacgtcggtaccgtaccggtacgacggtacacccggacgtcggtcccgtacccgtcccgtacgactacccttcgttcccctcctacccccg

SEQ ID NO: 187276 - DNA, 516 bp, Homo sapiens
  misc_feature: GYAE6OF01EBIVK.4.47.E03.1.454.CMB.1.raw
  modified_base (413)..(413): a, c, t, g, unknown or other
  misc_feature (413)..(413): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctactctggagatgcattgccataccagcagaagtcagaccaggcccctgttctggtcatctgtggagacaccaaacgccctccgggatccctgagagattctctggctccagctcgagggacaatggccacttgactatcagtgggcccaggtggaggatgaacctagactactattgttactacaacagacagcagtgntaatcagtggggtgttcgggcgggaggatcgaagcgtgaccgtcgtacggtctagacccgaaggcctcgccccccgtcggtccacctcttcgtccccgtcccc

SEQ ID NO: 187277 - DNA, 667 bp, Homo sapiens
  misc_feature: GYAE6OF01CSPPD.4.47.E03.1.454.CMB.1.raw
  modified_base (291)..(291): a, c, t, g, unknown or other
  misc_feature (291)..(291): n is a, c, g, or t
  modified_base (330)..(330): a, c, t, g, unknown or other
  misc_feature (330)..(330): n is a, c, g, or t
tcagagcactgtagcacgaccggtgctcgatttagactcgcgcacagagaggaagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcactactctggagatgcattcgccataccagcaagaagtcacgaccacggcccctgttcgtggtccatcgtgtcggaanaccaccaaaccgccctcgggactcccgagagagacttcncgtggcctccgagctacgaggacaagtcggacctacgttagacttacgacgacggttcgggacccgagggtacggaaggtacgtacgaaccgtcggaacttacttaattcgtttaacacaaacacgaacgacgacgtacgttgaacttaacgtacgtaaggttggggttcgttacgggacgggtaagggactacggaacgtcgttaccggacccgttaccgtaacgggtccaaccgggaaccccgtaacgggtacccgttccccggtacccccccgtttaccggggtacccttaacccgttccccgtttccccgggtttccccccggttcccccccg

SEQ ID NO: 187278 - DNA, 529 bp, Homo sapiens
  misc_feature: GYAE6OF01A7CNV.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgaccctccgggatccctgagagattctctggcctccagctcagggacaatcggccaccttgactatcagtgggcccaggtggaggatgaactgactactattgttactcaacagaccagcagtgactaatcaagtggggtgttcgggcggagggatacaagctgaccgtcctagggtcagccccggaaggccctccggccccccgttcggtccaccgttcccttcgttccccctacccccg

SEQ ID NO: 187279 - DNA, 560 bp, Homo sapiens
  misc_feature: GYAE6OF01CX76V.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccacggccctgttctggtcatctgtggagacaccaaaccgaccctaccgggggggactccgtgagagattctctggctccagctcgagggacaatcggccaccttgactatcgaggtcgggcccgagggtggaggagtacgaaccgtgactacttattagttactacaacacgacagcagtgactaatcgtagttggggttggttcgggcgggagggacgtacgaagtcgtcgaccgtccgtacggtcgacgacccgaacggccgtccgcccccgtccggtcctacctccgttccgttcccctacccccg

SEQ ID NO: 187280 - DNA, 512 bp, Homo sapiens
  misc_feature: GYAE6OF01EL80A.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgaccctccgggatccctgagagattctctggctccagctcgagggacaagtggccaccttgactatcaggtcggggcccaggtggaggatgaacctgactactattgttactcaacagacagcagtgactaatcagtggggttgttcgggcggagggatcgaagcgtagaccgtccgtaggtcacgcccgaaggcctcgccccctggtccacgtcttcccg

SEQ ID NO: 187281 - DNA, 517 bp, Homo sapiens
  misc_feature: GYAE6OF01DCVYJ.4.47.E03.1.454.CMB.1.raw
  modified_base (505)..(505): a, c, t, g, unknown or other
  misc_feature (505)..(505): n is a, c, g, or t
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctactctggagatgcattgccataccagcagaagtcagaccaggcccctgttctggtcatctgtggagacaccaaacgccctcgggatccctgagagattctctgctccagctcgagggacaagtcggacccacttgactatcgaggtcggggcccagggtggaggatagaacctgaactactattgttactcaacagacagcagtgactaatctagtggggtgttcgggcgggaggatacaagctggaccgtcgtaggcacggcccgaaggcctcgaccccctggtccnccgttcctcccg

SEQ ID NO: 187282 - DNA, 789 bp, Homo sapiens
  misc_feature: GYAE6OF01C8SBF.4.47.E03.1.454.CMB.1.raw
  modified_base (426)..(426): a, c, t, g, unknown or other
  misc_feature (426)..(426): n is a, c, g, or t
tcagagcactgtagcacgaccggtgctcgatttagactcgcgcacagagagaagggggtgggctcaggaggcagagctctgggaatctcaccatggccctggacccctctcccgtctcccctcccctcctaccttctttcgcaccacgtctctcgaggccgtccctactagaggctcgacacacgccgacccctccggtggtcgacgtcgtcccgaccggaacgaacgaccgacgagacacctacctacgtggaggatgcatcgtccgactacacgacgtacgaaaggtcacgaaccgaccggtcccgttccgtttgtcggtacgtactccgttggtagggaacgaacccaaaccccgaaaacccggtaacccccgtccccgggtaacgtacccttaccggaaggtacgtaactttcctttcccgngggtaccctccctaaggacccgttaccgaacgggggaaaccgtaacttcgggcccccgtaaccctttaggtaacgtaaacttcgggacgggttacgggggccccggaaggttggggaaggacgttacgtaacccgtacgtaacgttaacttaagtttacgttaaccgtaacaaaccggagtaacgtacgcgtaacgtggtactaaccgtagtaccggttagggggttcggttacgggacggggaagggtactacaacgaccgttcgacccggtaccgtaggtaccgccgaccccgaaggtcccgtcccgtacccccgtccggtactacccttccgttccccggttcccccgcccccgttaccc

SEQ ID NO: 187283 - DNA, 554 bp, Homo sapiens
  misc_feature: GYAE6OF01EKFF7.4.47.E03.1.454.CMB.1.raw
  modified_base (453)..(453): a, c, t, g, unknown or other
  misc_feature (453)..(453): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaaccgccctccgggatcccgtgagagtattctctgctccagctcgagggacaagtcggccaccttgactatcgaggtcggggacccagggtggaaggatacgaacctgtactactattagttactacaactagacagcagtcactaatcgtaagtggggtgttcgggnggaggatacgaagtcgtagtacccgtcgtacggtccacgacccgtaaggccctccggccccccgttcggtaccaccgttccgttccgttccccctaccccc

SEQ ID NO: 187284 - DNA, 792 bp, Homo sapiens
  misc_feature: GYAE6OF01CSPX1.4.47.E03.1.454.CMB.1.raw
tcagagcactgtagcacgaccggtgctcgatttagactcgcgcacagagagaagggggtgggctcaggaggcagagctctgggaatctcaccatggcctggaccctctcctgcctccccctcctcactttctgcacagtctctgaggcctcctatgagctgacacagcccaccctcggtgtcagtcgtccccaggacaaacggccaggatcacctactcgtggagatgctattgccataccagcagaatcagaccacggccctgttctggtctatctgtaggacgacaaccgaaaccgacccgtaccgggactcccgtaggacgagtacttcgtcgtacggtctaccgagtcctacgaaggggaacctaagtccggtaccctaaccgtttacgtaacttacgtaccggtaacgggttaccgggggaccccggtaggggtacgggtaacgggtaagtaccgggtaaaccgttacggtaaacctttaaccgtttaacgttttaccggttaaccgttaaccgtaaaccgaagtaaccgaacggtaccgtaaggttacgtaacgtttaacgtccggttaaggggttcgggggtttacgggttaaccgggggacggggttaacggggtaacgttacggaaacgggtcccggtacggtaacccccgggtttaccggtaacgggttacccgaacccgggtaccccggtaaacgggggtccccttccccgggttaccccccggtccgggttacccctacccgttttcccggttaccccgttcccccccgttaaccccccg

SEQ ID NO: 187285 - DNA, 564 bp, Homo sapiens
  misc_feature: GYAE6OF01CKL6U.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggactcacctactctggagatgcattgccataccagcagaagtcagaccaggcccctgttctggtcatctgtggagaccaaccaaaccgacccgtccgggactccctgagagattctcgtcggctccagctcgagggacaagtcggacccacttagactatcgagggtcggggacccagggtaggaggtaagtcggaaaccctgaacttacttatttacgttacctacaaacagacagcagtcgactaatcgaggttggggtggttcggggacggagggactcgaagcgtcgtacccgttccgtaggtcacggacccgaaggcccgtccgcccccgtcggtccaccgtccttcccg

SEQ ID NO: 187286 - DNA, 796 bp, Homo sapiens
  misc_feature: GYAE6OF01DQFRF.4.47.E03.1.454.CMB.1.raw
  modified_base (225)..(225): a, c, t, g, unknown or other
  misc_feature (225)..(225): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctactctgganatgctattgccataccgagcaagaacgtcaacgaccacggcccctgttcgtggtcatctggtggacgaccaccaaaccgacccgtaccgggactccccgtagacgtagtacttcctcgtcggccttccgagtccgtacgaacgggaactaacgtcggaccctacgttacgactacgtacgacgggtcggggacccgtaggggtgggaacgggtacgtacggaaacccgttacggtaaacctttaaccgtttaagtttacgtttaacctaccgaaacgtaacggtaaccgaaggtaccgtaaggttacggtaacctttaaacgtccggtaagggttacgggggtttacgggttaccggggggtaaccggggtaagggggtaaccttaccgggtaaacgggtacccggttacgggtaaccccccggtttacggtaacggggtttaccccgaacccgggtacccccggtaaacgggtcccccggttacccccgggtaccccccccggttaccgggttaccctaaccccggttttccccgtttaccccggttacccccccccttaacccccccgg

SEQ ID NO: 187287 - DNA, 536 bp, Homo sapiens
  misc_feature: GYAE6OF01EG2SA.4.47.E03.1.454.CMB.1.raw
  modified_base (222)..(222): a, c, t, g, unknown or other
  misc_feature (222)..(222): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctgganatgcattgccataccagcagaagtcagaccaggcccctgttctggtcatctgtgagacaccaaacgaccctccgggatccctgagagattctctggctccagctcagggacaatggccaccgttgactatcgaggtcgggcccgaggtggaggatagaacctgactactattgttactacaacagacagcagtcgctaatcgtagtgggtgttcgggacggagggatacgaagcgtacgacccgttccgtagggtccagacccgaaggcctccgcccccgtcggtccaccttccgttccgttcccccgtccccg

SEQ ID NO: 187288 - DNA, 546 bp, Homo sapiens
  misc_feature: GYAE6OF01AU2DN.4.47.E03.1.454.CMB.1.raw
  modified_base (350)..(350): a, c, t, g, unknown or other
  misc_feature (350)..(350): n is a, c, g, or t
  modified_base (437)..(437): a, c, t, g, unknown or other
  misc_feature (437)..(437): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgccctccgggatccctgagagattctctggctccagctcagggacaatggccaccttgactntcgagtcggggcccagggtggaggatgaacctgactactattgttactcaacagacagcagtgactaatcaagtggggtgttcgggnggagggtatacgaagcgtcggtacccgtccgtaaggtccaggccccgaagggcctaccggccccccttcggggttaccctaccgttcccttccgttcccccggtccccc

SEQ ID NO: 187289 - DNA, 558 bp, Homo sapiens
  misc_feature: GYAE6OF01BXHGO.4.47.E03.1.454.CMB.1.raw
tcagagcactgtagcacgaccggtgctcgatttagactcgcgcacagagagaagggggtgggctcaggaggcagagctctgggaatctcaccatggcctggaccctctcctgctccccctcctcactttttgcacagtctctgaggcctcctatgagctgacacagcccaccctcggtgtcagtgtccccaggacaaacggccaggatcacctactctggagatgcattgccataccagcagaagtcagacccaggcccctgttctggtcatctgtggagacaccaaacgcccctcgggatccctgagagtattctctggctccagctcgagggacaagtcgccacttgactatcgaggtcgggcccagggtggaggatacgaaccgtgaactactattgttactacaacagacagcagtgactaatcgagttgggtgttcgggagggtaggagtcgaagtcgtacgtaccgtccgtacggtcgacggtacccaagggtcccgtaccgcccccgttcggtccctaccgttcccttccgttccccctccccttaccccg

SEQ ID NO: 187290 - DNA, 556 bp, Homo sapiens
  misc_feature: GYAE6OF01DPASP.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctactctggagatgctattgccataccagcagaagtcagaccaggcccctgttctggtcatctgtggagacaccaaacgaccctccgggatccctagagagattctctggctccgagctcgaagggacaagtcggcctacttgactatcgaggtcggggcccagggtcggaaggatacgaactgacttaactagttgttaactactaaacacgaacacgcagtgacttaatcgtaagtggggtgttcgggcggagggatacgaagtctacggacccgttccgtaggtccacgcccgaaggcctccggcccccgtcggtccaccttcgttccgtccccgtcccc

SEQ ID NO: 187291 - DNA, 503 bp, Homo sapiens
  misc_feature: GYAE6OF01A92MV.4.47.E03.1.454.CMB.1.raw
  modified_base (494)..(494): a, c, t, g, unknown or other
  misc_feature (494)..(494): n is a, c, g, or t
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgaccctccgggatccctgagagattctctggctccagctcgagggacaatggccacttgactatcagtcggggcccaggtggagatgaacctgactactattgttactcaacagacagcagtgctaatcagtggggtgttcgggcggaggatcgaagctaggaccgtcgtaggtcacgcccgaaggcctcgccccctggtccncgtctcccg

SEQ ID NO: 187292 - DNA, 723 bp, Homo sapiens
  misc_feature: GYAE6OF01CW338.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgcctccccctcctcactttctgcacagtctctgaggcctcctatgagctgacacacgcccacccgtcggtgtcagtcgtcccaggacaaacggccaggactcacctactcgtggagatgcattcgaccataccagacaagaagtacaacgacccgacggccccttgttcgtcggtctagtcgtaggtggaacgaccaaccgaaaccgtacccgtaccgggactcccgtagacgtagtacttcctcgtacggcctccgacgtctacgaagggaactaacgtcggaccctaccgttgaacttacgtacggtagggtccggggacccgtaggggtacgggaacggtaacgtacggtaaacccgttacgtaaaccttaacgtttacgttacggtttaacctaaccgaaacgtaacgtaaccgacgtacgtaacggtacgtaacttaacgtccggtaagggttcgggggttacggttaccggggacgggagggtaacgtcggtaacggtccgttaccggacccggttaccgtaacgggtccgaccggaccccggtaacggtccccgtacccggtacccccgttacggtaccctcccgttcccggttacccccg

SEQ ID NO: 187293 - DNA, 529 bp, Homo sapiens
  misc_feature: GYAE6OF01BSYY6.4.47.E03.1.454.CMB.1.raw
  modified_base (435)..(435): a, c, t, g, unknown or other
  misc_feature (435)..(435): n is a, c, g, or t
  modified_base (456)..(456): a, c, t, g, unknown or other
  misc_feature (456)..(456): n is a, c, g, or t
  modified_base (498)..(498): a, c, t, g, unknown or other
  misc_feature (498)..(498): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctactctggagatgcattgccataccagcagaagtcagaccaggcccctgttctggtcatctgtggagaccaccaaaccgaccctccgggactccctgacgagacttctctcggcctccgagctcgaagggacaagtcggccctaccgttgactatcgaggtcggggcccagggtggaggtatgaacctgactactattagttacctacaacagacagcagtnactaatcagtgggtggtcggngggaggatacgagctcgaccgtccgtaaggcagcccaggccncgccccgtggaccatcctcgtccccgtcccc

SEQ ID NO: 187294 - DNA, 688 bp, Homo sapiens
  misc_feature: GYAE6OF01CWHOO.4.47.E03.1.454.CMB.1.raw
tcagagcactgtagcacgaccggtgctcgatttagactcgcgcacagagagaagggggtgggctcaggaggcagagctctgggaatctcaccatggcctggaccctctcctgcctcccctcctcactttctgcacagtctctgaggcctcctatgagctgacacagccacccgtggtgtcagtcgtcccaggacaaacggccaggactcacctactcgtggagatgctattcgaccataccgagcaagaacgtcacgaccacggccctgttcgtggtcatcgtgtacggacgaccaaccaaccgcccgtcggactcccgtaggacgtacgtacttctcgttcggacctccgaacgtcctacggacgggaactaacgtcggaccctacgtttacggaactacgttcggaacgggtccggggacccgtaggggtacgggaaggtacgtacggaaccgttcggtaaactttacgttaagttacgtttaaccaacgaacgtaacgacgtacgacgtacgtgtaacgtaagtccgtaaggggttcggggttaggttaccgggacgggtacggtacgtacgaacggtctacggtacccgttacggtacggtaccgaccggaccgtaacggtcccgtcccggtaccccgttacgggtaccctacggtttccctccccgttaccccgttacccccg

SEQ ID NO: 187295 - DNA, 554 bp, Homo sapiens
  misc_feature: GYAE6OF01AO27Q.4.47.E03.1.454.CMB.1.raw
  modified_base (424)..(424): a, c, t, g, unknown or other
  misc_feature (424)..(424): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctactctggagatgcattgccataccagcagaagtcagaccaggcccctgttctggtcatctgtggagacaccaaacgcccgtccgggactccctgagagtattctcgtggctccagctcgagggacaagtcggcctacttgactatcgaggtcgggcccagggtggaggatcgaacctgacttactattcgttacacaacagacagcagtnactaatcgaggttggggtgttacgggcgggaggatcgaagcgtacgacccgtacgtaggtccacggacccgaacggccctccggccccccgttcggtaccctaccgttcccgttccgtccccctaccccg

SEQ ID NO: 187296 - DNA, 549 bp, Homo sapiens
  misc_feature: GYAE6OF01A65S3.4.47.E03.1.454.CMB.1.raw
  modified_base (433)..(433): a, c, t, g, unknown or other
  misc_feature (433)..(433): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctggtgtcagtgtccccaggacaaacggccaggatcacctactctggagatgcattgccataccagcagaagtcagaccaggcccctgttctggtcatctgtggagacaccaaacgcccgtccgggactcccgtgagagattcctctggcctccagcctcgagggacaagtcggcctaccttgactatcgaggtcggggcccagggtggaggtatcgaacctgaaccttactagttacgttactacaactagacagcagtnactaatcgagttgggtgttcgggaggtaggatacgaagctcggtaccgtacgtaggtccacgcccgaagggcctccggcccccgtcggtccaccttccgtccgttcccccgtcccc

SEQ ID NO: 187297 - DNA, 537 bp, Homo sapiens
  misc_feature: GYAE6OF01BZZBD.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgaccctccgggactccctgagagattctctggctccagctcagggacaagtcggcctaccgttgactactcgaggtcggggcccagggtcggaaggtagtacgaaccctagacttactattgttactacaacagacagacagtgactaatcgagtggggtagttcgggcggaggagtacgaagtctaggtaccgtcgtaggtcacggacccaaggccctcgccccctcggtcctccgtcgtccccg

SEQ ID NO: 187298 - DNA, 831 bp, Homo sapiens
  misc_feature: GYAE6OF01AZQQ4.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctactctggagatgctattcgccataccagcagaagtcacgaccacggcccctgttctggtcatctgtaggacgaccaccaaaccgcccgtccgggactcccgtaggacgtacgtactttcctcgttcgggccttccgaacggtccttaccggaacggggtaacctaaacgttccgggtacccctaaccgtttacggaaccctttaacgtacccggaacggggttcccgggggaccccgtaagggggttacggggaacgggtaacgttaccgggtaaaccccgttagggttaaacccttaaccgtttaacgttttaccggtttaaaccctaacccgtaaaacccggtaacggaaacccgtaacggtacccgttaacgggttaccgttaaccgttaaaggttcccggttaaggggtttcgggggggtttaccggtttaccggggggaacggggtaacggggtaacgttaccgtaaacgggtcccgtaccgggttaacccccggttaccggtaacgggttacccgaacccggtaccccggaacgggtccccgttaccccgggtccccccgttcgggtaccctacccgttcccgtttccccgggttccccccgtccccccg

SEQ ID NO: 187299 - DNA, 590 bp, Homo sapiens
  misc_feature: GYAE6OF01BH4TT.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctactctggagatgcattgccataccagcagaagtcagaccacggcccctgttctggtcatctgtggagaccaccaacgaccctcgggactcccgtgaagagtattcctctcggcctccgagcctacgacgggaacaagtcggacctaccgttgaactactcgacgggtacggggcccgtagggtggaacggagttacggaaaccctggaccttaacttagtttcgttaacctcaaactagaccagtcaagtcgactaagtcgtaggttcggggttgttcgggacgggaggtactcgaacgtcgtacggacccgttcgtacggcgacgacccgtaaggccgtcccgccccgtagtcctaccgttccgtacccgg

SEQ ID NO: 187300 - DNA, 842 bp, Homo sapiens
  misc_feature: GYAE6OF01ARHEY.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagcccaccctcggtgtcagtcgtcccccaggacaaacgacgccgaggactccacctactcgtggagagtgactagttcgccaactaccgagacaaggaacgtccaacggaccgaccggtcccttagttcgtcggtactactcgtaggtaggaacgaccaaccgaaaccgtcccgtaccgggtactcccgtagaacgtagtacttccgtcgtcggtcctaccgagtccgtacggaacgggtaactaacggtccggtacccttaccgtttacgtaacttacgtaccggtacggggtccggggaccccgtaggggtacgggaaggtacgttaaccggaacccgttacgttaaccgtttaacgtttaacgtttaccgtttaaacctaacccgtaaacgaacgtaaccgtaaggtaccttaaggttaccgtaacctttaaacgggtaccggtttacggggtttagggggggttaccggtttacccgggggtaagggggtaaacgggttacgtaaaccgggtaaccggttccggttacccgggtaaccccggtttaccggggtttaaccggaacccggacccgggtaaccccggtaaccgggttcccccgttacccccggtaccccccggtttcgggtaacccccttacccgtttccccggttccccgtttaacccccccccg

SEQ ID NO: 187301 - DNA, 683 bp, Homo sapiens
  misc_feature: GYAE6OF01BQS8H.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctctcactttctgcacagtctctgaggcctcctatgagctgacacagccaccctcggtgtcagtcgtcccaggacaaacggccaggactcacctactctggagatgcattcgaccataccagcagaagtcagaccacggccctgttctggtcatctggtggacgaccaaccaaaccgacccgtccgggactccccgtgaacgagtacttctacgtcggctccagctacggaggaactaagtcggaccctacgtttacgaactagtaccgagggtccggggtacccgtagggtacggacggagtacggaacccgtagtaaccgttaactttaagtttcggttaacctaacgaaccaggtaaccagaccgtagtacgtaactaattaccggaagggttcgggggttacggtttacggggacggggtacgggtaacgtaccggtaaggtcccgtaacggtaccccggttaccgttaagggtacccgaaccggtaccccgtaaacgggtcccgtaccccgggtccccccgttacgggtcccctaaccgttcccgttaccccccgg

SEQ ID NO: 187302 - DNA, 669 bp, Homo sapiens
  misc_feature: GYAE6OF01DH7EG.4.47.E03.1.454.CMB.1.raw
tcagagcactgtagcacgaccggtgctcgatttagactcgcgcacagagagaagggggtgggctcaggaggcagagctctgggaatctcaccatggcctggaccctctcctgcctccccctcctcactttctgcacagtctctgagcctcctatgagctgacacagccaccctggtgtcagtcgtcccaggacaaacggccaggactccacctactctggagatgctattgccataccagcagaagtcagaccacggccctgtctggtcatctgtggacaccaccaaacgacccgtccgggactcccgtagagtagacttcacgtcggctccgagtcctacgacgggaacaagtcggaccctaacttagaccttagtccgaagggttcggggacccgtaagggtcgggaacggtagtacgtaacgtagaacctttaacgttaagtttcgttaactacgaaacgtacgtaaccgagacgttaaggtactacgttaacgttccgaaggtttagggggttcggttacggggacgggtaacgggtactacggaaacggtcgttacggaacccgttaccggtacgggtcgaccggacccgtaacgggtccctcccgggtaccccccgttacgggtccctaacccgtttcccttacccggtccccctaacccccg

SEQ ID NO: 187303 - DNA, 657 bp, Homo sapiens
  misc_feature: GYAE6OF01DT5EG.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggaccaaacggccaggactcacctactctggagatgcattgccataccagcagaagtcagaccacggcccctgttctggtcatctggtggacgaccaaccgaaaccgacccgtccgggactccccgtaggaacgagtactttcctacgtcggcctccaggtcctaccggaaggggaacctaaacgtcggacccctaccgtttagaaccttagtccgagggttccggggacccgtagggtacgggaaggagtacggaacccgtgtaacctacttatttcgttaacctacaaacgagacagacagtcgactaatcgtaagggttggggttacgttacgggacgggtagggtaactacgaacggtccgtacggtacccgttaccgttacgggtaccgaccggtaccccgaacgggtcccttcccggaccccccgttaggttccctacccgttccgttacccccg

SEQ ID NO: 187304 - DNA, 557 bp, Homo sapiens
  misc_feature: GYAE6OF01DH09E.4.47.E03.1.454.CMB.1.raw
  modified_base (303)..(303): a, c, t, g, unknown or other
  misc_feature (303)..(303): n is a, c, g, or t
  modified_base (351)..(351): a, c, t, g, unknown or other
  misc_feature (351)..(351): n is a, c, g, or t
tcagagcactgtagcacgaccggtgctcgatttagactcgcgcacagagagaagggggtgggctcaggaggcagagctctgggaatctcaccatggcctggaccctctcctgctccccctcctcactttctgcacagtctctgaggcctcctatgagctgacacagccaccctcggtgtcagtgtccccaggaccaaacggccaggatcacctactctggagatgcattgccataccagcagaagtcagaccaggccctgttctggtcatctgtggagacaccaaacgccctccgggatcccngagagattctctggctccagctcgaggacaatcggcctacttgactancgaggtcgggccctagggtggaggatacgaaccgtgtactacttagttagttactacaacgtagacacgactaggtcacgttaatacgaagttggggttcgttcgggacgggtagggactacgaagtctacggaccgttccgtaggtacgacggacccgaaggcctccgcccccgtcggtaccacttcctccgttcccctaccccg

SEQ ID NO: 187305 - DNA, 541 bp, Homo sapiens
  misc_feature: GYAE6OF01DABF1.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctcccctctcactttctgcacagtctctgaggcctcctatgagctgacacagccaccctcggtgtcagtcgtccccaggacaaacggccaggatcacctactctggagatgcattgccataccagcagaagtcagaccaggcccctgttctggtcatctgtggagacaccaaacgccctcgggactccctgagagtattctctggctccgagcctcgagggacaagtcggaccacttgactatcgaggtcggggcccagggtggaaggtatacgaacctgaacttactatttagttactacaacagacagcagtgactaatcgtagtggggtgttcgggacggtagggatcgaagtcgtacggaccgtcgtaggtccacggacccgaagggcctaccggccccctggtccaccgttccgttcccg

SEQ ID NO: 187306 - DNA, 727 bp, Homo sapiens
  misc_feature: GYAE6OF01DVPEZ.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctctcactttctgcacagtctctgagcctcctatgagctgacacacgcccacccgtggtgtcaggttccgtccccgaagggaaccaaaaccggccgaaggactccaacccgttactcgtaggagatcgctattcgacctataccagacaagaacgtacaacgtaccgacggtcccttgttcgtggtcattcgtgtaggacgaccaaccgaaccgacccgtcggactcccgtagacgtagtacttcctcgtcgtctccgagtcctacggacggactaagtcgacctacgttacgactacgtcggtacgggtcgggacccgtaggggtacggaacggtacgtacgtaacgttacgtaacttacgtttaagttaccgttaactaccgaaagtacgaacgtacgtacgtacgtacgtaacttaacgttcggtagggttcgggggttacgttcggggaacgggtacggacgtaccgtaacggtccgtacggtacccgttaccggtacggtaaccgaccggtaaccccggtacggtccccgttaccccggttccccccggtacgttcccgtaacccgtttcccggttaaccccgttccccccttaacccccgg

SEQ ID NO: 187307 - DNA, 722 bp, Homo sapiens
  misc_feature: GYAE6OF01BUH70.4.47.E03.1.454.CMB.1.raw
tcagagcactgtagcacgaccggtgctcgatttagactcgcgcacagagagaagggggtgggctcaggaggcagagctctgggaatctcaccatggcctggaccctctcctgcctcccctcctcactttctgcacagtctctgaggcctcctatgagctgacacagccaccctcggtgtcagtcgtccccaggacaaacggccaggatcacctactctggagatgctattgccataccagcagaagtcagaccacggccctgttctggtcatctgtggacgaccaaccaaaccgcccgtccgggactcccgtagacgtagtactttctacgtggccttccgagtcctacgaagggaacctaagtcggaccctaccgttagaacctagtacgtaacggttcgggggaccctaaggggtcgggaaggtacgtacggtaaacccgtggtaaccttaacgttaacgtttacggtttaacctaacgtaaaccgtacgaaccgtaagccgaacggtttacgacttaaagtccgtaaggttgggggttacgtttacggggacgggtaagggacgttaccgaaaggtccgttacggaaccccggttaccggttaacgggtaccgtaacccggaccccggtaaacgggtcccgttaccccgggtacccccccggttaccggttacccgtaaccccgtttccggtttaccccggttaccccccggtcccccc

SEQ ID NO: 187308 - DNA, 798 bp, Homo sapiens
  misc_feature: GYAE6OF01CAWI0.4.47.E03.1.454.CMB.1.raw
  modified_base (285)..(285): a, c, t, g, unknown or other
  misc_feature (285)..(285): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacacgccaccctggtgtcagtcgtccccaggacaaacggccaggatcacctactctggagatgctattcgaccataccagcagaagtcagaccacggcccctgttctggtcatctgtgganaccaccaaaccgacccgtcgggactcccgtgaagagtacttcgtcgtcggccttaccgagtcctacggaacgggaactaaacgttcgggaccctaaccgttacgacttaacgtacggtaacgggtccgggggaccccgtagggggtacggggtaacggtacgttacggaacccgttggtaaccttaaacgtttacgttaacggtttacctaaccgtaacgtaaacgaaccgtacggtacctaagggttacgtaaaccgtttaaacgttaccgggtaagggttacggggggtttaccggggttaccggggtaacggggtaacgggggttaaccgtaccggtaaacgggttacccgtaccggggtaacccggttacccgggtttaaccgggtaccgtaaacccgggtacccccggtaaacggggttccccgtaccccgggtaccccccgtttcccggggtaacccttacccccgtttacccgtttccccgttacccccccgtttaaaccccccgg

SEQ ID NO: 187309 - DNA, 728 bp, Homo sapiens
  misc_feature: GYAE6OF01C1AUC.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgcctccccctcctcactttctgcacagtctctgaggcctcctatgagctgacacacgcccacccgtcggtgtcagtcgtccccaggacaaacggccaggactcacctactctggagatgctattcgccaataccagcaagaagtcaagaccacggtcccctgttctggtcattcgtggtggacgaccaacccgaaaccggccccgttacgggacttccccgtaggaacgagtacttcctcgtcggcctccgagctacgaagggactaacgtcggaccctacttgaacttagtccgagggtccggggacccgtagggtcgggaacggtacgtacggtaaacccgttagtaacttaacgttagttttacgttaaccttaaccgaaacgtaacgaaccgtaagaccgtaaggttacgtaaccttaaacgttcgtaaggggttagggggtttccggttaccgggggacgggggtaacgggtacgttacggaaacggtccgtaccggtaaccccggtttccggtacgggttacccgaccgggtaacccccggtaacgggtcccgttaccccggtaccccccgttaggttaccccgtcccgtttcccgtttaccccccg

SEQ ID NO: 187310 - DNA, 684 bp, Homo sapiens
  misc_feature: GYAE6OF01A7B80.4.47.E03.1.454.CMB.1.raw
  modified_base (227)..(227): a, c, t, g, unknown or other
  misc_feature (227)..(227): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggaccaaacggccaggatccacctactctgganatgcattgccataccgagcagaagtcagaccaggcccctgttctggtcatctgtggacgacaccgaaacgaccccgtccgggactccccgtgacgacgtacgttctcgtacggcctccagtctcgaaggggtaccaagtcggaccctacctttggaacttacgtcgtaacgggtcggggaccccgtaaggggtcgggaagggtaacgtacggtaacccgtaggtaacccttaacttaacgtttacgtttaaccgtactaaacgtaacgaccgtaacggtaccgtaaggtacggtacttaaacgttcgtaaggttgggggttacggttcggggacgggtaagggtacgtacgaacggtccgtacggacccgttacgttaacggtccgacggacccgacgggccgtcccggtacccccgttcggacctaccgttcccgttccgttcccccttacccccg

SEQ ID NO: 187311 - DNA, 781 bp, Homo sapiens
  misc_feature: GYAE6OF01DOPA5.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctactcgtaggagatgctattcgccataccagcaagaagtcacgaccacggtcccttgttctggtcattcgtgtggacgacaacccgaaaccgcccgtccgggactcccgtagagtacgtacttcgtacgtcggccttccgacgtccgtacggtaaacggggacctaacggtcggaccctaaccgtttcggaaaccttacgtacggacggggttaccggggacccgtagggggtacgggaaggtacgttaacggtaaccgttaggtaaaccttaacgtttaacgtttacgttaactaaccgaaacgtaacgaaccgtagtaccgtaagttacgtaaccgttaagtaccggttaggggttacgggggtttacgggtttaccgggggaacggggtaacgggtaacggtaccggaaaaggttccggttaaccgggtacccggttaaccggtaaccgggtacccgtaacccggtacccgggtaaacggttccccggtaccccggtaccccccggttaccgggttacccttacccggtttcccgttccccggtttccccccggttacccccc

SEQ ID NO: 187312 - DNA, 674 bp, Homo sapiens
  misc_feature: GYAE6OF01C4WNF.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgcctcccctcctcactttctgcacagtctctgaggcctcctatgagctgacacagcccaccctcggtgtcagtcgtccccaggaccaaacggccaggactcacctactctggagatgcattcgccataccagcaagaagtcacgaccacggtcccctgttctcggtcatcgtggtggacgaaccaccgaaaccgacccgtaccgggacttccccgtaggaacgtacgtactttctcgtcgggcctaccgacgtcctaccggaaggggtaactaacgtcgggacccctacgtttacggaacttacgtacggtagggttcggggggaccccgtaggggtcgggaagggtactacggtaaacccgtaggtaaccgttaacttagtttacgttaccttaacctaaacgagaaccgagacgtagtcgaccttaagtcgtagggtggggttacggttcgggacgggtagggacgtacaaggccgtacggtaccgtccgtagggttaccacggacccgaaggcccgtcccggtcccccgtggttccctccgttcccggttaccccg

SEQ ID NO: 187313 - DNA, 583 bp, Homo sapiens
  misc_feature: GYAE6OF01BGG69.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattcgccataccagcagaagtcaagaccacggcccctgttcgtggtcatctggtggacgaccaaccgaaacgacccgtccgggactccctgacgagtacttctctcggctccgagtcctacgaacgggacaagtcggccctaccgttgactagtcgacggtcggggcccaggtggagatacgaacgtgactactattcgtaactacaactagacagcagtcgactatacgaggtgggtcgttagggcggtagggactaggaagtcgtaccggaccgtaccggttaggtaccacggaccccgtaaggtcccgttaccggtccccccgtaggtaccctcccgttccgttacccccg

SEQ ID NO: 187314 - DNA, 621 bp, Homo sapiens
  misc_feature: GYAE6OF01BBPDV.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctactctggagatgcattgccataccagcaagaagtcacgaccacggcccctgttctggtcatcgtgtggagaccaccgaaaccgacccgtccgggactcccgtagagacgtacttctctggcctccagctacgagggacaagtcggacctaccttgactagtcgaggtcggggccctagggtaggaggagtacgtaaccgtgtaacttacttagtttcgttaactacaacgagacgagacgagttacgacttaagcgtagggttcggggtgttacggggacgggtaagggtacgtacgaacgtcgtaccggtacccgttacggtacggtccgtaccggacccggtaacggtccgtccccggacccccgttcggtaccctaccgtttccctccggttccccccgtcccc

SEQ ID NO: 187315 - DNA, 682 bp, Homo sapiens
  misc_feature: GYAE6OF01CQ10X.4.47.E03.1.454.CMB.1.raw
  modified_base (519)..(519): a, c, t, g, unknown or other
  misc_feature (519)..(519): n is a, c, g, or t
tcagagcactgtagcacgaccggtgctcgatttagactcgcgcacagagagaagggggtgggctcaggaggcagagctctgggaatctcaccatggcctggaccctctcctgcctccccctcctcactttctgcacagtctctgaggcctcctatgagctgacacacgcccacccgtcggtgtcagtcgtccccaggacaaacggccaggatcacctactcgtaggagatgcattcgccaataccgagacaaggaagtcacgaccgacggtccccttgttctggtcatctggtaggacacaacccaacgaccccgtacgggactcccgtaggaacgtagtacttcgtacgtcggtacctccgaggtcctacggaacggggaactaacgtcggaccctacgttacgacttacgtacggacgggtaccggggacccgtaggggtacgggaaggtacgtacggaaccgttaggtaacctttacttagtttacgttaaccaacaacgacgactagactaggtnactaagtcgaaggttggggtacggtacggacgggaggtaacacggtaacggtccgtacggtacccgttaccgtagggtaccaccgggacccgtacgggtcccctacccggttcccccggtcggtaccctaccgtttccccggtcccgtttcccccgtcccccg

SEQ ID NO: 187316 - DNA, 603 bp, Homo sapiens
  misc_feature: GYAE6OF01BQA44.4.47.E03.1.454.CMB.1.raw
  modified_base (225)..(225): a, c, t, g, unknown or other
  misc_feature (225)..(225): n is a, c, g, or t
  modified_base (281)..(281): a, c, t, g, unknown or other
  misc_feature (281)..(281): n is a, c, g, or t
  modified_base (309)..(309): a, c, t, g, unknown or other
  misc_feature (309)..(309): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctactctgganatgcattgccataccagcagaagtcagaccaggccctgttctggtcatctgtgganacaccaaaccgcccgtcgggactcccgngagagattctcgtggcctccgagctacgaagggacaagtcggcctacttgactatcgaggtcgggcccagggtggaggatacgaacctggtaacttacttagttcttaactcaaacgtagacagactagtcgaactaatcgagttcgggggtgttccgggagggtaagggtctacgaaggtcctacggtacccgttaccgttagggcccaacggccccggaaggtcccgtcccggtaccccccgttcggggttaccctacccgttcccgttaaccgttccccccgtaacccccg

SEQ ID NO: 187317 - DNA, 706 bp, Homo sapiens
  misc_feature: GYAE6OF01CMJW8.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctactctggagatgcattcgccataccagcagaagtcagaccaggccctgttctggtcatctgtggagacaccaaacgaccctccgggactccctgagagtattctctggctccagcctcgacgggacaagtcggacctaccttagactatcgacgggtcggggaccccgaggggttcgggaagggtacgtacggaaacccgttacggtaacctttaaccgtttagtttacggtttaaccttaccgaaaaccgtaacgtaaacccgaaggaccgtaaggttcgtaaccttaaacgttccgtaaggttaggggggttcgggtttaccggggacggggtaaggggtacgtacggaacggtccgttaccgggtaacccggttcccggtaagggttccgaaccgggacccccggtaaacgggtcccgtacccggtcccccccgttccgggttaccctaacccgtttccccttccgggtttcccccccttaaccccccg

SEQ ID NO: 187318 - DNA, 624 bp, Homo sapiens
  misc_feature: GYAE6OF01EZ13O.4.47.E03.1.454.CMB.1.raw
tcagagcactgtagcacgaccggtgctcgatttagactcgcgcacagagagaagggggtgggctcaggaggcagagctctgggaatctcaccatggcctggaccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagaccaaccgaaaccgacccgtccgggactcccgtagagagattctctggcctccagctacgagggacaagtcggccctaccttgactatcgaggtcggggcccgagggtagggaggtatacgaacctagacttaactatttgttaacctacaaacagaacagcagtgtactaatcgtaaggttggggttacggttcgggacgggtaggggtactacggaaggtccgttacggtaacccggttacccgtagggtaccgaacggtaccccgaaacgggtcccgttacccggtcccccccgttcgggtaccctaacccgttccgtttacccggttcccccctaccccccg

SEQ ID NO: 187319 - DNA, 576 bp, Homo sapiens
  misc_feature: GYAE6OF01CDJ80.4.47.E03.1.454.CMB.1.raw
  modified_base (301)..(301): a, c, t, g, unknown or other
  misc_feature (301)..(301): n is a, c, g, or t
tcagagcactgtagcacgaccggtgctcgatttagactcgcgcacagagagaagggggtgggctcaggaggcagagctctgggaatctcaccatggcctggaccctctcctgctccccctcctcactttctgcacagtctctgaggcctcctatgagctgacacagccaccctcggtgtcagtgtccccaggacaaacggccaggatcacctatctggagatgcattgccataccagcagaatcagaccaggccctgttctggtcatctgtgagacaccaaacgaccctccgggatcccgngagagtattctcgtgctccacgctcgaggacaatcggacctacttcgactactcgaggtcgggacccgtagggtggaacgggatacggaacctagaaccttactatttacgttaactacaaacagacagacgagtgactaatcgaagttggggtacgtcgggacggtacgggatacgaaggtccgtacggacccgtcgtacggtcaacggaccgaacggtccgtaccgcccccgttcgggttacccaccgtttcccgtccgttccccgtcccccg

SEQ ID NO: 187320 - DNA, 720 bp, Homo sapiens
  misc_feature: GYAE6OF01A4IUC.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctactctggagatgcattcgccataccagcaagaagtcagaccacggtcccctgttctggtcatctggtggacgaccacccgaaaccgcccgtccgggactcccgtagagacgtacttcgtcgtcggcctccgacgtcctacggaacgggaactaacgtcgggtaccctaacgttacggtaaccttagtaccggtacggggtccgggggacccgtaagggggtacgggaacgggtacgtacggtaaccgttacggtaaaccctttaacgttaagtttacggtttaacctaaccgtaaacgtacggacgtaacggcctaggtccgtacttaagtccgtaggggttcggggttcggttccggggagggtacgggtactacggaacgtccggttacggtacccggttaccggtacgggtaccgaaccggacccggtacgggtccccgtacccggtcccccgttcgggtaccctacccgtttcccgttccccgttacccccttacccccg

SEQ ID NO: 187321 - DNA, 655 bp, Homo sapiens
  misc_feature: GYAE6OF01BW1UR.4.47.E03.1.454.CMB.1.raw
  modified_base (225)..(225): a, c, t, g, unknown or other
  misc_feature (225)..(225): n is a, c, g, or t
tcagagcactgtagcacgaccggtgctcgatttagactcgcgcacagagaggaagggggtgggctcaggaggcagagctcgtgggaatctcaccatggcctggaccctctcctgctcccctcctcactttctgcacagtctctgaggcctcctatgagctcgacacagcccaccctcggtgtcagtcgtccccaggacaaacggccaggatcacctactctgganatgcattgccataccagcagaatcagaccaggccctgttctggtcatcgtgtggagaccaccgaaaccgtcccgtccgggactcccgtagacgagtactttcctacgtcggcctccagtcctcgaggggacaagtcggacctaccgttgtactatacgaggtcggggccaagggtcggaggtatacgaacctggtactacgtagttacgttaactacgaactacgacgagccaaggtcgacttaacgtcgtaacggttggggtcggtttaccgggagggtaagggtacttacgaacggtccggtacggtaaccccggttaccgttaacgggtccgaacggaccccggtaaacgggtcccgtacccgggtaccccccgttcgggtacccctaacccgttcccggttcccggtttccccccggtaccccccg

SEQ ID NO: 187322 - DNA, 571 bp, Homo sapiens
  misc_feature: GYAE6OF01BEKGN.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagcccaccctggtgtcagtcgtccccaggacaaacggccaggatcacctactctggagatgcattgccataccagcagaagtcagaccaggcccctgttctggtcatctgtggagacaccaaaccgaccctccgggactccctgagagattctctggctccagctcgagggacaagtcggcctaccttgactatcgtacggtcggggcccagggtggaggagtcgaacctgactaactagttacgttactacaaacagacacgcagtgactaatcgtaggttggggtgttcgggcgggtagggactacgaacgtcgtacggacccgttccgtaggtccgacggcccgaacggccgtccggccccccgttcggtacctaccttcccgttccgttccccctaaccccg

SEQ ID NO: 187323 - DNA, 603 bp, Homo sapiens
  misc_feature: GYAE6OF01D5G9X.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctactctggagatgcattgccataccagcagaagtcacgaccacggccctgttctggtcatctgtggagaccaccgaaaccgacccgtccgggactcccgtagagagtacttctcgtcggctccgagcctacgaacggggacaagtcggaccctaccgttgacttagtacgaggtcggggacccgagggtgggaggacgtacggaaccgtgtaacttactacgtttacgttaactacaaacagacgagactagtgactaagtcgtaggtggggtgttacgggcgggaggatacgaagtcgtaggtacccgtacgtacggtcacggacccgacgggccgtcccggacccccgttcggtacctaccttcccgttccgttcccccgtaccccc

SEQ ID NO: 187324 - DNA, 705 bp, Homo sapiens
  misc_feature: GYAE6OF01DWOGX.4.47.E03.1.454.CMB.1.raw
  modified_base (525)..(525): a, c, t, g, unknown or other
  misc_feature (525)..(525): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggctcacctactctggagatgctattcgaccataccagcaagaagtcacgaccgacggtcccttgttcgtcggtcacttcgtggtaggaacgtaaccaacccgaaaacccggtaccccggtaccggggtaaccttccccgtaggtaacgtacgtactttccgtcgtcggcctaccgacgtcctacggaacgggaactaacgtcggaccctaccgttgactacgtacggacgggtacgggacccgtaggggtacgggagtacgtacggaacttagtaacttacgtagtttcgttaacactaacgagacagtatacgtanactaagtcgtagggtcggggtcggttacgggacgggtaaggtactacgaacgtccggtaccggtacccggttacgtaccgggtaccgaacccggacccggtacggtccccgttacccggtcccccgttacggttaccccgtaccgtttccccgttcccccggttcccccttaacccccgg

SEQ ID NO: 187325 - DNA, 564 bp, Homo sapiens
  misc_feature: GYAE6OF01CMJXW.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaaggatcacctactctggagatgctattgaccataccagcagaagtcagaccaggcccctgttctggtcatctgtggagacaccaaaaccgccctccgggactcccgtgaacgagtattctcgtggctccagctcgagggacaagtcggccacttgactatcgaggtcggggaccctagggtggaggtagtacgaacctacgtaacgtaacttagttacgttactacaaacagaacagacagtgactaatcgaggtgggtggttcgggcggtagggtatcgaagcgtcgacccgtcgtagtcgacgacccgacggccgtccgcccccgtggtccctacttcctcgttcccctaccccg

SEQ ID NO: 187326 - DNA, 779 bp, Homo sapiens
  misc_feature: GYAE6OF01A2FP9.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctactctggagatgcattgccataccagcagaagtcagaccaggcccctgttctggtcatctgtgagaccaccaacgccctcgggactccctgagagtattctcgtggctccgagcctcgagggacaagtcggaccctaccgttgaacttacgtccgtagggttccgggggaccccgtaggggtagggtaacgggtacgttacgggtaaaccccgttaggtaaccgtttaacgtttaacgttttacggttttaaccctaaccgtaaaaccgtaacggtaaccctaacgggtacctaagggttacgtaaccgttaaacgttaccggtaagggtttacgggggggtttcgggtttaccgggggaccgggggtaaggggtacgttaacgggtaaacgtcccggttaccgggttaaacccccggtttcccgggttaaacggggttccccggtaaacccggggttacccccccgaaaagggggttcccccgtttaccccggggtacccccccccgtttacccgggggttacccccttaacccggttttcccccgtttaacccccccggg

SEQ ID NO: 187327 - DNA, 603 bp, Homo sapiens
  misc_feature: GYAE6OF01EIBWC.4.47.E03.1.454.CMB.1.raw
  modified_base (178)..(178): a, c, t, g, unknown or other
  misc_feature (178)..(178): n is a, c, g, or t
tcagagcactgtagcacgaccggtgctcgatttagactcgcgcacagagagaagggggtgggctcaggaggcagagctctgggaatctcaccatggcctggacccctctcctgctccccctctcactttctgcacagtctctgaggcctcctatgagctgacacagccaccctcggtntcagtcgtccccaggacaaacggccaggatcacctactctggagatgcattgccataccagcagaagtcacgaccacggcccctgttctggtcatctgtggagtaccaaccaaacgaccctccgggactccctagagagtattctctcggctccgagctcgaggacaagtcggcctacgttgactagtcgaggtcgggcccagggtggaggtatcgaacctgacttactagttagtactacaacgtagacagacagtacgactaatcgtaaggtggggttacgttacgggacgggaagggtatacgaacgtcgtacggtacccggtaccgtacggtaccgacggacccgtaacgggtcccgtacccggcccccccgttacggtacccgtacccgttcccgttcccggttcccccgttaccccccg

SEQ ID NO: 187328 - DNA, 555 bp, Homo sapiens
  misc_feature: GYAE6OF01BOTJQ.4.47.E03.1.454.CMB.1.raw
  modified_base (434)..(434): a, c, t, g, unknown or other
  misc_feature (434)..(434): n is a, c, g, or t
  modified_base (533)..(533): a, c, t, g, unknown or other
  misc_feature (533)..(533): n is a, c, g, or t
tcagagcactgtagcacgaccggtgctcgatttagactcgcgcacagagagaagggggtgggctcaggaggcagagctctgggaatctcaccatggcctggacccctctcctgctcccctcctcactttctgcacagtctctgaggcctcctatgagctgacacagccaccctcggtgtcagtcgtccccaggacaacggccaggatcacctactctggagatgcattgccataccagcagaagtcagaccaggccctgttctggtcatctgtggagaccaccgaaacgcccgtcgggactccctagacgagatttctcgtggcctccgagtcctcgagggactaagtcggacctaccgttgacttacgtcgaggtcggggcccagggtcggaggatcgaactgactatacttgtactcaacagacagcaggtnactaatcgaagttgggtcgttcgggcggtaggactacgaagccgtcgtacccgtcgtacggtccaaggccccgaggccttccggccccgttcggtaccnccgttctccgttcccctacccc

SEQ ID NO: 187329 - DNA, 657 bp, Homo sapiens
  misc_feature: GYAE6OF01B6CLC.4.47.E03.1.454.CMB.1.raw
  modified_base (233)..(233): a, c, t, g, unknown or other
  misc_feature (233)..(233): n is a, c, g, or t
tcagagcactgtagcacgaccggtgctcgatttagactcgcgcacagagagaagggggctgtgggctcaggaggcagagctctgggaatctcaccatggcctggacccctctcctgcctccccctcctcactttctgcacagtctctgaggcctcctatgagctgacacacgcccaccctcggtgtcagtcgtcccgaggaaccaaacggccaggatccacctactcgtgganatgcattcgaccataccagactagaacgtcagaccacggtccccttgttctcggtactagttccgtaggtacggaacgaaccaaacccgaaacccggtaccccgtccgggaactcccgtagagtacgtacttctcgtcgctaccgagtctacgacggaactaacgtcggtaccctacgttacgactacgtacggacgggtaccggggaccgtagggtacggaggtactacgaacgttacgaacttacttagttacgtactaacaacgtacacgacacgtagcgtaactacgtacgtaggttggggtacggtcgggacgggtagtacgtacggtacgtcgtaccggaccgttacgtacgtaccgaccggacccggaacggtcccgtcccggtcccccgttagtaccctccgttccgttcccccgg

SEQ ID NO: 187330 - DNA, 622 bp, Homo sapiens
  misc_feature: GYAE6OF01B65BY.4.47.E03.1.454.CMB.1.raw
  modified_base (316)..(316): a, c, t, g, unknown or other
  misc_feature (316)..(316): n is a, c, g, or t
  modified_base (327)..(327): a, c, t, g, unknown or other
  misc_feature (327)..(327): n is a, c, g, or t
  modified_base (461)..(461): a, c, t, g, unknown or other
  misc_feature (461)..(461): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagccaccctcggtgtcagtcgtcccaggacaaacggccaggatcgcctactctggagatgcattcgaccataccgagcaagaagtcagacccacggcccctgttctggtcatctgtaggacacaccaaaccgacccgtcgggactcccgngagagtattcncgtggctccagtctcgagggacaagtcggaccctacgttgacttatacgagggtccggggcctagggtgggacggtagtacggtaaccttggtaacctaacgttatttacgttaacctacgaaaccaggaaccncgtacgtacgtgtaaccttaagtcgtaagggttggggttgggttaccggggacgggtaagggtactacggagtccgtcggtacccgtacgttacggcgacgcccggtcggccgtcccgtcccccgttcggtaccaccgttccttcccgtccccctaccccg

SEQ ID NO: 187331 - DNA, 710 bp, Homo sapiens
  misc_feature: GYAE6OF01CIOYJ.4.47.E03.1.454.CMB.1.raw
  modified_base (287)..(287): a, c, t, g, unknown or other
  misc_feature (287)..(287): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagccaccctggtgtcagtcgtccccaggacaaacggccaggactcacctactcgtggagatgcattgccataccagcaagaacgtcagaccgacggcccctgttcgtggtcatctgtgganaccaccgaaaccgcccgtccgggactcccgtagacgacgtacttctcgtcggtctaccgagtcctacgaacggggacaacgtccggaccctaccctttagacctacgtcgtacgggttccgggggaccccgtaagggggtagggaacggtacgtacggtaaacccgtggtaaccgttaaccgttaatttacggttaccttaccaaacgtacggaaccgacggactaaggttacgaaccttaaacgtcgtaagggttgggggttcgtttaccggggacggggtaacggggtactacggtaacggccggttacggaacccggttccgtaacgggtcccaccgggtaccccgaagggtccccttaccccggcccccggttacggtacccctaccttcccgtttccccggttaccccctaccccccg

SEQ ID NO: 187332 - DNA, 622 bp, Homo sapiens
  misc_feature: GYAE6OF01A8AAH.4.47.E03.1.454.CMB.1.raw
  modified_base (227)..(227): a, c, t, g, unknown or other
  misc_feature (227)..(227): n is a, c, g, or t
  modified_base (295)..(295): a, c, t, g, unknown or other
  misc_feature (295)..(295): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacacgcccacccgtcggtgtcagtcgtccccaggacaaacggccaggatcacctactctgganatgcattcgaccataccagacaagaagtcacgaccacggccccttgttcgtggtcatcgtggtagganaccaacccaaaccgcccgtccgggactccgtagagatacttctctggtcctaccgagccgtacgaggtaacagtcgacctaccttagactagtcgaggtcgggaccgagggtggagatacgactagacttatattcgtacacaacagtacagctagtcactaagtacgtaggttcggggtgttaccggggaggaggtactacgtaaacgcgtacggtacccggttacgtacgggaccgtaccggacccgtaacgggtcccgtaccccggtcccccgttacgggtccctaacccggtttcccgttacccgttccccccgtaccccccg

SEQ ID NO: 187333 - DNA, 641 bp, Homo sapiens
  misc_feature: GYAE6OF01BETUC.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagccaccctcggtgtcagtcgtcccccaggacaaacggccaggatccacctactcgtggagatgctattgccataccagcagaagtcagacccaggccctgttctggtcatctgtggacgaccaaccgaaaccgcccctccggggactcccgtagagagtacttccgtcgtgggcctccgacgctccgaagggaccaaagtccggacctaacccgttgacctagtcgaacggtcggggaccctagggtaggaggtagtacgtaaccgtgaacttacgttagttacgttactacaacgacgacgagtcgagtcgacttaactcgtaggtggggtacgttcgggacgggaggtacgtacgaagtccgtacgtacccgttccgtacggtaccgacggaacccggaacggtcccgtaccccggtccccccgttacggtaccccaccgttcccggttcccgttccccccggtaccccccg

SEQ ID NO: 187334 - DNA, 667 bp, Homo sapiens
  misc_feature: GYAE6OF01ALR5I.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcaagaagtcagaccaggcccctgttctggtcatctgtggagaaccaaccaaaccgacccgtccgggactcccgtagagagtacttctcgtggtcctccgagcctacgagggaacctaacgtcgggaccctaccgttgtacttacgtccgagggttcgggggacccgagggggttacgggaaggtaacgttacggaacccgttagtaaccttaaccgtttagtttacgtttaaccctacctaaaccgaacgaaccgtaggtacctaaggtacgtaaccgttaaagtccgttaagggttggggggttacggtttaccggggacgggtaagggtacgtacgaacggtccgtacggtacccgtcgtacggtccacggacccgacggcccgtccgtcccccgtcgtcccacttcccttccgtcccctaccccg

SEQ ID NO: 187335 - DNA, 781 bp, Homo sapiens
  misc_feature: GYAE6OF01A84WZ.4.47.E03.1.454.CMB.1.raw
  modified_base (286)..(286): a, c, t, g, unknown or other
  misc_feature (286)..(286): n is a, c, g, or t
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggactcacctactctggagatgctattgccataccagcagaacgtcagaccaggcccctgttctggtcatctgtganacaccaacgaccctcgggactccctgacgagtacttctccgttcggcctaccgacgcctaccgaacggggacctaagtcgggaccctaccgtttaggaaccttaactccgtaacgggttaccgggggaccccgtaaggggttacgggaacgggtaacgttaccggaaacccgttacggtaaccgtttaaccgtttaacgtttacgggtttaacccttaacccgaaaccgtaacggtaaccgaacggtacccgtaaacggttacggtaacctttaaacgttccggtaacgggtttacggggggtttacggtttaccgggggaccggggttaacggggtaacgttaccgggaaacggttacccgttaccgggtaaaccccgggttcccggttaaaccgggttacccgaaccgggtaccccccggtaaacgggtccccgtaccccgggtcccccccggttaccgggttcccctaacccggtttcccgtttacccccgg

SEQ ID NO: 187336 - DNA, 821 bp, Homo sapiens
  misc_feature: GYAE6OF01CEHRL.4.47.E03.1.454.CMB.1.raw
  modified_base (137)..(137): a, c, t, g, unknown or other
  misc_feature (137)..(137): n is a, c, g, or t
tcagagcactgtagcacgaccggtgctcgatttagactcgcgcacagagaggaagggggtgggctcaggaggcagagctctgggaatctcaccatggcctggaccctctcctgcctcccctctctactttctgcacngtctctgacggcctcctatgagctgacacacgccctaccgtggtcgtcaggtccgtaccccgaaggaaccgaaacgggccaggactaccaccttactcgtaggacgtatgactagttcgacctataccgagcaagaacgtcacgaccgacggtccctgttctggtcagtcgtggacggacgaaccaaccgaaaaccgcccgtaccgggacttcccgaggaacgacgttcgttccgtacgtacggtacctacgacggtccgtaacggaaacggggtaactaacggtaccgggtacccttaaccgttcggtaaactacgttaccggacgggggttccggggacccggtaaggggttaacgggacgggtaacgtaccgggtaaaccctacgttaaacccgtttaacgttttaaccgtttaacgggtttaaaccttaaccgtaaaccgtaacggtaaacccggacgtaaccgttaacggttacgtaaaccgttaacggttaccgttaagggggtttcgggggttacgggtttacggggaacggggtacggtaacgttacggacggttaccggtacggtaacccggttacggtacgggttccgaaccggtaccccggtaaggtccccgtcccggtaacccccgttcggtacccttcccggtaccgtttcccggtccccccgttaccccg

SEQ ID NO: 187337 - DNA, 639 bp, Homo sapiens
  misc_feature: GYAE6OF01C28WF.4.47.E03.1.454.CMB.1.raw
  modified_base (505)..(505): a, c, t, g, unknown or other
  misc_feature (505)..(505): n is a, c, g, or t
tcagagcactgtagcacgaccggtgctcgatttagactcgcgcacagagagaagggggtgggctcaggaggcagagctctgggaatctcaccatggcctggatccctctacttctcccctctcactctctgcacaggctctgaggcctctatgagctgacacacgcccacccgtcggtgtcagtcgtccccaggacagacgccagatcactgctcgtggagatgcattcggccagaaccaatatcgcttacgtacgaccagacagaacgcgacggccgacgccctgtgttgttagtaataactaagacagtgagacggtcccagacggtactcccgtaggacgacgttacttccgtcgtcggtcttaccgagacgtacggaagggaaccaacgtacgtaccgtacgttacgactactacgtagtacggacgtaccgaggacgaagagacgaagtcgtagaactagttacgtagtactaacgcgaacgacgaagacgtaaccgggngggttaaccggtaaagttaaaagtaaacgggtaaccgggttaccggggaacggggttaaacccgggaacgttaaacggacccttaaccggggtaaccccttacgtaaccgggttcgaaccggttaaccccgggg

SEQ ID NO: 187338 - DNA, 796 bp, Homo sapiens
  misc_feature: GYAE6OF01BTX9A.4.47.E03.1.454.CMB.1.raw
  modified_base (240)..(240): a, c, t, g, unknown or other
  misc_feature (240)..(240): n is a, c, g, or t
  modified_base (612)..(612): a, c, t, g, unknown or other
  misc_feature (612)..(612): n is a, c, g, or t
tcagagcactgtagcacgaccggtgctcgatttagactcgcgcacagagagaagggggctgtgggctcaggaggcagagctctgggaatctcaccatggcctggaccctctcctgcctccccctctcactttctgcacagtctctgacggcctcctatgagctgacacacgcccacccgtggtcgtcagtcgtaccccaaggaaccaaaccggccaaggactaccacctactcgtggganatgctattcgaccaatacccgagaccaaggaacgtccgaaacggaccctaccgggtcccccgttgtttccgtcgggtacctacgttccgtagggtacggtaaccgaacccgaaccccgaaaacccggtacccccggttacccggggtaaccttcccccggttaaggaaccggaacggttacctttccgtcgttaccgggtcccttaccggacgtccgtaaccggaacgggtaacctaaaggtccggacccttaaccgttagaaccttacgtcgacgggggtaccggggtacccggtaggggttacggaacgggtacgtaacggtaaccctaggtaaccttaacgtttagttacgttaaccgtacaaaccgtnaacacgtacgtaacggtctaacgttaacgttcggtacgggttggggttacgggttacgggacgggaaggtacgtaacgacggtccgtaacggtacccggttaccggtaggtacccgaccgacccggtaacggtcccgtaccccggtcccccgttacggtcccttcccgttcccggttacccccg

SEQ ID NO: 187339 - DNA, 772 bp, Homo sapiens
  misc_feature: GYAE6OF01D38CU.4.47.E03.1.454.CMB.1.raw
  modified_base (157)..(157): a, c, t, g, unknown or other
  misc_feature (157)..(157): n is a, c, g, or t
  modified_base (180)..(180): a, c, t, g, unknown or other
  misc_feature (180)..(180): n is a, c, g, or t
  modified_base (358)..(358): a, c, t, g, unknown or other
  misc_feature (358)..(358): n is a, c, g, or t
tcagagcactgtagcacgaccggtgctcgatttagactcgcgcacagagaggaagggggtgggctcaggaggcagagctctgggaatctcaccatggcctggaccctctcctgcctccccctctcactttctgcacagtctctgagcctcctatganctgacacacgcccaccctcggtntcagtcgtaccccaggaacaaacggccaggactccacctactcgtaggagatgctattcgaccataccagcaagaagtcacgaccacggtccctgttctggtcatcgtggtaggacgaccaacccgaaaccgtcccgtaccgggactcccgtagagtacgtacttcgtcgtcggtccnccacgccgtacggaacggactaacgtccggaccctacgtttagaccttacgtcggtagggtccggggacccgtaggggtaggaacggtacgttaacggtaaccgttacgttaaacttaacgttaagtttacggtttaaccaccgtaaacgacgtaaccgacgtacgtaggttacgtaacgttaaacgtcggtaacggggttcgggtttcggggtaccgggtacggggtaagggtaaccttacggtaaccggttccgttacccgggttaacccggttacccggttaacgggtaccccggttaaccggtaccccccgggtaaaccgggttccccgttacccccggtaccccccggtttaccgggttacccttaaccccggtttccgtttaccccccgtttcccccctaacccccgg

SEQ ID NO: 187340 - DNA, 571 bp, Homo sapiens
  misc_feature: GYAE6OF01CG94X.4.47.E03.1.454.CMB.1.raw
  modified_base (321)..(321): a, c, t, g, unknown or other
  misc_feature (321)..(321): n is a, c, g, or t
  modified_base (430)..(430): a, c, t, g, unknown or other
  misc_feature (430)..(430): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggatcacctactcgtggagatgctattcgaccataccagcagaagtcagaccacggcccctgttctggtcatctggtggacgacaacccaaacgacccgtaccgggactcccgngacgagtacttctcgtggcctccgagctacgagggacaagtcggcctacgttgactatcgaggtcgggccagggtggaggactgaacctgactatattgtacacaacanacagcagtgactaagtcaggttgggtcgttcgggacggtagggactacgaacgcgtacgtaccgtaccggtacggtccgacgacccgaaggcctacccggtcccccgtcggtaccctactccgttccgtccccctaccccg

SEQ ID NO: 187341 - DNA, 774 bp, Homo sapiens
  misc_feature: GYAE6OF01EFXSL.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagcccaccctcggtgtcagtcgtcccaggaccaaacggccaggactcacctactctaggagatgcattcgccataccagcagaagtcagaccacggccctgttctggtctagtctggtggaacgaccaaccgaaaccgacccgtaccgggactcccgtgacgtacgtacttccgtcgtggcctccgagctacgagggacaacgtcggaccctaccgttacgaactacgtccgtaacgggttccgggggacccgtaaggggttacgggaacgggtacgttaaccgggtaaaccccgttaggtaacccttaacgtttacgttttaccgtttaaacctaaccgaaacccgtaaggaccgtaacggtaccgtaacgggttagtaaccgttaaagttaccgggttaacggggtttacggggggtttacgggttaccgggggacggggtaacggggtaacgttaccggaacggttccggtaaccgggttaccccggttacccgggttaacgggttacccggaacccggtaacccccggtaacgggaccccgttaccccgggtacccccccgttacgggttaaccccttacccggttcccgtttaccccccgg

SEQ ID NO: 187342 - DNA, 757 bp, Homo sapiens
  misc_feature: GYAE6OF01DN7C3.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctactcgtggagatgctattcgaccataccagacagaacgtcagaccgacggtcccctgttctcggtcatcgtgtaggacgaacaaccgaaaccggcccgtaccgggactcccgtagacgtagtaacttccgtcgtcggcctaccgacgtacctacggaaggggaacctaagtccgggaccctaaccgttacgacttaaacgtcggtagggtccgggggacccgtaggggtacgggtaacggtacgtaacggaaccgttacgtaaccgttaacgtttagtttaacgtttaacccgtaacgtaaacgtaacgacgtacgtacgtacggtacgtacgttaaacgtacggttaagggttcggggggtttacgggtttaccgggggacggggtaaggggtaacgttaccgaacggttaccggtaccggtacccggttaacccggtacgggtaaccgaccgggtacccggaaacgggtcccgtaccccgggttaccccccgttacgggttaccttacgtttccccgttacccgttaccccccttaccccg

SEQ ID NO: 187343 - DNA, 837 bp, Homo sapiens
  misc_feature: GYAE6OF01DV8AP.4.47.E03.1.454.CMB.1.raw
  modified_base (141)..(141): a, c, t, g, unknown or other
  misc_feature (141)..(141): n is a, c, g, or t
tcagagcactgtagcacgaccggtgctcgatttagactcgcgcacagagaggaagggggtgggctcaggaggcagagctcgtgggaatctcaccatggcctcggaccctctcctcgcctccccctctctactttctgcacncgtctcgtgacgcctcctatgagctacgacacacgtccctaccgtcggtcgtacgacggttccgtaccccggaagggaaacccgaaaacccgggtccgaacgggtaccttaccctaacccgttaacgtcggttaggggaactacgtcgtaacgtacgttcgacctaactaaccgagacgaaaggtaccgaccgaacggacccgtaccggtcccttggttccgtgtacgacgttcggtacgggtaacggaaccgaacccgtaaacccgtaacccggtaccccggtaccgggtaacctcccggtaggtaacgtacgttctttccgcggtccgtacctaccgtacggtacgtaacgggaagggtaacctacggtcccggtaacccttgtaaccgtacgtaacggtcgggaccggggtacgggaacggtggggtacggtacgtacgtaaccggttaacgtacgttaaccgttacgttaacgtttacctaacgtaaccgaagtacgacgtacgagtacgtagtactaaggtacggtacgggttcggggtaacggtcgggaacggtacgtacgtaacggtccgttacgggaccgttaccggaacgggttaccgacccggtaaccggtacccggaccggttcccgtcccgggtcccttaacggtcccttaacccgttcccgtacccgtcccccttaaccccgg

SEQ ID NO: 187344 - DNA, 766 bp, Homo sapiens
  misc_feature: GYAE6OF01DDW1I.4.47.E03.1.454.CMB.1.raw
tcagagcactgtagcacgaccggtgctcgatttagactcgcgcacagagaggaagggggtgggctcaggaggcagagctctgggaatctcaccatggcctcggaccctctcctgcctccccctctctactttctgcacagtctctgacggcctctagtgagctgacacacgcccaccgtcggtgtcaggttccgtacccccgaagggaaacccgaaaaccgggccaagggtactaccgtaacccttacgtcgtagggagtactcgcctagttcgaccactaccgagaccaagaacgtcaacgaccgaccggtcccttcgttcgtcggtctacgtctggtaggacgacaaccgaaccgacccgtccggactccgagagtagtacttctcgtcgactaccacgctacgacggaacaacgtcggacctacgttacacgttataccggtaggttcggggacccgtaggggtacgggtaacggtacgtaccgtaaccgtacgtaacttacgttaagtttacgttaccgtaacgtaacgaaccggtaacgacgtacgttaagtacgtacgttaacgttccggtagggtttaccggggttagggttccggggtacgggtaaggggttacgttaccggaaggtaccgttacggtaccccggtaccggttacggtaccggtaaccggtaacccgagggttccccgtaccccgtcccccgggttacggttacccttacccggtttacccgttccccggttacccccgttacccccg

SEQ ID NO: 187345 - DNA, 623 bp, Homo sapiens
  misc_feature: GYAE6OF01BJ6GI.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagccaccctcggtgtcagtcgtcccaggaccaaacggcaggactcacctactctggagatgcattcgccataccagcaagaactcagaccacggccctgttctggtcatcgtggtgacaccaaccgaaaccgcccgtacgggactcccgtggacgagtacttctcgtcggcctacgacgctacgagggaccaagtcggaccctacgtgactacgtcgacggtcggggacccgtagggtcggagtagtacgaacctagtaacttattagtttacgttactacgaacgtaaagaacgtcgtagtacgacttaagtacgtagggtggggttcgttacggggacgggtaggtactacgaacgtcgtacggtaccggttccgtacggtaccacggacccgtaacggtcccgtcccggtaccccgttcggtacctacccgttccgttcccgttaccccccg

SEQ ID NO: 187346 - DNA, 878 bp, Homo sapiens
  misc_feature: GYAE6OF01CE1JN.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctctactttctgcacagtctctgacgcctcctatgagctgacacacgcccacccgtcggtcgtcagtcgtaccccgaggaaccaaacggccaaggactccacctactcgtaggagatcgctagttcgacctactaaccagacaggaagtaccgacgaacccgacggtcccccttggttcctggtccacgttcgtggtaggaacgacctaacccgaaacccggtaccccgtaccgggactcccgtaggacgtacgtacttcgtcgtcggcctaccgtacgtctacggtaacggaacgtacgtaccggtaccctaccgttagaacccttagtaccggtaacggggtccggggacccggtaagggggtacgggaacgggtacgtaccggtaaaccgttacgtaaaccgtttaaccgtttagtttaaccggtttaacctaaccgtaaaacccggttaacgtaaacccggtaacggttaaccgacgggtttacggtaaaccgttaacgttaccgggttaagggttcgggggggtttaccgggttaccggggggtacgggtaacgggggtaaccgttaacggtaaaccggtcccggttaaccgggtaccccgttaaccgggtttaacgggaccccggtaaccggtacccccggttaaacggggcccccggtttaacccccgggtcccccgttccgggttttaacccccggtaccgttttccccccggttacccccgtttccccccgggttaaccccccccc

SEQ ID NO: 187347 - DNA, 774 bp, Homo sapiens
  misc_feature: GYAE6OF01DJW3N.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgacggcctcctatgagctgaccacacgcccacccgtcggtgtcacgtcgtaccccgaaggaacaaaccggccgaaggactccaccgtactcgtggacgatcgctattcgacctaataccagaccagtaagtacacgaccgacggtcccttcgttctcggtcactcgttgtggaacgaaccaaccgaaaccgtaccccgtaccggggacctcccgtaggacgacgtacttccgtcgtcggtcctaccgacgtccgtacggaacgggaactaacgtcggtaccctaactttcgacttacgacgtacgggtccggggacccggagggtacggaaggtacgtaacgtaccgttacggaaaccttacgttaagtttacgttaacctacaaccggtaaacgtaccgaggtaccgtaacgtacgtaaccgttaacgcgtttaagggttcgggggttacgggttacggggacggggtaaggtaacgttacgaacggttacccggttaaccggtacccgttaccggtaacgggtccgaacccggtcccggtaaacgggtccccgtaccccggttccccccgggttacgttaccccgttaccctttacccgtttccccgttacccccccggttaaccccc

SEQ ID NO: 187348 - DNA, 846 bp, Homo sapiens
  misc_feature: GYAE6OF01DFCRZ.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgacggcctcctatgagctgacacacgcccacccgtcggtgtcacgtcgtaccccgaaggaccaaaccggccaggactccaccttactcgtggagatgctattcgaccataccgagacaagaacgtcgaacgaccgacggtcccctgttcgtggtcactcgtggtaggacaaccaaccgtaaaaccggccccgtaccgggtaactcccgtaggacgtacgttacttcctacgtcggacctaccgagccgtacgaacgggtaccaaacgtccggaccctaccgtttacgacttacgtacggtacgggtccggggacccgtaggggtaggggaacggtacgttaacggtaacccgttacgtaaacccgtttaacgttaacgttttaccggtttaaaccctaccgtaaaacgaacgggtaacctacggtaccgtaacggttacggtaaaccttaacggtccggtttaacgggggtttcggggggtttaccggtttccggggggaaccggggtaagggttacctaaccgggaaccggttacccggttaaccgggtaacccccggttaccggttaaacgggtaacccggtaacccgggtaaccccgggtaacccggtccccggttacccccggtaccccccgggtttaccggttaacccttacccgtttcccccgggtttcccccgtttacccccccggtaccccccg

SEQ ID NO: 187349 - DNA, 712 bp, Homo sapiens
  misc_feature: GYAE6OF01CEUHN.4.47.E03.1.454.CMB.1.raw
  modified_base (575)..(575): a, c, t, g, unknown or other
  misc_feature (575)..(575): n is a, c, g, or t
  modified_base (606)..(606): a, c, t, g, unknown or other
  misc_feature (606)..(606): n is a, c, g, or t
tcagagcactgtagcacgaccggtgctcgatttagactcgcgcacagagagaagggggtgggctcaggaggcagagctctgggaatctcaccatggcctggaccctctcctgcctccccctcctcactttctgcacagtctctgaggcctcctatgagctgacacacgcccacccgtcggtgtcagtcgtaccccaggacaaacggccaggactccaccttactcgtaggagatcgactattcgaccaactaccgagacgaagaacgtacacgaccgacggtccccttgttccgtggtcattcgtggtacggaacgaaccaaacccgaaacccggaccccggttacccgggaccttaccccgtaggtaaacggtacgtacgtttccgtcggttcggcccttaccgaacgcccgttacgggaacgggaacctaacggtccggacctacgttacgtactacgttacggacggggttaccggggaccgtaggggtcgggaaggtacgttaacggaaccgttgttaaaccttacgtttacgttacgttaacgaactaacgtaagaccgtagacgtagtntaactaagtcgagggttgggtcggtacgggnggtaggactacgtaggctcggacccggttcgtaggcccacgtaccggaaccgtccgtccccgtacccctcgggtacctacccctcgttcccgtacccccttccccg

SEQ ID NO: 187350 - DNA, 666 bp, Homo sapiens
  misc_feature: GYAE6OF01AZVXY.4.47.E03.1.454.CMB.1.raw
  modified_base (231)..(231): a, c, t, g, unknown or other
  misc_feature (231)..(231): n is a, c, g, or t
tcagagcactgtagcacgaccggtgctcgatttagactcgcgcacagagagaagggggctgtgggctcaggaggcagagctctgggaatctcaccatggcctggacccctctcctgcctccccctcctcactttctgcacagtctctgacggcctcctatgagctgacacacgcccacccgtcggtgtcagtcgtccccaggacaaacggccaggatcacctactctgganatgctattcgaccataccagcaagaatcgacgaccgacggccccttgttcctggtactagtcgtggtaggaacgaccaacccgaaaccggtccccgtaccgggaacctcccgtaggaacgtacgtactttccgtcgtcggcctaccgagtcctacggaacggactaacgtcggacctacgtacgactagtcgacggtcggggccgtaggtaggagtacgtacgtaactcgtaactacgttattacgttacacgaactagacgagcgtagtctaactagtacgtacgggttggggttacggttacgggacgggtaggtacgtacggtaacggtccgtaaccgggtaccgttaccggtaaggtacccgaaccggtacccggaacggttccgtacccggtaccccggttaccgttcccgtaccttcccgttacccccg

SEQ ID NO: 187351 - DNA, 638 bp, Homo sapiens
  misc_feature: GYAE6OF01D77B2.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagcccaccctcggtgtcagtcgtcccaggacaaacggccaggatcacctactctggagatgcattcgccataccagcaagaacgtcacgaccacggcccctgttcgtggtcatctggtggacgaccaacccgaaaccgacccgtccgggactcccgtgacgagtacttctcgtcggcctccgagctacgagggaacaacgtcggaccctaccgttagactacgtacgtacgggtcgggggaccctaggggtacgggagggtaactacggtaaacccgtaggtaaccttacgttatttacgttactacaaacgagacacgctagtgtactaatcgtagggttcggggttggttcgggacgggtaggtagtacgaacggtccgtacggtacccggttcggtacggtaccgacggacccgtaaggcccgttcccgacccccggttacggtcctacccgttcccgttacccccg

SEQ ID NO: 187352 - DNA, 657 bp, Homo sapiens
  misc_feature: GYAE6OF01A00ZM.4.47.E03.1.454.CMB.1.raw
tcagagcactgtagcacgaccggtgctcgatttagactcgcgcacagagaggaagggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaaacggccaggatcacctactctggagatgctattcgcataccagcagaagtcacgaccacggcccctgttctggtcatctggtggacgaccaccaaaccgccccgtccgggactcccgtagagtagtacttctcgtcggcctccgagcctcggacggacagtcggaccctacttgactagtcgtagggtccgggaccgagggtcgggagtagtacgtaacctggtacttaacttagttacgttaccgtactaaacgtagaacgtacggactaggtactaccgttaagtcgtagggttcgggggttacgggttccggggacggggaacggtagtacggtaacgtccgtaccggtacccggtaccggttacggtaccggacccggtacccgaaccgggtccctccccggtacccccgttcgggaccttaacccgttccttcccggttcccccctaccccg

SEQ ID NO: 187353 - DNA, 615 bp, Homo sapiens
  misc_feature: GYAE6OF01EKBHE.4.47.E03.1.454.CMB.1.raw
  modified_base (498)..(498): a, c, t, g, unknown or other
  misc_feature (498)..(498): n is a, c, g, or t
tcagagcactgtagcacgaccggtgctcgatttagactcgcgcacagagagaagggggctgtgggctcaggaggcagagctctgggaatctcaccatggcctggacccctctcctgcctccccctcctcactttctgcacagtctctgaggcctcctatgagcctgacacagccaccctcggtgtcagtcgtccccaggaccaaacggccaggatccacctactctggagatgctattcgcataccagcagaatcagaccaggccctgttctggtctatctggtggacgaccaaccgaaaccgacccgtccgggacttcccctaggacgagtacttctcgtggtcctccgagtcgtacgagggaacaacgtcggacctaccgttgactatcagggtcgggccgtagggtggaggatacgaacgtgtactacttattagttacctacaacgacgacagacagtcgactaagtccgtaaggttcggggttagttcggggngggtaagggactagaacgtccgtacggtacccgtccggttaaggtacccgaacggtaccccgaacgggtccgtacccggtccccccgtacggtcccttacccgttccgttacccccg

SEQ ID NO: 187354 - DNA, 754 bp, Homo sapiens
  misc_feature: GYAE6OF01CCX0S.4.47.E03.1.454.CMB.1.raw
  modified_base (230)..(230): a, c, t, g, unknown or other
  misc_feature (230)..(230): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggaacaaaccggccaggactcacctactcgtagganatgactagttcgacctagtaccgagaccaaggaaacgtcaacgaaccgacggtccccttgttccgtggtccattccgtgtggaactaccaaccgaaaccgcccgtaccgggactcccgtaggacgaacgtactttctcgtcggccttaccgacgcctcgaacggggaacctaagtccggaccctaaccgtttcgaacttaaacgtcgtaacggggttccggggacccgtaggggttacggaagggtaacgtacgtaacccgtagtaacccttaacgttaacgtttacggttaacctacgaaacgagaaccgacgtccgaggttacgtaacgttaactcggtacggttgggggttcggttacgggacgggtaaggtactacgaaacggtcgttaccggtacccggttacgtaaccggtaccggttaaccggacccccggtaaacgggtcccttccccgggtacccccgttccggttaacccgttaccccgttcccgttcccggtttcccccccgttaaccccccg

SEQ ID NO: 187355 - DNA, 921 bp, Homo sapiens
  misc_feature: GYAE6OF01B5X3B.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggaacaaacggccaggactcacctactctggagatgcattcgccataccagacaagaagtcaagacccacggcccctgttctggtcattcgtggtgacgaccaaccaaccggaccccgtccgggaactcccgtagacgacgtattccgtcgtcggcttaccgaagtccgtacgaacgggacctaaacgtcggtacccctaaccgttcggaaaccttacgtaccggtaacggggttcccggggggaccccgtaagggggttacgggtaacggggtaactttaaccgggtaaaacccccgttaggtaaaccccgttttaaacgtttaacgtttttaaccgggttaaacccttaacccgtaaaaccggtaaccggaaaccgttaaacggtacccgggttaaacggtaccggtaaacccgtttaaaggtttcccgggtaaagggggtttttaacgggggggggtttcccggttttaacccggggggggaaccggggggtaacgggggttaaaccgttaacccgggtaaacgggttacccgggtttaacccgggggttaaaccccgtttaccggggttttaaaccccggggggtaaccctaacccggggtaaacccccccgggtaaaacgggggttacccccccgtttccccgggtaaccccccccccgggttttaggggtacccccccttaaccccgggttttccccccggttttaccccccccggggg

SEQ ID NO: 187356 - DNA, 681 bp, Homo sapiens
  misc_feature: GYAE6OF01CQSBM.4.47.E03.1.454.CMB.1.raw
tcagagcactgtagcacgaccggtgctcgatttagactcgcgcacagagagaagggggtggctcaggaggcagagctctgggaatctcaccatggcctggaccctctcctgcctcccctcctcactttctgcacagtctctgaggcctcctatgagctgacacacgcccacccgtcggtgtcagtcgtccccaggacaaacggccaggactcacctactcgtaggagatgctagttcgaccataccagcaagaacgtcacgaccacggtccctgttctggtctagtcgtggtaggacaacaaccgaaacgtcccgtaccgggaactcccgtaggacgtacgtacttccgtacgtcggtcctccgagtcctacggaacgggacaacgtcggaccctacgtacgtactacgtacggagggtccgggaccgtaaggggtcgggaacggtagttaaccggaaccctaggtaacccttaagttaacgtttacggttaacacaaacgaacgaacgtacgaccgtagtacgtaactaacgtccggtaagggttcggggttacggttacgggacggggtaagacgtacgaagtcgtaccgaccggttcgtacgggaccaccggacccgtaggtccctacccggtccccgttacggtaccctaccgttcccgtccccgttccctaccccg

SEQ ID NO: 187357 - DNA, 703 bp, Homo sapiens
  misc_feature: GYAE6OF01B4R5R.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacacgcccaccctcggtgtcagtcgtcccaggacaaacggcaggactcacctactcgtggagatgctattcgaccataccagcaagaacgtacaacgaccacggcccctgttctggtcatctggtggacgaccaaccgaaaccgccccgtaccgggactcccgtaggacgacgtactttcgtacgtcggccttaccgagtccgtacgaacggggactaagtccggaccctacgttacgactagtacgagggttaccggggacccgtagggtacgggacggtacgttacggaaccttacggtaacttacgtttacgtttacgttaacctaccgtaaacgtacgaacgaacgtacgaacggttcaacgttaagtccgtaagggttcggggtcgttacggggacgggtaaggtactacgaacggtcgttaccgaccgttacggtacggtcctaaccgggacccgtaacgggcccgttccccggacccccgttacgggtacccttaacccgttcccgttccccggtttccccccgtccccccg

SEQ ID NO: 187358 - DNA, 755 bp, Homo sapiens
  misc_feature: GYAE6OF01AR2BZ.4.47.E03.1.454.CMB.1.raw
  modified_base (234)..(234): a, c, t, g, unknown or other
  misc_feature (234)..(234): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgacggcctcctatgagctgacacacgcccacccgtcggtgtcacgtcgtccccgaggaaccaacggccaggctacacctactcgtagganatgactattgaccataccagacagaacgtacacgaccgtaccggtcccttgttacgtcggtctacgttcgtcgggtacggaccgtaacccaacccgtaaacccgtccccggtaccggtacctacccggtaggtaacgtacgttcttaccgtcggttcggtcccgtaccgacgtaccgtacggaacggtacgtacggtccggtaccctaccgttacgtaactacgtacggtacggggtccgggaccggtaggggtaggaacgtacgtaacgaaccgtagtaaccgtttaagttacgttactaaccgtaacgaacgtaaccgtagtacgacgttaggtactaaccgtagtacggtagggttacgggttacgggtacggggacggtaaggtactacggtacgtccgttaccgggtaccggttacggtacggaccggtaccgacccggtacggtaccccgttccccgtacccggtttacccggacccttacccgttccccgttccccggttaccccgttaccccg

SEQ ID NO: 187359 - DNA, 844 bp, Homo sapiens
  misc_feature: GYAE6OF01ECHAI.4.47.E03.1.454.CMB.1.raw
  modified_base (234)..(234): a, c, t, g, unknown or other
  misc_feature (234)..(234): n is a, c, g, or t
  modified_base (791)..(791): a, c, t, g, unknown or other
  misc_feature (791)..(791): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctctactttctgcacagtctctgacggcctcctatgagctgacacacgcccacccgtggtgtcagtccgtccccgaggaacaaacggccaggactccacctactcgtgganatcgactagttcgacctaactaccgagacgaaggaacgtccgaacggaacccgtaccgggtccccctttaggttccgttacgggtacctacgttccggttagggtacgggaaaccgaaccccaaaaccccggtaaaaccccggtccccgggttacccgggtaaccttaccccggtaggtaacggtaacgttacgtttcccgtacggtcggtaccctaccgaacgtccgtaacgggaacgggaacctaacggttccggaacccttacgttacgtaccttacggtaccggtacggggtccggggaccgtagggggtacgggaacggtacgtacggtaaccgtacggtaactttacgttaacgtttacgttaacctaccgaacgtacgaacgtacggtaacgtaaggttacgtaacttaaggtacggttaggggttcgggggtttacgggttacccgggggaagggttaacgggtaccttaccgggaacggttcccggtaccgggtacccgttacggtaccgggtaccgaccggaccccggtacggtccccggttccccncccccgggtttgaccccttacccgtttcccggttccccgtcccccctaacccg

SEQ ID NO: 187360 - DNA, 641 bp, Homo sapiens
  misc_feature: GYAE6OF01AWQDZ.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatccacctactctggagatgcattgccataccagcagaagtcagaccacggcccctgttcgtggtcatctgtggagacaaccaaaccgacccgtccgggactcccgtgacgagacttctctgcctccgagctcgagggacaatcggccacttgactatcgaggtcgggacccgtagggtggaggagtacggaacctgtaacttaacgttattcgttaacctacaacgtacgaactaacgcgaagtcgacgttaactcgtaagggttcggggttagggttccggggacgggtaacggggtacgtacgtaacggtacgttaccggacccggttacgttaacgggtccgtaacggacccccggtaaacgggtcccgttacccggtccccccgttacggtacccttaccgttcccttcccgttacccccttaccccccg

SEQ ID NO: 187361 - DNA, 830 bp, Homo sapiens
  misc_feature: GYAE6OF01BGY9N.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacacgcccacccgtcggtgtcagtcgtaccccgaggaaccaaacggccaaggactccacctactcgtggaagatgctattcgaccaactaccgagacaaggaagtcaacgacccgacggtcccctgttcgtcggtactatcgtggtacggacgaaccaaccgaaaccgtaccccgtaccgggactcccgtagaacgacgtacgtttctcggtcggtcctccgagccgtacgaacgggtaacaacgtcggtacccctacgttacgaaccgttacgtaccggtaacgggttccggggaccccggtaaggggttacggggaacgggtaacgttaacgggtaaacccgttacgggtaacccgttaaacgtttaacgttttaacggtttaaaccctaaccgtaaaacgtaaccggtaaaccgtaacggtaaccgttaacggttacggtaaccttaaacggttccggtaagggtttcggggggttacgggtttaccgggggacggggttaagggaacggtaccggtaaacggtccgttacggtaaccccgggtaccggttacggtacccgtaacccggaccccggtaacgggtccccgttacccggacccccggtttaccggtacccgttacccgtttaccccgttccccgggttaccccccttaccccccg

SEQ ID NO: 187362 - DNA, 838 bp, Homo sapiens
  misc_feature: GYAE6OF01BIWGT.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctctcactttctgcacagtctctgaggcctcctatgagctgacacagcccaccctcggtgtcagtcgtccccaggacaaacggccaggatcacctactcgtggagatgctattcgaccataccagcaagaagtcacgaccacggtccctagttctggtctatcgtgtacggaacgtaccaaccgaaaccgtacccgtaccgggaccttacccgtaggacgaagttactttccgtacgtcggtacccttaccgacgtcctacggaacggggtaacctaaacgtccgggaaccctaaccggttcgtaaccgttacgtccggaacggggttccgggggaccccgtaagggggtcgggaacgggtaacgtaccggtaaccgttacggtaactttaacgttaagtttaccggtttaaccttaaccgaaacgtacgaaccgtaacggtaccgtaaggtacggtaaccttaaggtaccgttaaggggtttccggggggtttaacgggttaccgggggaacgggggtaaacgggttaacgttaaccgggaaaccgggttccggttaaccgggtaaccccgggttacccggttaacggggtaccccgaacccgggttaacccccgtaaacggggttcccccggttaacccccggacccccggtttacccgggtaccctttaacccggttcccgtttacccccgtttaacccccccgttaaccccccg

SEQ ID NO: 187363 - DNA, 711 bp, Homo sapiens
  misc_feature: GYAE6OF01CQP8R.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgcctcccctcctcactttctgcacagtctctgacggcctcctatgagctgacacacgcccaccctcggtgtcagtcgtcccaggacaaacggccaggactcacctactctggagatgcattgccataccagcaagaagtcacgaccacggccctgttctggtcatcgtgtggacgaccaccgaacgacccgtcgggactcccgtagagagtacttctcgtcgctaccagctacgaggacaagtcggacctaccgttgaactacgtacgtacgggtcggggacccgtaggggtacgggaacggtacgtacggtaaacccgttggaaacctttaacgttagttttacggttaacctaccgaaacgtaacggtaacacggtacctaacggtcgtaacttaaggttaccggtaaggggtttcgggggttacgggtttaccggggacggggtaacggggtaacttaaccgggaaacggtccggttacggtaaccccgggttaccgttaccggggtacctaacccgggaccccgtaagggttccccgtacccgggtaccccccgttacggggtcccttaacccggttcccgtttacccccgg

SEQ ID NO: 187364 - DNA, 655 bp, Homo sapiens
  misc_feature: GYAE6OF01EZ0L6.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagcccaccctggtgtcagtcgtccccaggacaaacggccaggatcacctactctggagatgcattcgccataccagcaagaagtcagaccaggcccctgttctggtcatctgtggagaccaccaaaccgcccgtccgggactcccgtagagagtacttctcgtggcctccacgctacgaacgggacaagtcggcctacttagactagtcgaggtccggggaccctagggtggaggtagtacgaacgtacgtaacttaactagtttacgttaactaccaaagaacgtacaacgtcgaagttacgtactaactacgtagggtggggttcgggttaccgggtacgggacgggtatacggaacgtcgtaccggtacccggtacgtaaccgggttccgaacggtacccggtaaacgggcccgttacccggtcccccccgttccgggtacccttacccgttacccggttccccgttaccccccggttaccccccg

SEQ ID NO: 187365 - DNA, 714 bp, Homo sapiens
  misc_feature: GYAE6OF01DN7IL.4.47.E03.1.454.CMB.1.raw
  modified_base (161)..(161): a, c, t, g, unknown or other
  misc_feature (161)..(161): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctcactttctgcacagtctcgtggacgcctctagtganctgacacgacgcccacccgtggtctacgacgtccgtaccccgaaggaaccgaaaccggccgaaggactaccaacccttactcgtagggatacgtcgactagttcgacctactacccgagaccaaggtaacgtccgaacgaccgaccggtcccttagttcgtggtacacgttcgtggtacggaaccgaaccaaacccgtaaccggtcccgtacggacctccgtaagacgtagtacttcgtcgcggtcctaccgagtccgtacgaacggaacctaacgtcgaccgtacgtacgactagtacggtagttcgggaacgtccgaggaacgtaaggaacgggtacgaacggtcgtaacggtaactttaacgttcgtactaactacgtaacacgaagtacgacggtagggtacgggttaagtaacttaaggtaacgggtgggttaccgggacggtaacgaccgaacgtcgtacgacccggtgtaacgacggacccgaccggtacgcccgttacccgccccgttcgaccttaccgttcccggttcccgtccccgttacccg

SEQ ID NO: 187366 - DNA, 668 bp, Homo sapiens
  misc_feature: GYAE6OF01CG9W2.4.47.E03.1.454.CMB.1.raw
  modified_base (180)..(180): a, c, t, g, unknown or other
  misc_feature (180)..(180): n is a, c, g, or t
tcagagcactgtagcacgaccggtgctcgatttagactcgcgcacagagagaagggggtgggctcaggaggcagagctctgggaatctcaccatggcctggacccctctcctgcctccccctctcactttctgcacagtctctgacggcctctatgagctgacacacgcccaccctggtntcagtcgtacccaggaccaaacggccaggactcacctactcgtggatatgctattcgaccataccgagcaagaagtcacgaccacggcccctgttctggtcatcgtggtggacgacaccgaaaccgcccgtcggactcctagagacgtattccgtcgtacggcttaccgacgtccgtacgtacggggaactaacggtcggaccctacgttacgacttacgtaccggtcgggtaccggggcccggagggtacgggaagggtacgtaccggtaaccgtcggtaaccttaactttacgtttacgttactaccaacgaacgacacgtacgtagtaccgtataacgtcggtaggttcggggttcggtacggggtagggaggtacgtacgaggtccgtacggacccgtcggtacggtaccgacggtacccggacgtccgtcccgcccccgttcggacccttaccgttcccgtccgttccccccggttacccccg

SEQ ID NO: 187367 - DNA, 683 bp, Homo sapiens
  misc_feature: GYAE6OF01EXKGH.4.47.E03.1.454.CMB.1.raw
  modified_base (137)..(137): a, c, t, g, unknown or other
  misc_feature (137)..(137): n is a, c, g, or t
  modified_base (186)..(186): a, c, t, g, unknown or other
  misc_feature (186)..(186): n is a, c, g, or t
tcagagcactgtagcacgaccggtgctcgatttagactcgcgcacaggagagaagggggctgtgggctcaggaggcagagctctgggaatctcaccatggcctcggacccctctcctgcctccccctctcactttcngcacagtctctgacggcctcctatgagctgacacagcccacccgtggtntcgagtcgtccccgaggaaccaaacggccaaggactccaaccttactcgtagggacgtagtgacctagttcgaccctaataacccgagacaaaggaacgtccaacggacccacggtccccttagtttccgtggtccatcgtggtacgacgaccaaccgaaaccgcccgtacgggactcccgaggacgtagtacttcgtctcggcctacgagctacgagggactaacggtcgaccctaccgttgacttagtcgagggttccgggccgagggtggacgtacgtacgaaccttagaacttagtacttacgttacctacaaactagacagacctagtacgtaacctaagtcgtagggttacggggtcgttcgggacggtacgggtactacggtaagtccggtaacggtacccggttacgtacgggtaccgaacggtaccccgaagggtcccgttacccccggccccgttaggtacccctacccggtttcccgttacccccg

SEQ ID NO: 187368 - DNA, 843 bp, Homo sapiens
  misc_feature: GYAE6OF01EB51N.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctctactttctgcacagtctctgacggcctcctatgagctgacacacgccctacccgtcgggtcgtcacggtccgtacccccgaagggaaccgaaaccgggcccgaagggacttacccaacccttaaccttcgtagggaagtatggtctagttcgaccacgtaaccgaggacgaacgaaggtccaacgacccgtaacggtccccttgttccgttggtccaacgttcgttcgggagggtaacgaacccgtaacccggaaaacccggtacccccggttacccggggaacttccccgtagggaacggtaacggttactttccgtcggtacggccctaccgagtccgtacggagggaacctaaggtccggaccctacgttagaactacgtccgaagggtccggggaccgtagggtcgggaacgtacgtacggtaaccgtacggtaactttaacgttaagtttaccggttaaccctaacgaacgtaacgtaaccgtacgaccgtaaggttcgtaaccgttaaacgtcggtaaggggttcggggtttaccgggtaccgggggtaacggggtagggacgtaccggaacggtacccggtaccggtaacccggttacggttacgggtacccgaaccgggtcccggtaaaccggggtcccgttacccccggtcccccgggttcggtaccccttaccgtttcccgttccccggttcccccctaaccccccg

SEQ ID NO: 187369 - DNA, 728 bp, Homo sapiens
  misc_feature: GYAE6OF01A7T6G.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgcctccccctctcactttctgcacagtctctgacggccctctatgagctgacacacgcccacccgttggtgtcagtccgtacccgaggaaccgaaacggccagactaccacctactcgtaggagtatgctagttcgacctaactacccgagacaaaggtaacgtaccaacggtaacccggaccggttcccccgtttaggtttccgttcggttacacgtttcgtagggttacggaaaccgtacccgaaacccgtaaaacccggtaccccggtacccggggacttccccgtaggaaacgtacgttactttccggtcgtcggtaccctacgacgtctacggaaggaactaacggtccggacccttacgttagaactcgtacggacgggtccggggaccggtagggtacgggaagtacgtacgtaaccgtacggtaacttatacgtttacgtactacaacgagtaccgagactagacgtaacgtattacggagggttcggggttacggttccgggaggtacggtacgagtacgtaccgttaccggccgttaccgaggtaccgacgaccggtaccgccgttacccggaccccgttcgtaccctcgttcccgtccccgg

SEQ ID NO: 187370 - DNA, 639 bp, Homo sapiens
  misc_feature: GYAE6OF01B3JIT.4.47.E03.1.454.CMB.1.raw
  modified_base (181)..(181): a, c, t, g, unknown or other
  misc_feature (181)..(181): n is a, c, g, or t
  modified_base (222)..(222): a, c, t, g, unknown or other
  misc_feature (222)..(222): n is a, c, g, or t
  modified_base (626)..(626): a, c, t, g, unknown or other
  misc_feature (626)..(626): n is a, c, g, or t
tcagagcactgtagcacgaccggtgctcgatttagactcgcgcacagagagaaggggctgtgggctcaggaggcagagctctgggaatctcaccatggcctggacccctctcctgctccccctctcactttctgcacagtctctgaggccttctatgagctgacacacgcccaccctggtntcagtctcccaggacaaacgccaggatcacctatcgtgganactgctattcgcctataccagcaagaacgtcagaccacgcccttgttacgtggtctatcgtggtaggacaaccaaccgaaaccgacccgtaccgggtactccccgtaggaacgtacgtacttcctcgtacggtctaccagtccgtacgaacgggacctaagtcggaccctactttacggactacgtacggaacggttcgggggaccgtagggtaggacggtaacgtacggtaaccctggtaaccttacgttaagttttacgtaacgtaccaaacgtaccgacgtaacgctagtacgtaactaagtaccgtaggttcggggtagttcgggagggtacgaatcgtaacgtcgtacggacccgtacggtaggccgtacgccgtaggacctccgaccccgtaggtccncgttcccgtcccg

SEQ ID NO: 187371 - DNA, 801 bp, Homo sapiens
  misc_feature: GYAE6OF01BOPNU.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgacggcctcctatgagctgacacacgcccacccgtcggtgtcaggtccgtacccccgaagggaaccaaaaccggccgaaggtactaccaacccttactcgtaggagtagtcgacctagttcgccctaactaaccgagaccgaagaacgtacacgacccgacgtccccgttgttcgtaggtcctagttccgtggacggtaaccgaacccaacccggaaacccgtcccggtccgggactcccgtagacgtatcttcgtcgtcgcctaccacgtcgtaccgaggtacaacgtcggaccctacgttacgaacgttacgtacggtacgggtccggggacccgtaaggggtacgggaacggtacgtaaccgtaaccgttacgtaacttaaccgtttacgtttacgttaacccgtaactaaaccgagtaaccgtaacgaccgttaacggtacgtaaccgttaacggtacggttacgggtttacgggggtttccgggttaacggggacgggttaacgggtacgtacgaacccgggtttccggcggttaaaccccggttacgtaaccggtccgaaccccgggtacggtaaccggtccccgttacccgggtacccccgtttcgtaccccgtacccggtttccccgttccccgttccccggtaccccc

SEQ ID NO: 187372 - DNA, 762 bp, Homo sapiens
  misc_feature: GYAE6OF01DD0EB.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctcgcctccccctcctcacttttctgcacagtcctctgacggccctcctatgagctgacacacgcccacccgtcggtgtccagtccgtaccccgaaggaaccgaaaccggccgaaggactccaacccttactccgtagggagatcgactacgttcgaccaactaccgaagacaaggaaacgtcgaacgacccgaaccggtccccgttgtttccgtcggtacacgttcgtcggtaggaaccaaccgaaacccgaaaaccgtaccccggtacccggaaccttcccgtaggaacgtacgttacttcctcgtccgtccttaccgacgtccgtacggaagggaacctaacgtccgggaccctaaccgttacgaacttcgtaacggtacgggttccggggacccggtagggcgggtacggtacgtaaccgtaaccgtagtaaccgttaactttacgtttacgttaacccgtactaacgaacgaactacgactaggtactattaacgtcgttaggttgggttaccggtcgggacgggagtacgtagtacgtacgttaccggaccgttccgtacgaccgtacggacccgtacggtcccgtaccccggttccccggtacgttacccctagttacccgttccccgttaccccgttacccccg

SEQ ID NO: 187373 - DNA, 724 bp, Homo sapiens
  misc_feature: GYAE6OF01COWAW.4.47.E03.1.454.CMB.1.raw
  modified_base (131)..(131): a, c, t, g, unknown or other
  misc_feature (131)..(131): n is a, c, g, or t
  modified_base (179)..(179): a, c, t, g, unknown or other
  misc_feature (179)..(179): n is a, c, g, or t
tcagagcactgtagcacgaccggtgctcgatttagactcgcgcacagagagaagggggtgggctcaggaggcagagctctgggaatctcaccatggcctggacccctctcctgctcccctcctcactttcngcacagtctctgaggcctcctatgagctgacacagcccaccctcggtntcagtcgtccccaggacaaacggccaggatcacctactctggagatgcatgccataccagcagaagtcagaccaggccctgttctgtcatcgtgtggacgacacccaaaacggtcccctaccgggactcccgtaggaagtacgaatttcctcttcgggcttccgacgctacgacgggacaagtcggccctacgttcgactagtcgagggtcgggacccgtagggtacggaacggtagtaccggtaaaccgttgtaacccgttacgttaactttacgggttaaaccttaccgaaacgttaacggaacctggaaccttacggttacgtaaccttaacgtaccgtagggttacgggggttcggttaccggggtacgggtaacggggtacttaccggaaacggtccgttaccgggtaaccccgttaccggttaaaccggtaccgggtaacccgtaacccggtaaacccggggtcccgttaaccccgccccccgggttttacggacccgttaaccctttcccggttcccggttcccccttaacccccccg

SEQ ID NO: 187374 - DNA, 661 bp, Homo sapiens
  misc_feature: GYAE6OF01EE215.4.47.E03.1.454.CMB.1.raw
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
tcagagcactgtagcacgaccggtgctcgatttagactcgcgcacagagaggaagggggtgggctcaggaggcagagctctgggaatctcaccatggcctggacccctctcctgcctccccctcctcactttctgcacagtctctgagcctcctatgagctgacacagcccaccctggtgtcagtcgtccccaggacaacggccagntccactactcagganatgctattcgccaataccagacaagaagtcaacgaccgaccggtccccttgttccgtggtctatcgtggtaggacgaccaaccgaaaccgtaccccgtccgggtactcccgtgacgagtacttcctcgtcggccttccgaagtccgtacggaacggaacctaagtccggaccctaacgttacgtaacctacgtccggagggtccggggacccgtaaggggttggaaggtacgtacgtaacccgtagtaacgttaacttacgttcgttaaaccgacaaacgtaacgactagactagtactattaacgtcgtagggttaggggttcgggtacgggacgggtaaggtctagacggtcgtacggtacccgtacgtacgtcgacgaccccgaggcccgttcccgccccgtacgtccctacttccgttcccgtcccccgttcccg

SEQ ID NO: 187375 - DNA, 705 bp, Homo sapiens
  misc_feature: GYAE6OF01AQHNJ.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctctcactttctgcacagtctctgaggcctcctatgagctgacacacgcccaccctcggtgtcagtcgtccccaggaccaaacggccaggactccaacctactcgtaggagatgctattcgccataccagcaagaagtcaacgaccacggcccctgttcctggtcatctgtggacgaccaaccaaccgtcccgtcgggactcccgtagagtagctttctactggcctccgagtcctacggaacggtaacctaacgtcggacccttaccgtttagaaccgttagtccgtagggtaccggggacccgtaggggtcggaaggtactacgaaccgttagtaacctacttagttacttaactaccaagtacgactacgtacgacgtcgtaactaacgtacgtagggtacggggtttcgggttaccggggacgggttaaggggacgttacgaacggttccggtacggtacccggttaccggtacggtaccgtaccggtaaccccggagggttacccccgtccccgggtccccccgttaccgggtacccttaaccccgttcccgtttaccccgttccccccgttaccccccg

SEQ ID NO: 187376 - DNA, 783 bp, Homo sapiens
  misc_feature: GYAE6OF01AXF1Z.4.47.E03.1.454.CMB.1.raw
  modified_base (161)..(161): a, c, t, g, unknown or other
  misc_feature (161)..(161): n is a, c, g, or t
  modified_base (185)..(185): a, c, t, g, unknown or other
  misc_feature (185)..(185): n is a, c, g, or t
  modified_base (233)..(233): a, c, t, g, unknown or other
  misc_feature (233)..(233): n is a, c, g, or t
tcagagcactgtagcacgaccggtgctcgatttagactcgcgcacagagagaagggggctgtgggctcaggaggcagagctctgggaatctcaccatggcctggacccctctcctgcctccccctcctcactttctgcacagtctctgaggcctctatganctgacacacgcccacccttcggtntcagtcgtcccaggacaaaccggccaggactccacctactcgtagganatgctattcgccaataccagcaagaacgtcaacgacccacggtccccttagttctcggtacacttcgtggtacgaacgaaccaacccgaaacccgaccccggtaccgggaccttaccccgtaggaacgtacgttacgttccctacggtcgtccctaccgtaacgtcctaacggaacgggtaaccaaaggtttcccggaacccctttaaccgtttagaacctttacgtaccggtacggggtccgggggtaacccggtaggggtaacggggtaaggtaaccgtaaccggtaaccgttaagtaacccgtttaacgttaaccgttttaccgttaaaccctaacgaaaacgtaaccggtaacacggtacctaaggttacgtacttaacgttaggaacgggtttgggggtaacgggtttccgggaggggtaacgtaccgtacgaacggtaccgtacgtacccggttaccggtaccggacgaacccggacccggtaacggtacccgtccccgttacccccgggttaccggtaccctacccggttccgttacccccgg

SEQ ID NO: 187377 - DNA, 738 bp, Homo sapiens
  misc_feature: GYAE6OF01EV90L.4.47.E03.1.454.CMB.1.raw
  modified_base (133)..(133): a, c, t, g, unknown or other
  misc_feature (133)..(133): n is a, c, g, or t
tcagagcactgtagcacgaccggtgctcgatttagactcgcgcacagagagaagggggtgggctcaggaggcagagctcgtgggaatctcaccatggcctcggaccctctcctgcctcccctctctactttcngcacagtctctgaggcctctatgagctgacacacgccaccgtcggtgtcagtcgtccccgaggaccaacggccaggatccacctactctaggacgagtcgctattcgccaataccagcaagaagtcacgaccacggccctgttctggtcatctggtaggactaccgaaccgaaaccgcccgtaccggactccgtagacgagttattccgtacgtcgtcctacgacgtcctacgacggtacaacgtccggacctacgtacggtaactcggtacgtaacgggtccggggaccgtaaggggtggaacggttacgtaaccggtaacgtacgttaacgtttaaccgttaagtttacggttaaacctaacgaacccgttaagaaccgacggtaacgtacggttaacgtaattaacggtaagttaacggttggggggttacgtacgggggtacggggtacgggtaactaccgggtaaacgtccgggttacgttaaccccgggttacggttaaacccggtacgtacccgggaaaccccggtagtcccccggtacccggttcccccgtacggttaccccaacggttttccccgtccccgttacccccgttcccc

SEQ ID NO: 187378 - DNA, 685 bp, Homo sapiens
  misc_feature: GYAE6OF01CL9DZ.4.47.E03.1.454.CMB.1.raw
  modified_base (224)..(224): a, c, t, g, unknown or other
  misc_feature (224)..(224): n is a, c, g, or t
tcagagcactgtagcacgaccggtgctcgatttagactcgcgcacagagagaagggggtgggctcaggaggcagagctctgggaatctcaccatggcctggaaccctctcctgcctccccctcctcactttctgcacagtctctgaggcctcctatgagctgacacagccaccctcggtgtcagtcgtccccaggacaacggccaggatcacctactcgtgganatgcattcgccataccagcagaagtcagaccacggccctgttctggtctagtctggtcggaacgactacccgaaaccgccccgtcccgggactcccgtggtaacgagtactttccgtcgtcggtcctccaggccttacggaaggggtaaccaaacgttccggaaccctacccgtttacggaaccttagtaccggtacgggttccgggggaccccgtaggggttacggggaacggttaacgtaccgggttaaccgtcggtaaacttaacgttactttacggttaactaccgaaactacgacgagacctaagtgtaactatcggtaggttggggttacggtcgggacgggtagggtactacgtaacggtcttaccggacccgttacggtacggcgaaccgaccggaaccgtcccgtcccggtccccgtcggtaccctacgttcccttccgtccccctaccccg

SEQ ID NO: 187379 - DNA, 764 bp, Homo sapiens
  misc_feature: GYAE6OF01B3DT1.4.47.E03.1.454.CMB.1.raw
  modified_base (185)..(185): a, c, t, g, unknown or other
  misc_feature (185)..(185): n is a, c, g, or t
tcagagcactgtagcacgaccggtgctcgatttagactcgcgcacagagaggaagggggtgggctcaggaggcagagctctgggaatctcaccatggcctcggacccctctcctgcctccccctcctctactttctgcacagtctctgacgcctctagtgagctgacacacgcccacccgtggtntcagtccgtacccgaggacaacggccagactccacctactcgtaggagatcgactattcgacctataaccgagacaaggtaacgtccgaacggacccgaccggtccccttggtttaccgtcggttacctacgttcggtacgggtacggaaaccgaacccgtaaaccccggtaaaaccccggtcccccgggtaaccggtacccttacccggtaggaacgtacgttaccgtttcgtaccggtaccggtcctaccggagtaccgtacggaacgggtaactaggtcccggaccttacgtcgtaacgtacgtacggtacgggtccgggacgtagggtacggagtacgtaccgtacctagtaaccttacgttagttacgtaacctacgaaacggtacaacgacgtacgtagttacgaacgttaacgtccggtaggggttaccggggttacgggttaccggggacggtaagggttacctaacgggtacggttccgtaaccggtccgtacggtacggtccgaccggtaaccgtacggtcccgtacccgtcccgtacggttactacccgtccgttccctccccgtccc

SEQ ID NO: 187380 - DNA, 817 bp, Homo sapiens
  misc_feature: GYAE6OF01DJ587.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgacggcctcctatgagctgacacacgcccacccgttcggtgtcaggtcgtcccccgaaggaaccaaaccgggcccgaaggtactaccaaccgttactcgtaggagatcgctagttcgaccactaccgagacaaggaactaccgaacgacccgaccgggtccccttggtttccgtggttacagtccgttgtacgggaaccaacccgaaacccgaaaccccggtaccccgtacccgggtacttcccgtaggaacgtacgttacttcctaccggtcggtccctaccgacgtcctacgaacggggactaagtccggaccctacgttacgacgttacgtccggtacggtccggggaccgtacggggtcgggtaacgtacgtaacgtaaccgtagttaaccgttacgttaatttaaccgttactaaccgtaacgtaacgaccgtagtaccggaagttccgtaacttaacgtacggttagggttacgggggtttacgggtccggggaacgggtagggtaaccttacgaaccggtccggtttaaccggtacccggttccggtaacgggtacccgaacccggtaccccgggtaaaccggtccccgttacccccgggtcccccggtttacggttaccccgttaccgttttccccggttcccccggtttcccccggtacccccc

SEQ ID NO: 187381 - DNA, 903 bp, Homo sapiens
  misc_feature: GYAE6OF01EK3CB.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgacggcctcctatgagctgacacacgcccacccgttcggtcgtctacggttccgtacccccgaaggaaccgaaaaccgggcccaagggacttacccgtaacccttacctcggtagggaacgtacttcggacctagtttccgaccctaacgtaacccagactaacggaaacgttaccaaccggacccgacccgggttcccccgtttagttccgtcgggttacctcgtttaccggttagggtacggaaccgaacccgaaaccccggtaaaccccggtaccccggtacccggggtaccttcccggtagtaacggtacgttacgttttcccgtccggtacgtcccgtaccgaacgtccgtacgtaaacgaacctaacggtccggtaaccccttacgttacgtaaccgtacgtacggtacggggtaccggggtacccggtaaggggtacgggtaacggtaccggttaacggtaaccgttaacggttacccttaacgtttacgtttaaccggtttaacacctaaacgtaacggaacctacggtccgtaaggtaccgttaacgtaacgttacgggttaacggggtttggggttacgggtttacggggtaccggggtaacgggtacgtaccggaacgttaccggtacccgtacccggttacgtacggtaccccggaaccggtacccggaccgggttaccccgtcccggttccccccggttcgtaccccgttacgttcccccggttacccgttccccccggttccccc

SEQ ID NO: 187382 - DNA, 728 bp, Homo sapiens
  misc_feature: GYAE6OF01BWPSW.4.47.E03.1.454.CMB.1.raw
tcagagcactgtagcacgaccggtgctcgatttagactcgcgcacagagagaagggggtgggctcaggaggcagagctctgggaatctcaccatggcctggaccctctcctgctccccctctcactttctgcacagtctctgagcctcctatgagctgacacacgcccacccgtcggtcgtcagtcgtcccaggacaaacggccaggactcacctactcgtggagtatgctattcgccgtataccagcaagaacgtcaacgaccacggtcccttgttcgtggtcactcgtgtaggacgaccaaccgaaaccgacccgtaccgggactcccgtagagagtacttctacgtgcctacacgtctacggacggaactaacgtcggtacctaccgttacgaaacttactccggtagggttacggggacccgtaggggtagggaacggtacgtacggtaaccttgtaacttaaccttagtttacgttaactaaccgaacgtacgaccgtagtaccgatcggtaacctaacgttcgtaacggggttcgggttacgggttccggggacgggttaacggacctacggtaacggttccgtaaccgggttaccggttacccgggtacggtaccgtaacccgggacccgttaacggggttcccctaacccccggggtttacccccctcgggttaaccctaacccgtttccccggtttacccgttccccccgttacccccg

SEQ ID NO: 187383 - DNA, 767 bp, Homo sapiens
  misc_feature: GYAE6OF01B8TRJ.4.47.E03.1.454.CMB.1.raw
tcagagcactgtagcacgaccggtgctcgatttagactcgcgcacagagaggaagggggctgtgggctcaggaggcagagctctgggaatctcaccatggcctgacccctctcctgcctccccctcctctactttctgcacagtctctgacggcctcctatgagctagacacacgcccaccctcggtgtcagtcgtccccgaggaccaacggccaggatcctacctactcgtggagatgctagtcgacctataccagcaagaacgtcacgaccacggcccttgttcgtggtctatcgtggtacggacgaaccgaacccgaaaccggtacccccggtacgggtacctccgtagagggtaactacgtttaccgtcgtcgggtacctaccgacgtccgtacggaacggggaacctaaacggtccggtaaccccttaaccgtttacggaaccttaacgtaccggtacggggtcccgggggtacccggtaggggtacgggaagggtacgtacggtaaccgtacgtaacgttaacttacgtttaaccgttactaaccgaaacgtacgaacgtacgacgtagtacgtaacctaagttacgtaggggttacgggggttgggttaccggggacgggtagggtaccgtacggtaacggtaccggtaccggtaccggttaccggttaccggtaccggtaacccggaaccccggtaccggtaccccgtaccccggtacccccgttacggtaccccgtacccgttccccggttacccccg

SEQ ID NO: 187384 - DNA, 734 bp, Homo sapiens
  misc_feature: GYAE6OF01D6SZY.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacacgccacccgtcggtgtcagtcgtcccaggacaacggcaggatcacctactctggagatgcctattcgccataccagacaagaacgtcacgaccgacggtcccctaggttcctcgggtacacttcgtcggtagggaacggaaccaacccgaaaaccggaccccggttaccggggaaccttccccggtaggaacgtagttacgttcctcggtcggaccctaccgaagtcctacggaaggggtaacaaacgtccggaccctaaccgttggtaaccttagtaccggacgggttccgggggtaacccgtaggggggttacggaagggtaacgttaacgggtaaacccctagggtaaaccttacgtttaactttacggttaacctaccgaaaccgtacgaacgtaagacgtacgtacgtacttaacgtacggtaagggttcgggggttcggtacggggtacgggagggttactacggaacggtcgtacggttacccggcggttacggaccgacggacccgtaggtccccgtcccgaccccggttaccggaccttacccgtcgttacccccg

SEQ ID NO: 187385 - DNA, 777 bp, Homo sapiens
  misc_feature: GYAE6OF01B34TS.4.47.E03.1.454.CMB.1.raw
  modified_base (235)..(235): a, c, t, g, unknown or other
  misc_feature (235)..(235): n is a, c, g, or t
tcagagcactgtagcacgaccggtgctcgatttagactcgcgcacagagagaagggggtgggctcaggaggcagagctctgggaatctcaccatggcctcggaccctctcctgcctccccctcctctactttctgcacagtctctgaggcctcctagtgagctgacacacgcccacccgtcggtgtcagtcgtccccaggaacgaaacggccaggactcaccgttatcgtggagntgctagtcgccaactaccgagaccaaggtaacgtcgaacgaccgacggtccccttgttcgtacggtctacgttgtcggtacggaacgaacctaacccgaaaccgtccccgtaccgggtactcccgtaggaacgactactttcgtccgtacgggccttaccgaggtacctaacgggaacgggaacctaacggtcggacccttaacggttacggaaacctttacggtacggtaacggggtcccggggtaccggtaggggttacgggaacggttaggtaccgtaaccggtacttaaccgttacttaacgtttacgttaacctacaaacgaacgaccgaacgtacgtaagtcgtaaccttaagtccgtaaggggtttcggggtccgggttcgggaaccgggtaggtactaccggtaaacggtcgttaccggtaaccggttcccgtaagggtcccaacgggtaaccccgtaagggtccccgtaccccggttaccccgttaccggggttccaacccggtttcttcccccgttacccccgttacccccg

SEQ ID NO: 187386 - DNA, 711 bp, Homo sapiens
  misc_feature: GYAE6OF01EONJY.4.47.E03.1.454.CMB.1.raw
  modified_base (88)..(88): a, c, t, g, unknown or other
  misc_feature (88)..(88): n is a, c, g, or t
  modified_base (224)..(224): a, c, t, g, unknown or other
  misc_feature (224)..(224): n is a, c, g, or t
tcagagcactgtagcacgaccggtgctcgatttagactcgcgcacagagagaagggggtgggctcaggaggcagagctctgggaatcncaccatggcctggacccctctcctgctccccctcctcactttctgcacagtctctgaggcctcctatgagctgacacagccaccctcggtgtcagtgtccccaggacaaacggccaggatcacctactctggaganagctattgccataccagcagaagtcacgaccgacggccctgttctggtcactcatggaggacaccaaaccgaaacccgtaccccggattcccccgggtagtaccccgtaggaagtttacgaacctttcggtccttccggaacgtccctacgacgggtaccaaagggtacggaacctaccggttccgaacccttagtaccgtaaggttccggggaccgtacggggttcccggaaggggtacggtagggaaacccttggaaacccttaacgtaacttacgtttaacttcgtaaactacgaaaccacggaccagtacgacgttaagtcgtaaagtcgggtagttacggggtacggttacggggtacggtacgggaagtccgtaaggacccgtaccgtaccgggtcctaacgggtccccgaacgggcccctaaacgggtccccccgacggtttccccgaccccgttcccgttccgttccccgttacccccg

SEQ ID NO: 187387 - DNA, 659 bp, Homo sapiens
  misc_feature: GYAE6OF01CV3R9.4.47.E03.1.454.CMB.1.raw
tcagagcactgtagcacgaccggtgctcgatttagactcgcgcacagagagaagggggtgggctcaggaggcagagctctgggaatctcaccatggcctcggacccctctcctgcctccccctcctcactttctgcacagtctctgacgcctcctagtgagctgacacagcctacccgtcggtgtcagtcgtaccccgaaggaccaaaccggccaggactaccaccttactcgtaggagatgctattcgaccactaccgagacaagaaagtcaacgaccacggcccttagttctcggtcatcgtgtggaacgaactaaccgaaaaccgcccgtaccgggacttcccgtagaagaagtacttcgtacgtcggtacctaccgagtctacgaagggaacaagtcggacctacttagactatacgagggtcgggaccgtgggtaaggaagtactaacgtaacctacgtaacttattaacgttagttaacctacaaacagaacgagacgagtacgataactacgtagggttcggggttacggttcgggacggtaaggtactacgaacggtacgtacgacccggtacgtacggtaacgacgacccggaacggtacccgtccgaccccgttcgtaacctccgtttactcccgttccccgtaccccg

SEQ ID NO: 187388 - DNA, 961 bp, Homo sapiens
  misc_feature: GYAE6OF01DVLET.4.47.E03.1.454.CMB.1.raw
tcagagcactgtagcacgaccggtgctcgatttagactcgcgcacagagagaagggggtgggctcaggaggcagagctctgggaatctcaccatggcctggaccctctcctgcctccccctctcactttctgcacagtctctgacggcctcctatgagctgacacagccacccgtcggtgtcagtcgtcccaaggaccaaccggccaggactaccgaccttacctcgttggacgtatcgactagttcgacctaacttaccgagacaagaacgtacgaacgtacccgaccgggttccccttggttccgtcggttacctagttccgttagggtacgggaaccgaacccgaaaccccgtaaaaccggtccccggttacgggacctttcccgtaggagttacgtactttcgtccggtttacgcccgttaccgacggtccttaccgggaaggtaaccgaaccggtttcccggtaaccccgtttacccggtttcgtaaaccgtttacgtaccgggtaaaccggggtcgggggtaacccccgtagggggttaacggtaccgggttaacgttaacccgggtaacgtttaaccgttaaccgttttaacgttaaccgggtttttaaaccgtttaacccgtaaaccgtaaaccggttaacgggtaaacccctaagggtacctttaaaccggggtttactaaccccgttaaacggttccgggttttaaacgggggtttcggggtttaaccgggggttccggggttaaacgggggtacgtaacccggtttaggaaccccgtttagggtaacccggttcccccgggtttaaggtaaacccggggttacccgtaaccggggtacccccgggtaccggttaccccggttccccccgggttacccccgtttacccggtttaccccggttacccttttaccccggggtttccccccttcccccccgtttaaccccccgg

SEQ ID NO: 187389 - DNA, 770 bp, Homo sapiens
  misc_feature: GYAE6OF01DCLNU.4.47.E03.1.454.CMB.1.raw
  modified_base (266)..(266): a, c, t, g, unknown or other
  misc_feature (266)..(266): n is a, c, g, or t
tcagagcactgtagcacgaccggtgctcgatttagactcgcgcacagagaggaagggggtgggctcaggaggcagagctctgggaatctcaccatggcctggaccctctcctgcctccccctcctctactttctcgaccactacgtcctcgtggacgtccctactagtgagctagaccacgccgaccctaccgtcggtcgtacgacggtccgtacccgaacggaaccgaaaccggccaaggactacctaacccttactcgtagganacgtcgacgtattcgacctaactaccgagaacgaagaacgtaccgaacgaacccggtaccggtcccgttcgtttccgtacggtactacttcggttagggtaacggaaaccgaaacccgaaaccccggtaaaacccggttacccccggtaacccgggttacctacccgggtaggaacggtaacgtttaccttccgttacgtccgtaccgtaccgacggtaccgtaacgggaacgtacgtaacgtcccgtacccttactacgacctagaccggtagggtaccgggaccggtagggacggtaacgtactacgacgtacgtaactttacgttaacgtttacgtaccaactaacgagtaacgacgtaatacgtacgtaaccttaggtacggtagggttcgggtacggtgggacggtagacgtagacgtccgtacgtcccggagtaccgacgaccgaccgtcgtcccgtcccgcccggttactcctacttccgtcccccttcctaccccg

SEQ ID NO: 187390 - DNA, 767 bp, Homo sapiens
  misc_feature: GYAE6OF01AO5BU.4.47.E03.1.454.CMB.1.raw
tcagagcactgtagcacgaccggtgctcgatttagactcgcgcacagagagaagggggtgggctcaggaggcagagctctgggaatctcaccatggcctggaccctctcctgcctccccctctcactttctgcacagtctctgacggcctcctatgagctgacacacgcccacccgtcggtgtcacgtcgtaccccgaggaaccaaacgggccaaggactccaacctacctcgtaggagatcgactagttcgaccataccagacaagaacgtcgacgacccgacggtccccttgttccgtacggtcctacgtcgtaggtaggaactaacccgaacccgaaaccgtaccccggtaccgggtacctcccgtagacgtacgttaccttcgtcgtacggtccctaccgacggtaccgtacggaacgggaactaacggtccggtacccttacgttacgtacctacgtccggtacgggttaccggggacccgtaggggtacggtaacggtacgtacgtaaccgtcgtaacttaacgttagttacgttaccaacgtaacgtacgactacgtacgtagtacaacgttaagtcgtaaggggttcgggtacggttacgggacgggtaacggtacgtaccgtaacggttccgtaccggtaacccggttaccgtacgggtacccgtaccgtacccgggtaaaccgtcccggtaccccgtaccccggtttccggttaccgttacccggttttccccggtaccccgttccccgttaccccg

SEQ ID NO: 187391 - DNA, 807 bp, Homo sapiens
  misc_feature: GYAE6OF01AQHYB.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctctactttcctgcacagtctctgacgcctcctatgagctgacacacgcccacccgtcggtcgtcacgttcgtacccccgaaggaaccaaaaccgggccaacggtactacctacccttaccgttcgtagggaagtatcggacctatttcgaccctaagtaccgacgaccgtaaggtaaacgtccgaaccgacccgaccgggtccccctttgttccgttacggtctacttcgtaggtcggaacgaacccaacccgaaaccgtaccccggtccggtaaccttcccgagaacgtacggttactttcctcggtacggtccctaccgaacgtcccgtaacggaagggtacctaggtcccggacccttacgttacgtaactacggtaccggtaggggtaccgggacccgtaggggtggtaaggtacgtaccggttaaccgtccgttaaactttaacgttaagtttacgtaccgtaaccaaacggacgtaacgacgtactaacggtactacgttaacgtccggtaagggtttcggggtacggttacgggacgggtaacgttacgtacggtaacttccggtacggttaacccgtaccggttaccggaccgtacccggtaccggacccggtcccgtacccggtccccgttccgggtacctacccgttccccgttcccgttacccccttccccg

SEQ ID NO: 187392 - DNA, 712 bp, Homo sapiens
  misc_feature: GYAE6OF01EBDKL.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctctcactttctgcacagtctctgagcctcctatgagctgacacagccacccgtcggtgtcagtcgtccccaggacaaacggccaggactcaccgtacttcgtggagtattcggctagttccgacctaatacccagcaaggaagtaccgacaccgacggtccccttgttctacggtctatccgttggtcggaacgacctaaccgaaaccgtacccgtccgggactcccgtagagagtacttctcgtggtcctcgacgtccgtagacggtaacctaacggtccggtaccctaaccgttgtaaccttacgtaccgtaacgggttccgggacccggtaggggttcggaaggtacgtacgtaaccgtacggttaccttaacgttacgtttacgttaacctacgaaccgacgacgtacgactagtcgtaacttactacgtaagggttcgggtttagtccgggtacgggtaggtaactcggacgtacgtcggtaccgttaccggtacggtccgtaggtaccccggtaaggccccgttcccgtaccccggttccgttacccgtacccttttccgtaaccccgtttcccccgtaccccccg

SEQ ID NO: 187393 - DNA, 663 bp, Homo sapiens
  misc_feature: GYAE6OF01BXYH5.4.47.E03.1.454.CMB.1.raw
  modified_base (420)..(420): a, c, t, g, unknown or other
  misc_feature (420)..(420): n is a, c, g, or t
tcagagcactgtagcacgaccggtgctcgatttagactcgcgcacagagagaagggggtgggctcaggaggcagagctctgggaatctcaccatggcctggacccctctcctgctccccctctcactttctgcacagtctctgacgcctcctatgagctgacacagccaccctcggtgtcagtcgtccccaggacaaacggccaggactcacctactctggagatgcattgccataccagcagagtcagaccaggccctgttctggtcatctgtgacgacaccaaacgccccgtcgggactcccgtgagacgtattctcgtgcctccgagtctacgagggaacaagtcggacctaccttgaactatcgacggttcgggcccagggtggaagtactacggaaccctgtaaccttaacgttnttacgttaactaccaacgtagacagctaggtacacttaagtcgtaagggttgggggttacgttaccgggggacgggtaacggggtactacgggaaaggtcccgttaacggtaccccggttaccggttaacgggtacccgtaccgaaccccggtaaccgggtcccgttaccccgggcccccccggtttacgggttaccccaaccctttcccggtttccccgttaacccccccgttacccccccg

SEQ ID NO: 187394 - DNA, 960 bp, Homo sapiens
  misc_feature: GYAE6OF01DEFQG.4.47.E03.1.454.CMB.1.raw
tcagagcactgtagcacgaccggtgctcgatttagactcgcgcacagagaggaagggggtgggctcaggaggcagagctctgggaatctcaccatggcctggacccctctcctgcctccccctcctctactttctgcacagtctctgacggcctctatgagctgacacacgccaccctcggtgtcagtcgtcccaggaccaaacggccaggatccacctactcgtaggagatcgctagttgcccaatacccgagacaaggaaagtccgaagaacccgaacgggtcccccgttgtttccgttacgggtaccgtaattcgttggttacggaacggaaccgaaacccgtaaaaccggaacccccgtaccggggaccttaccccgtaggaagaacggtacttccgtccgtgggccttccgacgtccgtacgaaacggggactaaacgtcgggtaccctaaccgtttacgtaccgtttaacgtaccggtaacggggtaccgggggtacccccggtaaggggggtaacgggtaacggggtaacggtttaacgggtaaaccccgttacggttaaaccgttaaacccttttaaagtttaacgggttttaaccccttaaccgtaaaaccgggtaaaaccgttaaaccgaaacccgggtaccgtaaacgggttaccgttaaacccgtttaaaggttacccggtaaggggttttacgggggggtttaaccggggggttttaccgggggtaaccggggggaaacgggggttaacgttaaccggtaaacgggtacccggtttaacgggtaacccccgggtttaccggttaaacggggttaaccccgaaacccggggttaccccgaaacccggggttaaccccgttccccgggttaaccccccccgttacggggttaacccccttaacccgtttcccccgggttaaccggtttcccccccccggttaccccccg

SEQ ID NO: 187395 - DNA, 810 bp, Homo sapiens
  misc_feature: GYAE6OF01EOMR4.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgcctccccctctcactttctgcacagtctctgacggcctcctatgagctgacacacgcccaccctcggtgtcagtcgtccccgaggaaccaaacggccaggactccacctactcgtggacgatcgctattcgcctaataccgagacgaaggaacgtacacgaccgacggtcccctggttctcggtctatcgtggtacggaacgaccaacccgaaaccgtaccccggtaccgggtacttcccgaggacgtacgtacttccgtacgtcggtacctaccgacggtcctacggaagggtaacctaaacggtccgggtaccctaacccggttagtaacccgttacgtaccgggtaacggggttcccgggggacccggttaagggggtacgggaacgggttacgtaacccgggtaacccgtaacggtaaccctttaacgtttacgttttaaccggtttaacctaaccgaaacgtacgaaccgtacgacgtacggtagtaaccgttaagtccggtaaggggtttacgggggttcggttacgggggtacgggtaacggggtactaaccgggtaacgtacccggttaccgggtaacccggttccggttaacgggaacccggtaccggaaccccgggtaacgggtcccccgttaccccggccccccggtttacccggaccttaccccgttccggttacccccccg

SEQ ID NO: 187396 - DNA, 749 bp, Homo sapiens
  misc_feature: GYAE6OF01DHFDA.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagccaccctcggtgtcagtcgtccccaggacaacggccaggatcacctactcgtggagtatgactattcgaccataccagcagaacgtcagacccacgggccccttgttcgtcggtctagtcgtggtggaacgaaccaacccgaaaccgcccgtaccgggactcccgtagagagtacttccgtacgtcggtcctccgacgtccgtacggaacgggaacctaacggttccggaccctaaccgtttcgaccttacgtaccggtacggggttaccgggggacccggtagggggtacgggtaagggtacgttaccgggtaaaccgtacggtaacccgtttaaccgtttaacgtttacgtttaacctaaccgaaaccgaacggtaaccgacggtaccgttaaggtcgttaacgttaactcggtaggggttcgggggttacgggtttaccggggacggggtagggacgttacgaacggtccgtaaccggtcccgttacggtaccggtaccgaccggaccccggtaacggtcccgtacccggtcccccgttacggtccctaaccgttcccttcccgttccccctaccccg

SEQ ID NO: 187397 - DNA, 914 bp, Homo sapiens
  misc_feature: GYAE6OF01ERN1H.4.47.E03.1.454.CMB.1.raw
tcagagcactgtagcacgaccggtgctcgatttagactcgcgcacagagagaagggggtgggctcaggaggcagagctcgtgggaatctcaccatggcctcggacccctctccctgcccttccccctcctctacttttctgcacagtctctgacgccctcctatgagctagacaccgacgcccacccgtcggttgtacacggtccgtacccgaaggaaccgaaaccggccgaaggtactcctaaccttaccgttcgagggaacgtacgtcgtacctaatttccggaccttaacctaacccgagtaacgaagtaaacgtcgaaccgtaaccgtcccggtccccttggtttcctgggttcctagtcggttagtacgggaccgaacccaaccgtaacccggacccggtaccggtacctccgtagagtactactttcgtccgtacgccgtacgacgtaccgtacggaacgggttaacgaccggtacggacccttaacggtacgtaaaccgtcgtacggggttacggggtccggggtaaccgtaagggggtagaacggttacgtaaacccggaacggtttaccgtaaacgtttaaccgtttaacgtttaaacggtttaacccaccggaaaaacggttcgaaccgttaggtaccggtttaagaccgtttaaacgttaaccggttaagggttccggggtttacgggggttaaccgggttccgggggaaacggggaacggttttaaccggtaaacgggcctttaacccggggtaccggttaaccccgtttcggggaaacccgtcccgaaacccgggttcggtaaaaccccggggcccgttttcccccccgggaccccgggtttaactcccccggtttaaactttccccccggtttaacccggttaccccccccttaccccgg

SEQ ID NO: 187398 - DNA, 796 bp, Homo sapiens
  misc_feature: GYAE6OF01C0NIH.4.47.E03.1.454.CMB.1.raw
tcagagcactgtagcacgaccggtgctcgatttagactcgcgcacagagagaagggggtgggctcaggaggcagagctctgggaatctcaccatggcctggaccctctcctgcctcccctcctcactttctgcacacgtctctgacgcctcctatgagctgacacacgccaccctcggtgtcacgtcgtaccccgaggacaaccggccaggactccaccgtacctcgtacggaggtacttcgactagtttcggacctactaccgaaggaccaaggaacgttcgaacgacccgaacggtccccttgtttacgtcgggtactagttccggtcggtacgggaaaccaacccgtaacccgaaaaccgggtcccccggttaccggggtaacccttccccggttaaggacgggtaaccgttacctttccctccgggtttaacgggcccttaacccgaggttccctacgggtaacggggaaccttaaacgggttcccggaccccttaacgtttacgaacccgtttagttaaccggtacgggtccggggaacccgtggggtacgggaacggtacgtaacggtaacctacggtacttacgttaacgttacgttaccgtacaacgacgtacgacggagttacgtacgtctaacggtacgtacggtaggggttacggttcggggaacgggtacgggacgttacggaaacgtccggtaaccggtccgtaacgtaacggtccggacgtaccggacggtaccgtccggtcccccgtcgtaccgtccctacgttcccgtccccgtaccccg

SEQ ID NO: 187399 - DNA, 721 bp, Homo sapiens
  misc_feature: GYAE6OF01EBO05.4.47.E03.1.454.CMB.1.raw
  modified_base (187)..(187): a, c, t, g, unknown or other
  misc_feature (187)..(187): n is a, c, g, or t
tcagagcactgtagcacgaccggtgctcgatttagactcgcgcacagagaggaagggggtgggctcaggaggcagagctctgggaatctcaccatggcctggacccctctcctgcctccccctctctactttctgcacagttctcgtgacggtcctacctatgagctgacacacgcccaccgtggtntcagtcgtacccgaggaacaaacggccaggactaccacctactcgtggagatgactattcgaccactaaccagactaagaacgtccaacgaccgtaccgtcccttagttccgtcggtactacgtcgttaggacgaacgaaccctaacccggaaacccgtcccggtaccggacttccgagtaagtacgttacttcgtcgtcggtcctacggacgtccgtacggaacgggtacaacgtccggtaccttacgttagaaccttggtacggtacgggtaccgggaccggagggtacggacgtacgtaacgtaacgttacgtaacgtttaacgtagttttaacggtaacccttaacgaaaaccgtacgtacgtaacgtaccgtagttacgtaaccgtaaagttcggtaacggggttgggtacggttacgggaggaggacctaggacgtccgtacgtcccggttagacggtaccgtacggtacccgaggcccgttaccgaccccgtttcgaactcccgttccgttcccctccccgtacccg

SEQ ID NO: 187400 - DNA, 718 bp, Homo sapiens
  misc_feature: GYAE6OF01C1YC2.4.47.E03.1.454.CMB.1.raw
tcagagcactgtagcacgaccggtgctcgatttagactcgcgcacagagagaagggggtggctcaggaggcagagctctgggaatctcaccatggcctggaccctctcctgcctccccctctctactttctgcacagtctctgacgcctactatgagctgacacagcccacccgtcggtgtacagtccgtaccccaaggaaccaaaccggccaaggactccaaccttactcgaggagactgactattcgacctaataccagacaagaacgtcacgaacacggtccctgttcgtgtcatcgtagtaggacgaacaccgaaacgacccgtacgggactcccgagagagtacttctacgtgtactaccgagtaccgagaacggactaagtacggaccctaaccgttagaccttaacgttcgaacgggttaccggggaccgtaaggggtggaacgtagttaacgtaacttacggaacttaacgttaagtttcgttaaactaccgaaacgacggtaaccaagtccgtaagtacgtacgttaaacgttcgtaacggggtttacgggtaggttacccgggaaggggtacgtagtaaccggaactccggttaaaccggcccgtttaacgacgggtaaccgaacccggtacccgtaaacgggcccttaccccgggacccccgttacggtaaccctaccgttaccccgttaccgttcccccctaaccg

SEQ ID NO: 187401 - DNA, 780 bp, Homo sapiens
  misc_feature: GYAE6OF01B567F.4.47.E03.1.454.CMB.1.raw
  modified_base (185)..(185): a, c, t, g, unknown or other
  misc_feature (185)..(185): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
tcagagcactgtagcacgaccggtgctcgatttagactcgcgcacagagaggaagggggtgggctcaggaggcagagctctgggaatctcaccatggcctggacccctctcctgcctccccctcctcactttctgcacagtctctgacggcctcctatgagctgacacacgcccacccgtcggtntcagtccgtaccccaggaaccaaacggccaggactaccacctactcgtagganatgctnttcgacctataccagcaagaagtcacgaccgacggccctgttcgtggtcctatccgtggtaggacaaccgaacccaaaccggccccgtaccgggactcccgtaggaagtagtacgtttccgtcgttcggtccctaccgtgtacccgtacggaacggggtaaacctaacgtccggaacccttaccgtacgttaaaccgtacgttaaccggacgggggtccggggtaaccccgggtaggggttacgggaacgggttacgtaaccggtaacccgttacgtaaacccgttaacgtttaacgtttacgttaacctaccgtaaacgtacgaacgtaacggctaacgtacgtaaccttaacgtacggtacgggtttggggttacggggttacgggacggggttaagggtacgtacgtaacggtaccgtacgggtacccgtaccggttacgggacccgacggtacccggtaacggtccccgtacccggtcccccggttcggtacccttacccttcccgggtttacccgtcccccgttacccccg

SEQ ID NO: 187402 - DNA, 654 bp, Homo sapiens
  misc_feature: GYAE6OF01BFJCY.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatccacctactctggagatgctattcgccataccagcaagaacgtcacgaccacggccccttgttctggtcatctggtgagacaccgaaacgcccgtccgggactcccgtagagagtattccgtcgtggcctccaggtcctacggaaggaacgtaacgtccggaccctaccgttacgaccttaacgtcgtaaggtccgggggaccccgaggggttcggaacggtagtacgaaccgtcgtaacttacttagtttacgtttaacctaccgaacgtaaccggacgaacgtccgaaggttctaacgttaacgtacgtacgggttggggttcgggttacgggacgggtaggacgtagaacgtcggtacgtacccgtcgtacggtccgacgacccggtaaggccgtacccgcccccgttcggaccctaccgttccctccgttcccctcccccg

SEQ ID NO: 187403 - DNA, 749 bp, Homo sapiens
  misc_feature: GYAE6OF01C7UV2.4.47.E03.1.454.CMB.1.raw
  modified_base (131)..(131): a, c, t, g, unknown or other
  misc_feature (131)..(131): n is a, c, g, or t
  modified_base (177)..(177): a, c, t, g, unknown or other
  misc_feature (177)..(177): n is a, c, g, or t
  modified_base (208)..(208): a, c, t, g, unknown or other
  misc_feature (208)..(208): n is a, c, g, or t
tcagagcactgtagcacgaccggtgctcgatttagactcgcgcacagagagaagggggtggctcaggaggcagagctctgggaatctcaccatggcctggacccctctcctgcctccccctctcactttcngcacagtctctgacgcctctatgagctgacacacgccaccctggtntcacgtcgaccccaggaccaacggccagacnccacctatcgaggagatcgactacgttgacctaacaccgagactaagaaccgtcgaacgtacccgacggtcccttagttcgtcggtacctagtcgttacggacggaaacaaaccgaccctaaaaccggccccggttacggaccttaccgagtacgtacggtacttccgtaggcgcctacagtcacgaggtacagtcacgtaccttagacttagacggttaagggcccgggtaagtagggtaggaaggtaccggtaacgtaaccggtactaacccgtttaacgttaacgtttaacgttaacccgttacaaccggttaacgaaccgtaggaccttaacggtacgttaacctaacgttaccgttagggttcggggtttacggttacgggtaaccgggacggtaacgtagaaccggttacggtaacggttcccgtaacttaccgggaccgtaacccggtaccgtacgggtaccccgtcccgttaaccccggttaccgtaacccggttccctttaaccccgttcccggttccccttaaacccccgg

SEQ ID NO: 187404 - DNA, 734 bp, Homo sapiens
  misc_feature: GYAE6OF01CJG6H.4.47.E03.1.454.CMB.1.raw
  modified_base (406)..(406): a, c, t, g, unknown or other
  misc_feature (406)..(406): n is a, c, g, or t
tcagagcactgtagcacgaccggtgctcgatttagactcgcgcacagagagaagggggtgggctcaggaggcagagctctgggaatcctcaccatggcctggacccctctcctgcctccccctcctcactttctgcacagtctctgacggcctctagtgagctgaccacacgccctacccgtcggtgtcacgtcgtccccaggaccaaacggcaggactcaccgtactcgtaggacgtagtcgactagttcgacctaacttaacccgagaccgtaagaaacgtacgaaccggtaccgaaccggtccccttaggttcgtcgtactgtctggtagacgaccgaacccaaaccggtcccgtaccgggtaactcccgtaagacgtaacgtactcctcgtcggcctaccgngtccgtaacggaggactaacggtcggtacctaacgttgaaccttacggtaggtaccgggtcggtaccgaagggtaggacggtacgtaacgtaccgtacgtaccgttaagttcgttacgttaccgtaacgtaaccgaacgtaacgtacgacgtacggtacttaacgtaacgtcgttaacgggttcgggttacgggtcggtacgggtaacgtacgtaccgtacgtacggtacccggtaaccgtcggtaaccgtccgaccggtacccgtacggtcccgtacccggtccccgtacgtccgtacccttcccgtccccgttaccccgtaccccg

SEQ ID NO: 187405 - DNA, 686 bp, Homo sapiens
  misc_feature: GYAE6OF01CRL1R.4.47.E03.1.454.CMB.1.raw
  modified_base (133)..(133): a, c, t, g, unknown or other
  misc_feature (133)..(133): n is a, c, g, or t
  modified_base (392)..(392): a, c, t, g, unknown or other
  misc_feature (392)..(392): n is a, c, g, or t
  modified_base (534)..(534): a, c, t, g, unknown or other
  misc_feature (534)..(534): n is a, c, g, or t
  modified_base (555)..(555): a, c, t, g, unknown or other
  misc_feature (555)..(555): n is a, c, g, or t
tcagagcactgtagcacgaccggtgctcgatttagactcgcgcacagagaggaagggggtgggctcaggaggcagagctctgggaatctcaccatggcctggacccctctcctgcctcccctcctcactttcngcacagtctctgaggcctctatgacgctgacacacgcccacccgtggtgtcagtccgtacccgaaggaaccaaaccggccaggactcctaacctactcgtaggagatcgctacgttcgaccataccgagacaagaagtaccacgaaccgtacggtcccttgttcgtacggtctagttcgtgtacggaacgtaaccaaccgaaacccgcccgtaccgggacctaccggtagaacgtcgtacttccgtcgcggtctaccgnaccgtcgaacggggaacacgtccggacctaacgttcgtaacttagccggtacggggtaccggggacccgtaggggtacgggaagtaacgtaacgaaccgttaacggtaacttaacgtttaagttaccgtataacaaacgtanacgagtcaagttacactagtntgggtaggttcgggtcggacggagacgtacacgtccgtacgttaaccgtcggtacgtaccgcccggtaccggacgccgttcccccggacccgttacgtccctaaccgttcccttcccggtccccttacccg

SEQ ID NO: 187406 - DNA, 820 bp, Homo sapiens
  misc_feature: GYAE6OF01CW3FG.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacacgcccacccgtcggtgtcagtccgtccccgaggaaccgaaaccggccgaaggactaccaacctacttcgtggacgatcgctagttcgaccctaactacccgaagaccgaaggaacgtaccgaccggaacccgtaccggtcccccttggtttccgtcggtactacgttcgtaggtacggaccgaaacctaaccccgaaaaccggtcccccgtaccggacctcccgtaggtaacgtacgttaccgttcctaccggtcgtacccgtaccgtacgtacccgttaaccggggaaacgggtaacctaccgggtaccggtaccccgttaaccgtttaaccgtaacctttacggtaccgggtacggggtcccggggtacccgtaagggggtcgggaacggtacgtaaccgggtaacctacgtacctttaacgttacttaacgttacctacgaacgtacgaccgtagacgtagtacacgttaagtccggtcgggttagggttccgggtcgggacggtacggtaccgtacggagtacccgtcggtacccgttacggtaacccggtaccgtacccggaacccggtcggttacccccgtccccgtcccccggttacgttaacccgttcccgttaacccgttccccgtaacccccttaacccccgg

SEQ ID NO: 187407 - DNA, 747 bp, Homo sapiens
  misc_feature: GYAE6OF01E2NE2.4.47.E03.1.454.CMB.1.raw
  modified_base (250)..(250): a, c, t, g, unknown or other
  misc_feature (250)..(250): n is a, c, g, or t
tcagagcactgtagcacgaccggtgctcgatttagactcgcgcacagagaggaagggggtgggctcaggaggcagagctctgggaatctcaccatcggcctcggacccctctcctcgcctccccctcctctactttctgcactacgtctctgacggtccctcctagtgagtctcgacacgacgcccacccgtcggtcgtcgacgtccgtacccgaggaaccgaaccggccgaggactcctacctactcgnggagagtcgctattccgacaactacgagacgaacgacgacgacgtaccgtccgtccgttgttcgtcgtacgtacgtcggtacggtacggaaccgtaacccgaacccggtaacccggtacccggtacccggtaccgtaccggtaggaacgttacgtaccgtttccgtccgtccggtcctaccgtacgtacgtacgacggtactacgtccgtactacgttacgtacgtacgtcggtacgggtccggtacggtagggtacgacggtacgtaccgtacgtacgttacttacgttaacgtaccgtaacgactaagacgacgacgtagtactacgtacgtacggtggtacgggtacgggtcgggtacgggacggtacgtaacgtacggtacggtacgttaccggtaccgtacggtaccggaccggtacccggtaccgtcccggtccccgtacccgtcccgttaccgtacccttcccgttccccgttacccctcccgttacccg

SEQ ID NO: 187408 - DNA, 927 bp, Homo sapiens
  misc_feature: GYAE6OF01EJV0V.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctcccctcctcactttctgcacagtctctgaggcctcctatgagctgacacacgccaccctcggtgtcagtcgtccccaggacaaacggccaggatccacctactcgtggagatcgctattcgccaataccgagacaagaaacgttccgaacggaaccgtaccggtacccccttggtttaccgtcggttacctacttccgttagggtacgggaacggtaaccccgaaacccgaaaaccccgggtacccccggttacccggggaaccttcccccgtagggaacgtacgttaacttcccgttacgtccggacccttaccgaacggtcccgttaaccggaacgggtaacctaaacgttccgggacccttaaccgtttacgaaccttaccgtacggtaacggggtccggggtaccccggtaaggggttacgggaacgggtaacgttaacgggtaacccgttacgggttaaaccctttaacgtttaacgttttacgggttaaacccttaaccgaaaaccgtacggaaacccgtaggaccgtaaggtttaccgtaaacctttaaacggtccgttaagggggttacggggggtttaccggggttaccgggggtaacgggggtaacggggttaaccgtaaccgggtaaccggttcccggttaaccggttaccccgggttaccgttaaccggggtacccggtaacccggtaacccccggaacgggttaccccgtcccccgggttacccccccggtttaccgggtacccccgttaacccgttttcccccggtttaccccgttccccccccgtttaaccccccg

SEQ ID NO: 187409 - DNA, 781 bp, Homo sapiens
  misc_feature: GYAE6OF01BFPVA.4.47.E03.1.454.CMB.1.raw
tcagagcactgtagcacgaccggtgctcgatttagactcgcgcacgagagaggaaggggggtgggctcaggaggcagagctctgggaatctcaccatggcctggacccctctcctgcctccccctcctcactttctgcacagtctctgacggccctcctatgagctgacacagcccacccgtcggtgtcagtcgtccccgaggaccaacggccaggactccaacctactcgtaggagatgctattcgaccataccagactagaacgtacacgacccgacggccccttgttccgtcggtacatcgttggtaggaacgaacctaacccgaaaccggtccccgtaccggggacctcccgtaggacgtacgtactttccgtcgttaggcccttccgacgtccgtacgaacgggactacgtacggaccccttacgttacgtaccgttataccggtacgggttcccggggggacccgtaagggggttacggggaagggtacgttaaccgggaaaccttacgggttaaaccgtttaaccgtttaaggttttacgtttaaaccctagtaaaccgtaaggaacacggtaactagggtacctaacttagtacgtacggggttacgggggttgggttaccgggggacgggtacgggtataccggtaacggtcggtaaccggttacccggtacggttacgggtaccgtaccgggacccggtacgggtacccctcccgggtcccccgttcgggtacccttaccccttcccggttccccgtccccgttacccccg

SEQ ID NO: 187410 - DNA, 725 bp, Homo sapiens
  misc_feature: GYAE6OF01CI6UA.4.47.E03.1.454.CMB.1.raw
  modified_base (237)..(237): a, c, t, g, unknown or other
  misc_feature (237)..(237): n is a, c, g, or t
  modified_base (503)..(503): a, c, t, g, unknown or other
  misc_feature (503)..(503): n is a, c, g, or t
tcagagcactgtagcacgaccggtgctcgatttagactcgcgcacagagagaagggggtgggctcaggaggcagagctctgggaatctcaccatggcctggacccctctccctgctccccctcctcactttctgcacagtctctgaggcctcctatgagctgacacagcccacccgtcggtgtcagtcgtacccccaggaaccaaacggcctaaggactacacccgtactcgtgganagtgctattgccataccagcaagaagtcacgaccacggtccctgttctcggtcatcgtagtggacgaaccaaccgaaaccggacccgtaccggacttcccgtaggacgagtaactttcctcgtacggtccttaccgagtccgtacgagggaactaagtccggaccctaacgttcggaacttacgtacgagggttccggggacccgtagggtagggtaacgtagtacggactaacgtacttaacgttatttacgtactaccgaaacnggaacctgacgtagacggtactaacgtacgtaacgggtcgggtacggggtttacgggtacggggacgggtaacgtaccgtaacggtaccgttacggtaccccggttaccggttaacgggaccgtaaccggaccccggtaaacggtacccgttcccggaacccccccgtttccggaacccttacccgtttcccggtttccccgttaaccccccttacccccgg

SEQ ID NO: 187411 - DNA, 706 bp, Homo sapiens
  misc_feature: GYAE6OF01BYBRO.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgagcctcctatgagctgacacacgccacccgtcggtgtcacgtcgtaccccaggaacaaaccggccaggactccacctactcgtaggagatgactagttcgaccataccagacagaacgtcacgaccacggtccctgttcgtggtctactcgtggtacggacgtaaccaacccgtaaacccgacccgtaccgggactcccgtagaacgtagtacttctccgtcgcctccgacgcgtacggaacggaacacgtccggacccttacgtacgtacttagtccggtacggggtcccgggccgtaaggggttacgggacgtacgttaccgaaccgttacgtaaccttaacgttacgtttacgttaaccctaactaacgaacgaacgtacgtactaggtactaccttaagtccgtaggggttcgggttacggtcgggacgggtacgtacgtacgtacgtcgtaccggtaccgttaccgtacgggtcctaccggacccggtccgtcccgtacccccgtcccgtaccggttacctacccgttaccccgttcccgttaccccctacccccg

SEQ ID NO: 187412 - DNA, 728 bp, Homo sapiens
  misc_feature: GYAE6OF01D40WM.4.47.E03.1.454.CMB.1.raw
  modified_base (610)..(610): a, c, t, g, unknown or other
  misc_feature (610)..(610): n is a, c, g, or t
tcagagcactgtagcacgaccggtgctcgatttagactcgcgcacagagagaagggggtgggctcaggaggcagagctctgggaatctcaccatggcctggacccctcttcctgcctccccctctctactttctgcacagtctctgacggcctcctatgagctgacacacgcccacccgtggtgtcagtcctcccaggacaaaccggccaggactccaccgtactctaggagatcgactagttcgacctaagaacctaatacgtcgtactttacgtacgtaaccacgacgaacgaacgaccgacggacccgacggtacccccgtggtttggtttacggtttagtttaacgttaaagtaaaacggtacgtaggtaggtaacggaccggtcccgtaacggaacgggtaccgtacccgtacggacgtaccgtacgtttccgtacggttcggtccctaccgtaacggtaccgttacggaaccgggtaaacctaacggtacggttaccgttaacggttaacggaaccctaagttccgtaagggtacggtacgttaaccgaggacgaaaggaacggacggagtactacgtacttacgttacgtagtactaacgtanagacgagacgaggtacggtaggtaaccttaagtaacggtcgggtacggacgggaacggtaaccgaggtcgtacgtaccgtaccgtacggacaacggacccgtacggtcctaccccggg

SEQ ID NO: 187413 - DNA, 791 bp, Homo sapiens
  misc_feature: GYAE6OF01A8MQK.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctctactttctgcacagtctctggacggcctctatgagctgacacacgccctaccgtcggtgtcagtccgtacccgaggaacaaacggccaggactccacctactcgtggagatgactattcgacctactaccgagacctaagaacgtacgaacgaccgtaccgtccccgttggttaccgtcggtactcttacgtggtagggaacgaacccaacccgaaaacccgtcccggtaccgggtacctacccggtaggacggtagttacttcgttccgtcggtcctccgacgcctacgggaacggactaacggtcggaccctacttcgaacgttacgtacggtacgggtccggggtaccgtaggggtacgggaaggttacctaacgggtaccttaacggttacttaacgttagttacgtttaaccgactaaaggacgtaacgacgtacgtaacggtagtaaccttacggtcgttacggggtttacgggggtcgggtttaccggggacggggtaaggttaccgacggttaacggggtcctaacccgggtccggttaaccggttaccgggacgtacccgggtaacccgtaccgggttcccctccccgggtacccccggtttacggttccctacccggttttaccccttccccgggttaaccccccttaccccggg

SEQ ID NO: 187414 - DNA, 718 bp, Homo sapiens
  misc_feature: GYAE6OF01ERYFM.4.47.E03.1.454.CMB.1.raw
  modified_base (166)..(166): a, c, t, g, unknown or other
  misc_feature (166)..(166): n is a, c, g, or t
  modified_base (406)..(406): a, c, t, g, unknown or other
  misc_feature (406)..(406): n is a, c, g, or t
tcagagcactgtagcacgaccggtgctcgatttagactcgcgcacagagagaagggggtgggctcaggaggcagagctctgggaatctcaccatggcctggaccctctcctgcctccccctcctcactttctgcacagtctctgaggcctcctatgagctgacacncgaccctacccgtcggtgtcagtccgtaccccgaaggaaccgaaaccggccgaaggactccaccgttactcgtggaagtagtcgctagttcgaccctaataccgagacaagacgtacaacgacccgacggtccccttagttccgtacggtactacgtcgtaggtacggaacgaacccgaaacccgaaaccggtccccggtaccgggtacctccgtagacgtagtacttctacgtcgtccncgactaccgtacggaacgaactacgcgtaccctacgttacgactacgtacggacgggtccgggaccgtggggtaggtaccggtacgaacgtacgtacgttaacgtactttaattaaccgttacaacgtacacgacgtacgtacgtacgtacttagtaagtcggtagggttgggtcgggtacgggtaagggtacgtaacggtactacgggtccggttaaccgacccggttagtaaccggtcgaccggtacccggaggttccccacccggtcccgtaccgtccttacgtccccgtttcccgcccccttaacccg

SEQ ID NO: 187415 - DNA, 858 bp, Homo sapiens
  misc_feature: GYAE6OF01ETJKN.4.47.E03.1.454.CMB.1.raw
tcagagcactgtagcacgaccggtgctcgatttagactcgcgcacagagagaaggggctgtgggctcaggaggcagagctctgggaatctcaccatcggcctcggaccccctctcctgcctccccctctctactttctcgcacagttctcgtgacggtcccttacctagtgacgtctacgaccactacgccctacccgttcggtcgtcgacgttccgtacccgaaggaaccaaaccggcgaaggtactcctaaccttaccgtgtaggacgtatagaccgttagttaccgacctaaccgtaacccgaggtacctaaaagggtaaccgtaccgaaacccgtaaccccgggtccggttcccccgtttaggttttaccggtacgggttacctacgttttcgtaggggtaccggaaaacccgaaacccgtaaccccgtaaaacccggccccggtacgggtacctcccgtaggtaacgtactttacgtcctccggtaggtcccaccgtacgtacgtacggacgtaacgtaggtcccgacttacgtaactacgttacgtaaccgggcgggtaccggggtccggtaagggtacggtacggtaacgttaccggtaacccgttaagtaaccgttaactttaaccgttacgtttaaccgtaacctaacgaggtaaccgtactaacgtagtaaccgtaagttaacgtccgggttagggttcggggttacggtacgggaacgggtacggtagtaccggtaaccgttcgtacccggtacccggtttacgacccgggtaccgtaccggaccccggtagttccccggttaccccggtcccgttaacccgccggtttacctccccggttaccccc

SEQ ID NO: 187416 - DNA, 737 bp, Homo sapiens
  misc_feature: GYAE6OF01ERYZN.4.47.E03.1.454.CMB.1.raw
  modified_base (184)..(184): a, c, t, g, unknown or other
  misc_feature (184)..(184): n is a, c, g, or t
  modified_base (585)..(585): a, c, t, g, unknown or other
  misc_feature (585)..(585): n is a, c, g, or t
tcagagcactgtagcacgaccggtgctcgatttagactcgcgcacagagagaagggggtgggctcaggaggcagagctctgggaatctcaccatggcctcggacccctctcctgcctccccctcctcactttctgcacagtctctgacggcctcctatgagctgacacacgcccacccgtggtntcagtcgtccccgaggacaaccggccaggactccacctactctggagatgctattcgaccaactaccagacaagtaacgtccgaacgacccacggtccccttgttcgtcggtctacgtcgtggtaggaacgacccaaacccgaaacccggccccgtaccgggacctcccgtagacgtagtacttcgtcgtcggcctcgacgcctacggaacggactaaggtccggacctacgttagaacctacgtccggacgggtccggggaccgtagggggtaggtaacgtacgtacgtaaccgtcgttaaccgtatttacgttagttaaccaacgtaaccgagtaaccgacgtaccgtaggtacgtacttaacggtcgtaagggggttcggggttacgggttaacgggngggttaacgggtacctaacggtacgtccgttaccggtccggttaaccgtacggtacccgtaacccgggacccgacgggttccccgtaccccggtaccccggttccggttaccctaccggtttccccgtttccccggtcccccgttacccccg

SEQ ID NO: 187417 - DNA, 788 bp, Homo sapiens
  misc_feature: GYAE6OF01B2HZ5.4.47.E03.1.454.CMB.1.raw
  modified_base (137)..(137): a, c, t, g, unknown or other
  misc_feature (137)..(137): n is a, c, g, or t
  modified_base (164)..(164): a, c, t, g, unknown or other
  misc_feature (164)..(164): n is a, c, g, or t
  modified_base (172)..(172): a, c, t, g, unknown or other
  misc_feature (172)..(172): n is a, c, g, or t
  modified_base (187)..(187): a, c, t, g, unknown or other
  misc_feature (187)..(187): n is a, c, g, or t
  modified_base (234)..(234): a, c, t, g, unknown or other
  misc_feature (234)..(234): n is a, c, g, or t
  modified_base (256)..(256): a, c, t, g, unknown or other
  misc_feature (256)..(256): n is a, c, g, or t
tcagagcactgtagcacgaccggtgctcgatttagactcgcgcacagagagaagggggctgtgggctcaggaggcagagctctgggaatctcaccatggcctcggacccctctcctgcctccccctctctactttcngcacagtctcgtgacgtcctctatganctgacacncgcccaccgtggtcncagtccgacccgagacaacggccaggactaccacctactgtaggaantgctagtccgaccactaaccgngacgtagaacgtaccgacgacccgaccggtcccttagttcgtgtctacgtgtggaacgaccgaaccaaacccggaccgtacccggtcggaccttaccgagtaagcttacttccggtacgtccgtctaccgcgtacgttaacccggaggtaaacccgtacgtacccggaccccgttacttaaccgtacctttaccgggtaaccgggtacggggtacccggggtaccgggtaacggggttaacggtaacgggaaccgttaacgggtaaccgtaccgtttaattaccggtttaatttaccgttactaaccaaagttacccacgttacgaacggttaacgtacgtaacgttaagtacggtaccggggttggggtttccggtaacggggacgggttaggtccgtaaaccgcggttacggtaacccggttaccgggtacccggttaaggccccggtaccgacccgggttaccctacccccgggtccgtttcccccccggggaaccttttacccgcccccgttttccggtacccccccc

SEQ ID NO: 187418 - DNA, 852 bp, Homo sapiens
  misc_feature: GYAE6OF01ASSDY.4.47.E03.1.454.CMB.1.raw
  modified_base (240)..(240): a, c, t, g, unknown or other
  misc_feature (240)..(240): n is a, c, g, or t
tcagagcactgtagcacgaccggtgctcgatttagactcgcgcacagagaggaagggggtgggctcaggaggcagagctctgggaatctcaccatcggcctggacccctctcctgcctccccctctcactttctgcacagtctctgacggcccttcctagtggagtctgacacacgcccacccgtcggtgtcacggtcctccccgaggaacaacggccagactccacgtactcgtagganactcggactacgttcgacctaacgttaaccgaggtaccgaacggaacgttaccgaaccggaacccgtaccgggttcccccttaggtttaccgttaccgggttactacgttccgtacggttacgggaaccgaacccgaaaccccggtaaaacccggtccccggttaaccgggtacccttacccggtaagggaccgtaagttacctttcccgttccgtaccggtacccttaccgacggtacgtaccgggaacggtaaccgtacggtaccggtacccttaccggttacggtaactacggtacggtaccgggtccgggtaccgtaggggtacggacgttagtaccgtaccgttacgtaactttacgttacgttaacgttacccgaagtaaccgtaacgtaccgaaggtcctaaggtttcggaacgtaacttgggttacgggttagggtcgggttacggacggggtaggtacctacggtaacgttccgtacccggtaaccgttaccgggttcgaacccgggtaccgtacccggtaacccggtacccgttcccccggaaacccgggtttctaaccccgtttaccgttacccgttttccccgtaacccccggttacccc

SEQ ID NO: 187419 - DNA, 766 bp, Homo sapiens
  misc_feature: GYAE6OF01BL6NY.4.47.E03.1.454.CMB.1.raw
  modified_base (248)..(248): a, c, t, g, unknown or other
  misc_feature (248)..(248): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgacggcctcctatgagctgacacagcccacccgtcggtgtcagtcgtccccaggacaaacggccaggactcacctactctggagatgctattcgccataccganactaagaagtcaacgaccgacggtcccttgttctggtctatctggtaggacgaaccaacccgaaaacccggtccccgtacccgggactcccgtaggtaacgtaacggtactttcctaccggttcgggtcccttacccgaaggtccctaccggaacggggtaaacctaacggtcccgggtaccctaccgtttacggaaccttacgtaccggtaacggggttcccgggggaccccgtaggggggtacggtaacgggtacgttaaccggtaaccgttacggtaaacttaaccgtttagtttacggttaaccctaacgaaacgtaacgacgtacgacgtaggtactacgtaactacggtagggttcggggttagggttcgggacgggtaaggtacgtacggaagtccggtacgtacccggttcgttaccggaccgtaaccggacccgtaaccgggtcccgtaccggtaccccccgttcgggttaaccctcccgtttccctttccccgtaccccctacccccg

SEQ ID NO: 187420 - DNA, 1043 bp, Homo sapiens
  misc_feature: GYAE6OF01BSTM5.4.47.E03.1.454.CMB.1.raw
tcagagcactgtagcacgaccggtgctcgatttagactcgcgcacagagaggaagggggtgggctcaggaggcagagctcgtgggaatctcaccatcggcctggacccctcttcctgccttccccctctctactttctgcctacagttcctcgtaggacggcccttcctagtaggacgtcctaggaaccaacgaccgacccctaacccgttcgggttctccgtaacggttccgtaccccgaagggtaaaccgaaaccggcctaagggtactccgtaaaccctacttcggtaggggaactagttacggacctagtttccgacccaacgttaacccgaacggtaacgtaaggtaacgtaaccggaaacccgtacccggtaaccggttccccccgtttaggtttccgttacgggttaccctaacggtttcggtacgggttaacggaaccggtaaacccgaaccccgtaaaaaccccgggttcccccggttaaccgggtaaccgtttaccccggaagggactttaaaccgggtaccgttttcccgttaccgtcgggtaccctaaccctcgggtaaccctttaacgggaaacggggtaaaccctaacgtacccgggttaaacccctttaacgggttaaccggttaaaccgtacccgttaggggttaacccgggtaaccccggggggtacccgggttaaggggtttaacggggaacggtttaacgaaaccgggttacccgttaacggttaaccgttaaacgttttaccggttttaaacgttaaccctacgtaaaaccggtaacgtacgtaacgacggttaaggtacctaacgttaacgttccggttaaggggttcgggtttaaccgggttccgggggaaacggtacgggtaaccgtaacggtaaccgggtaccgttacggtttaaaccggaccgtttaaccgggaaccgttacccgggaacgttacccggtaccccgtcccggttaaccccggtcccgggtttaaaccgtcccgtttaaaccgtttcccccgtaacccccggttacccc

SEQ ID NO: 187421 - DNA, 820 bp, Homo sapiens
  misc_feature: GYAE6OF01CBRPL.4.47.E03.1.454.CMB.1.raw
  modified_base (142)..(142): a, c, t, g, unknown or other
  misc_feature (142)..(142): n is a, c, g, or t
  modified_base (502)..(502): a, c, t, g, unknown or other
  misc_feature (502)..(502): n is a, c, g, or t
  modified_base (639)..(639): a, c, t, g, unknown or other
  misc_feature (639)..(639): n is a, c, g, or t
tcagagcactgtagcacgaccggtgctcgatttagactcgcgcacagagaggaagggggctggtgggctcaggaggcagagctctgggaatctcaccagtggcctcggacccctctcctcgccctccccctctctactttcngcacagtctgtaggacggtcctactagtgacgctagaaccaccaacgcccctacccgtcgggtgtaccgtacggttccgacccccgaaagggaaccgaaaacccggcctaaaggactacccgaccttaaccgtgagggaagacgttcgactacgttcggaccctaacgaaccgaacgacgaaaaggttaagaccgaacggacccggtaccggttcccccgttaggttccggtacggttactcgttaccggtaggaacgggaaaccaaccccgaaaaccccgaaaacccggtccccggtaacccgggtaacctacccgggtaagacggtaacttaccgttcgtacgtcgacccaccggtanaccggtaacgaacggacgaacgttccggacttaaccgttacgaattaccggcggtacgggtaccggggacgtaaggggtaggacggacgtacgtaccgtaacgttaactacgtttataacgtaaccacgtaaacganaacggacgtaacgtagtacaacgttaacgtacggttaggggtcgggttacggtacggggagggtaacgaacgtaccggacgtcggtaacccggaccgttacggaccgacgtacccgaaccggttaccggtccccgaccccggtccccgtaccggtttcccacccggttccggttccccccg

SEQ ID NO: 187422 - DNA, 731 bp, Homo sapiens
  misc_feature: GYAE6OF01AMZ2Q.4.47.E03.1.454.CMB.1.raw
  modified_base (127)..(127): a, c, t, g, unknown or other
  misc_feature (127)..(127): n is a, c, g, or t
  modified_base (173)..(173): a, c, t, g, unknown or other
  misc_feature (173)..(173): n is a, c, g, or t
  modified_base (185)..(185): a, c, t, g, unknown or other
  misc_feature (185)..(185): n is a, c, g, or t
  modified_base (221)..(221): a, c, t, g, unknown or other
  misc_feature (221)..(221): n is a, c, g, or t
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
  modified_base (531)..(531): a, c, t, g, unknown or other
  misc_feature (531)..(531): n is a, c, g, or t
tcagagcactgtagcacgaccggtgctcgatttagactcgcgcacagagagaagggggctgtgggctcaggaggcagagctctgggaatctcaccatggcctggacccctctcctgcctccccctcncactttctgcacagtctctggacgccttcctatgagctgacacacncccacctcggtntcagcgtcccaggacaaacggcaggatccacctacnctgganatcgnattcgacataccagcagaagtcacgaccacggtccctgttctggtccagtccgtggtacggaaccgacctaacccgaaaccgaccccggtcgggaacttcccgtaggaacgtaccgttacttccgtcgttcggtcctaccggtaacgtccgttaacggaagggtaacctaagttccggaacccttacccttagtaccgtacttacccggaacgggttaccgggggacccgagggttacggagggtaactacgtaaacccgtgttaacttacgtttacttacggtacctacgaaccgtanacgtacggactacgtctaactaattccggtaaggggttcggggtttacgggaccgggggtacggtaaacgggtacctaccggaacggtttccgtaacccggtacccggttaccggttaaccgggtacacccggtaaaccccgacgtccggtcccccggttacccgtacccggtaccgttaccccttccggtttacccccg

SEQ ID NO: 187423 - DNA, 511 bp, Homo sapiens
  misc_feature: GYAE6OF02GVASV.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgccctccgggatccctgagagattctctggctccagctcagggacaatggccacttgactatcaggtcgggcccagggtggaggatgaacctgactactattgttactcaacagacagcagtgactaatcagttgggtgttcgggcggagggatcgaagcgtgaccgtcgtaggtcagacccgaaggcctcgcccctggtccacgtccttcgtcccctacccc

SEQ ID NO: 187424 - DNA, 541 bp, Homo sapiens
  misc_feature: GYAE6OF02HAVD3.4.47.E03.1.454.CMB.1.raw
  modified_base (422)..(422): a, c, t, g, unknown or other
  misc_feature (422)..(422): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctactctggagatgcattgccataccagcagaagtcagaccaggcccctgttctggtcatctgtggagacaccaaacgaccctccgggactccctagagagtacttctctggctccagcctcgagggacaagtcggccacttgactatcgaggtgggcccgagggtggaggatgaacctgactactattgtactcaacagacagcagtnactaatcagtggggtgttcgggcggaggatacgaagctggaccgtcgtaggtcacggacccaagggtccctaccggcccccgttcgggtcctaccgttccgttccggttccccgtcccc

SEQ ID NO: 187425 - DNA, 518 bp, Homo sapiens
  misc_feature: GYAE6OF02IR71C.4.47.E03.1.454.CMB.1.raw
  modified_base (423)..(423): a, c, t, g, unknown or other
  misc_feature (423)..(423): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgccctcgggactccctgagagattctctcggctccagctcgagggacaagtcggccacttgactatcaggtcggggcccagggtggaggatgaacctgactactattcgttactcaacagacagcagtgactaancagtggggtgttcgggcggagggatcgaagcgtacgaccgtcgtaggcacgaccaaggccgtcgccccgtcggtccacgtcctcgtcccctcccg

SEQ ID NO: 187426 - DNA, 503 bp, Homo sapiens
  misc_feature: GYAE6OF02GEOTB.4.47.E03.1.454.CMB.1.raw
  modified_base (410)..(410): a, c, t, g, unknown or other
  misc_feature (410)..(410): n is a, c, g, or t
  modified_base (441)..(441): a, c, t, g, unknown or other
  misc_feature (441)..(441): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgaccctccgggatccctgagagacttctctggctccagctcaggacaatggccaccttgactatcagtcgggccaggtggaggatgaacctgactactattgttactcaacagacagcagtnactaatcagttggggtgttcgggcggagggntacgaagctgaccgtctaggtcacgcccaaggcctcgcccctggccactctcgttcccgccc

SEQ ID NO: 187427 - DNA, 502 bp, Homo sapiens
  misc_feature: GYAE6OF02HDA9D.4.47.E03.1.454.CMB.1.raw
tcagagcactgtagcacgaccggtgctcgatttagactcgcgcacagagagaaggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagaaaccaaacgaccctccgggatcccctgagagattctctggctccagctcagggacaatggccaccttgactatcagtggggcccaggtggaggatgaacctgactactattgttactcaacagacagcagtgctaatcagtggggtgttcgggcggagggatcgaagctgaccgtcctaggtcagcccaaggctcgcccctggtcactctcgttccaccctcc

SEQ ID NO: 187428 - DNA, 598 bp, Homo sapiens
  misc_feature: GYAE6OF02JGG1T.4.47.E03.1.454.CMB.1.raw
tcagagcactgtagcacgaccggtgctcgatttagactcgcgcacagagagaaggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctactctggagatgcattgccataccagcagaagtcagaccaggcccctgttctggtcatctgtggagacaccaaacgaccctccgggatccctgagagtacttctctggctccagctcaggtacaatggccaccttgactaatcagtcgggcctagggtacgaggaatgaacctgaactacgtattacgttactacaaatacgactacgacaagtgacctaaatcgtaagttcggggtgttacggacgggtagggactacgaaacggctacggacccgttccgtaagggtcccgtaacggcccgtaaacgggtcccgttacccggaccccccgtttaccgggtcctaacccgtttcccggttacccggtttacccccgtcccccgg

SEQ ID NO: 187429 - DNA, 540 bp, Homo sapiens
  misc_feature: GYAE6OF02GIVTH.4.47.E03.1.454.CMB.1.raw
  modified_base (408)..(408): a, c, t, g, unknown or other
  misc_feature (408)..(408): n is a, c, g, or t
  modified_base (418)..(418): a, c, t, g, unknown or other
  misc_feature (418)..(418): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctactctggagatgcattgccataccagcagaagtcagaccaggcccctgttctggtcatctgtggagacaccaaacgccctccgggatccctgagagattctctggctccagcctcgagggacaatcggcctaccgttgactatcgaggtcgggccaggtggaggatagaactgactactagttcgtactcaacngacagcagtnactaatcagtggggtgttcgggcggtagggatcgaagctggaccgtccgtaggtccaacggcccgaaggtcctaccggcccccgttcggtccaccgttcccttccggttcccccgtaccccc

SEQ ID NO: 187430 - DNA, 539 bp, Homo sapiens
  misc_feature: GYAE6OF02H8CHA.4.47.E03.1.454.CMB.1.raw
  modified_base (409)..(409): a, c, t, g, unknown or other
  misc_feature (409)..(409): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgaccctccggactcccctgagagattctctggctccagctcagggacaatggccacttgactatcagtgggcccaggtggaggatgaactgactatattgttactcaaacagacagcagtnactaatcagttgggtgttcgggcggagggatacgaagctacggtacccgtccgttaagggtcaaccggacccgaagggtcctccggcccccgtcggtaccctaccgttcgttcccgttccccgtcccccc

SEQ ID NO: 187431 - DNA, 503 bp, Homo sapiens
  misc_feature: GYAE6OF02FU99Y.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgaccctccgggatcccctgagagattctctggctccagctcagggacaatggccaccttgactatcagtggggcccaggtggaggatgaacctgactactattgttactcaacagacagcagtgactaatcatggggtgttcgggcggagggatcaagctagaccgtctaggtcagcccaaggctcgcccctggtccactctcgttccctacccc

SEQ ID NO: 187432 - DNA, 552 bp, Homo sapiens
  misc_feature: GYAE6OF02GKA1D.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccacggcccctgttctggtcatctgtggagacaccaaaccgcccgtccgggactcccgtgagagacttctctgcctccagctcgagggacaagtcggccacttgactatcaggtcgggcccgaggtggaggatgaacctgactaactagttattactacaacagacagcgagtgactaatcgaggttggggtggttcgggacgggtagggatacgaagccgtggacccgtcgtacggtccacggacccgaacggccgtccgcccccgttcggtcctacctccgttcccgttcccctaccccc

SEQ ID NO: 187433 - DNA, 541 bp, Homo sapiens
  misc_feature: GYAE6OF02FTM88.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgaccctcgggactccctgagagtattctcgtggctccagctcgagggacaagtcggaccaccttgactatcgaggtcggggcccaggtggaggatgaacctgactactattgttactacaacagacagcagtgactaatcgtagtgggtgttcgggcgggagggatacgagcgtacggaccggttccgtaggtccgacggaccccgaaggtcctccggtcccccgtcgggtccctaccgtccgttcccgg

SEQ ID NO: 187434 - DNA, 528 bp, Homo sapiens
  misc_feature: GYAE6OF02GXTRO.4.47.E03.1.454.CMB.1.raw
  modified_base (415)..(415): a, c, t, g, unknown or other
  misc_feature (415)..(415): n is a, c, g, or t
  modified_base (437)..(437): a, c, t, g, unknown or other
  misc_feature (437)..(437): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgccctccgggatcccctgagagattctctggctccagctcgagggacaatcggccaccttgactatcaggtcgggcccagggtggaggatcgaactgactactattgttactcaacagacagcagtnactaatcagtgggtgttcgggnggaggagtcgaagcctgaccgtcgtaggtcgacgcccgaacggccgtccgcccccgttcggtcctacccgtccgttccgttccccgtcccc

SEQ ID NO: 187435 - DNA, 838 bp, Homo sapiens
  misc_feature: GYAE6OF02FUYEN.4.47.E03.1.454.CMB.1.raw
  modified_base (144)..(144): a, c, t, g, unknown or other
  misc_feature (144)..(144): n is a, c, g, or t
tcagagcactgtagcacgaccggtgctcgatttagactcgcgcacaggaggagaagggggtgggctcgacggaggccaggagtctcgtgggtaactcttcgaccatggcctggaccctctcctgctccccctcctcactttcgngtcgacagtctctggacggttcctcctagtgtagtacgtgacactagccacccgtcggtgtcgtagttcggtccccgaggacggaaacggcctaaggactccgacccgtacggtcctgggagacttcggcctagttcgaccctagtacccagtcgaagtaacgtcctaggacccaacgggtccccttgttcctggtccagtcctggtccggacgtacgacccgaaaaccggtaccccgttaccggggaacttcccggtaggaacggtacgtactttcgtacgttcgggtccgttaccgaggtcgttcgacgggacctaaacgttcggaccctaaccgttacgaaccttaacgtaccggtacgggttccggggacccctaagggttcggaacgggacgtacgggaaaccctacggtaacccgtaaacgttaacgttacggttaaccgtacgtaaccgtacgaacgtaggtaccgtaagggtacgaaccgttaacgttacgtaacggttggggttacggtttacggggacgggttaacggggtacgttaacggtaacggtccgtacggtacccggttaccggtaacggttacccggaccggtaccccggtaacgggttacccggttaccggtaccccccggttacgggttcccgtacccggttcccgtttacccggttcccccgggttaccccccg

SEQ ID NO: 187436 - DNA, 522 bp, Homo sapiens
  misc_feature: GYAE6OF02FKU6D.4.47.E03.1.454.CMB.1.raw
  modified_base (411)..(411): a, c, t, g, unknown or other
  misc_feature (411)..(411): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaaacgaccctccgggatccctgagagattctctggctccagctcagggacaatggccacttgactatcagtggggcccagggtggaggatgaacctgactactattgtactcaacagacagcagtnactaatcagttggggtgttcgggcggtagggatcgaaagcgtagtaccgtccgtaggtcacgccccgaaggcctcggccccctcggtccacctccttcgttcccctacccc

SEQ ID NO: 187437 - DNA, 511 bp, Homo sapiens
  misc_feature: GYAE6OF02JBOCA.4.47.E03.1.454.CMB.1.raw
  modified_base (415)..(415): a, c, t, g, unknown or other
  misc_feature (415)..(415): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgccctccgggatcccctgagagattctctggctccagctcagggacaatcggccaccttgactatcaggtcggggcccagggtggaggatgaacctgactactattgttactcaacagacagcagtnactaatctagtggggtgttcggcggaggagtcaagcgtgaccgtcgtaggtcacgccaaggctcgccccgtcggtccactctccgtccctaccccg

SEQ ID NO: 187438 - DNA, 554 bp, Homo sapiens
  misc_feature: GYAE6OF02FVOMA.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgaccctccgggatccctgacgagattctctggctcagctcagggacaatcggccacttgactatcaggtcgggcccaggtggagatcgaactgactactatcgttactcaacgtagacagacagtagctaaagtcaagttggggtacgttcggggccgggtaagggacttacgaaggtcgtacgtaaccgttccgtaaggtccaacggaccccgtaaggcccgttacggccccccgttgggtaccctaccgttccgttcccgg

SEQ ID NO: 187439 - DNA, 623 bp, Homo sapiens
  misc_feature: GYAE6OF02G5CKJ.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctactctggagatgcattgccataccagcagaagtcacgaccacggcccctgttctggtcatctgtggacgaccaaccgaaaccgcccgtccgggactcccgtggaacgagtacttctcgtggccttccacgtcctacgaacgggaacaacgtcggacctaccttagactagtcgagggtcggggacccgagggtggaaggtatacggaacctgaacttacttattcgttaactacaaacacgacagcagtcgactaatcgtaaggttggggtacgttcgggacgggtaggtacgtacgaacgcgtacggtacccgttacgtacggtcgaaccggacccgtaacggtcccgtcccggtacccccggttcgggtaccctacccgttcccgttaccgttaccccctacccccg

SEQ ID NO: 187440 - DNA, 670 bp, Homo sapiens
  misc_feature: GYAE6OF02J0692.4.47.E03.1.454.CMB.1.raw
  modified_base (226)..(226): a, c, t, g, unknown or other
  misc_feature (226)..(226): n is a, c, g, or t
tcagagcactgtagcacgaccggtgctcgatttagactcgcgcacgagagagaaggggtctgtgggctcaggaggcagagctctgggaatctcaccatggcctggacccctctcctgcctcccctctcactttctgcacagtctctgaggcctcctatgagctgacacagccaccctcggtgtcagtcgtcccaggacaaacggccaggatccacctactctgganatgcattcgccataccagcagaagtcacgaccacggcccctgttctggtcagtctggtaggacgaccaaccgaaccggcccgtccgggactcccgtggaacgagtacttcgtcgtcggcctccgagtctcgaagggacaagtcggacctacgttgacttagtcgacggtcggggaccctagggtacggaggacgtacggtaaccgtgtaacttacgttagttacgttaactacgtaacgtacgactacgactacggtacgtacttaacgtcgtaagggttcggggttacggttaccggggacgggtaaggtacgttaaccgtacggtccggttaacggtacccggttaccggttacgggtaccgaaccggtacccgtaaacgggtcccgttaaccccggtcccccgttacgggttacccgtacccggtttaccggttcccccgg

SEQ ID NO: 187441 - DNA, 561 bp, Homo sapiens
  misc_feature: GYAE6OF02HTUFS.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctctcactttctgcacagtctctgaggcctcctatgagctgacacagccaccctcggtgtcagtcgtccccaggacaaacggccaggatcacctactctggagatgcattgccataccagcagaagtcagaccaggcccctgttctggtcatctgtggacgacaccaaacgaccctccgggactcccgtgagagtattctcgtggctccgagtctacgagggacaagtcggacctaccgttgactatcgaggtcgggaccgaggtggaggtagtacgtaacgtagactactagttacgttactacgtaacacgacacgacgagtgactaatagaggtgggtgtcggacgggaggtagtacgacgtcgtacgtaccgtccgtacgtcgacgacccgaacggtccgtccggtcccccgtccggtcctaccgttccgtcccg

SEQ ID NO: 187442 - DNA, 533 bp, Homo sapiens
  misc_feature: GYAE6OF02FR67X.4.47.E03.1.454.CMB.1.raw
  modified_base (445)..(445): a, c, t, g, unknown or other
  misc_feature (445)..(445): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgaccctccgggatcccgtgagagattctctggctccagctcagggacaagtcggccaccttgactatcgaggtcggggcccagggtggaggagtgaacctgactactattgttactacaacagacagcagtgactaatcgagttggggtgttcgggnggagggatcgaagcgtacgaccgtcgtaggtcacgacccgaaggccgtccgcccccgtcggtccaccgttcctccgttcccctacccc

SEQ ID NO: 187443 - DNA, 569 bp, Homo sapiens
  misc_feature: GYAE6OF02HJID3.4.47.E03.1.454.CMB.1.raw
  modified_base (472)..(472): a, c, t, g, unknown or other
  misc_feature (472)..(472): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctactctggagatgcattgccataccagcagaagtcagaccaggcccctgttctggtcatctgtggagaccaaccaaaccgccctaccgggactcccgtgacgagtacttctcgtcggctccgagcctacgagggacaagtcggacctaccgttacgactacgtcgtaggtcgggcccgaggtggaggagtacgaactgtactactattcgttactacaacacgacagacagtcacgtaatcgtagttgggtgttacggnggtagggatcgaagcgtacgaccgtcgtaggtccacggcccgtaacggccgtaccgtccccgtcggtacctaccgttcctaccgttccccctacccg

SEQ ID NO: 187444 - DNA, 509 bp, Homo sapiens
  misc_feature: GYAE6OF02FOP93.4.47.E03.1.454.CMB.1.raw
  modified_base (418)..(418): a, c, t, g, unknown or other
  misc_feature (418)..(418): n is a, c, g, or t
  modified_base (434)..(434): a, c, t, g, unknown or other
  misc_feature (434)..(434): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgaccctccgggatccctgagagattctctggctccagctcgagggacaatggcctacttgactatcaggtcgggccaggtggagatgaacctgactatattgttactacaacagacagctagtgctaatnagttggggtgttcggnggtagggatacgagtcgtgaccgtcgtaggtcacgcccgaaggcctcgccccgtgtccactctccgtcccgtccc

SEQ ID NO: 187445 - DNA, 529 bp, Homo sapiens
  misc_feature: GYAE6OF02F0OYU.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgaccctccgggactccctgagagattctctggctccagctcgagggacaatcggccacttgactatcagtcggggcccgaggtggaggatggaacctgactactattcgttactacaacagacagcagtgctaatcagtggggtgttcgggcggtagggatacgaagtcgtacggacccggttccgtaggtccgacgacccgaaggccgtcgcccccgtggtccctacgtcttcccgg

SEQ ID NO: 187446 - DNA, 584 bp, Homo sapiens
  misc_feature: GYAE6OF02ISZN8.4.47.E03.1.454.CMB.1.raw
  modified_base (439)..(439): a, c, t, g, unknown or other
  misc_feature (439)..(439): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagccaccctcggtgtcagtcgtccccgaggacaaacggccaggatcacctactctggagatgctattcgaccataccagcagaagtcagaccaggccctgttctggtcatctgtggagacaccaacgccctccgggactccctgagagtacttctacgtggctccgagcctcgagggacaagtcggacctacgttgactatcgaggtcggggcccagggtcggaggatacgaacctgaacttactattcgttactacaacagacagacagtanactaatcgtaagtggggtacgttcgggacggtagggtatacgaaagtcgtacggtacccggtacgtacgggtcaaccggacccgaacggtccgtaccggtcccccggttggtccctaccgttccgttcccggttccccgtccccg

SEQ ID NO: 187447 - DNA, 657 bp, Homo sapiens
  misc_feature: GYAE6OF02HN1K4.4.47.E03.1.454.CMB.1.raw
  modified_base (267)..(267): a, c, t, g, unknown or other
  misc_feature (267)..(267): n is a, c, g, or t
tcagagcactgtagcacgaccggtgctcgatttagactcgcgcacagagagaagggggtgggctcaggaggcagagctctgggaatctcaccatggcctggacccctctcctgctccccctctcactttctgcacagtctctgaggcctcctatgagctgacacagcccaccctcggtgtcagtcgtccccaggacaaacggccaggatcacctactctggagatgcattgccataccagcagaagtcagaccacggcccctgttcnggtcatctgtggagacaccgaaacgcccgtcggactccctgagagattctctcggctccgagcctacgagggacaagtcggacctaccgttgaactatacgaggtcggggacccgtagggtggaaggtactacggtaaacctggtaaccttacgtaagtttcgttaaccctactaaaccgaacgtaccaaggaccgtaagttacgaccttaagtccgtaaggttaggggggtcgttacggggacgggtagggtaactaccgaaaggtccgtacggtacccgttaccgttacgggtacccaccggtaccccggaaagggtccccgttacccggtaccccccgttcgggtacccttacccgtttccccgttcccgttcccccctaacccccg

SEQ ID NO: 187448 - DNA, 541 bp, Homo sapiens
  misc_feature: GYAE6OF02FRTKP.4.47.E03.1.454.CMB.1.raw
  modified_base (281)..(281): a, c, t, g, unknown or other
  misc_feature (281)..(281): n is a, c, g, or t
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
tcagagcactgtagcacgaccggtgctcgatttagactcgcgcacagagagaagggggctgtgggctcaggaggcagagctctgggaatctcaccatggcctggacccctctcctgctccccctctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtgganacaccaaacgccctcgggatccctgagngattcnctggcctccgagctcgagggacaagtggcctactgactatcaggtcgggccaggtggagatagaacctgactactatgttactcaacagacagcagtgactaatcaggttgggtggttcgggacgggagggactcgaagtcgtacggtaccggtccgtaggtccgaacgtacccgtaacgggccgtaccggtcccccgttacggtacctacgtttcccgttcccgg

SEQ ID NO: 187449 - DNA, 735 bp, Homo sapiens
  misc_feature: GYAE6OF02I2TZS.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctcccctcctcactttctgcacagtctctgaggcctcctatgagctgacacagccaccctcggtgtcagtcgtccccaggacaaacggccaggatcacctactctggagatgcattgccataccagcagagtcagaccagcccctgttctggtcatctgtggagacaaccaaaccgacccctccgggactcccgtgagagtacttctcgtcggctccgacgtcctcgaacgggacaacgtcggaccctaaccgttagaccttacgtccgtaacgggttccgggggaccccgtaggggtacggggtaacgggacgtacggtaaacccgttagtaaccgttaacgtttaacgtttacgtttaaaccgttaacctaaaccgtaacgtaaccgtaacgaccgtaaggttacgtaacctttaaacgttaccgtaacggttacggggttaacgtttacgggtttccggggacggggtaaggggtacgttaccggtaacgtccgttaaccgggtaccccggtttaaccggttaacggggttaccgaacccgggtacccgaaaccgggttcccgttaccccgggtacccccccggttaccgggttacccgtacccgtttacccccgg

SEQ ID NO: 187450 - DNA, 564 bp, Homo sapiens
  misc_feature: GYAE6OF02IQO9R.4.47.E03.1.454.CMB.1.raw
tcagagcactgtagcacgaccggtgctcgatttagactcgcgcacagagagaaggggggtgggctcaggaggcagagctctgggaatctcaccatggcctggaccccctctcctgcctcccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgacccgtccgggactcccctgagagtattcctctggcctccagcctcgagggacaagtcggccaccttgaactatcaggtcggggcccagggtggaggatcgaacctgacttactattgttaactcaaacagacagcagtgactaatcaggtggggtgttcgggcggagggatcgaagtcgtacgacccgttacgtacggtcaacggcccgaaggccgtccggtcccccgtacgggttccctaccgttccttcccggttcccccgtcccccg

SEQ ID NO: 187451 - DNA, 550 bp, Homo sapiens
  misc_feature: GYAE6OF02FMVOY.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctcccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgccctccgggactccctgagagattctctggctccagctcgagggacaatcggccaccttgactatcaggtcgggcccagggtggaggatgaacctgactactattgttactcaacagacagcagtgactaatcagttggggtcgttcgggcggagggtatcgaagtcgtacggacccgtccgtaggtccgacgtacccgaaggtccgtccggccccccgttcgggtaccctaccgtcccgttccgttccccctacccccg

SEQ ID NO: 187452 - DNA, 580 bp, Homo sapiens
  misc_feature: GYAE6OF02HMD0D.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgcctccccctcctcactttctgcacagtctctgaggcctcctatgagctgacacagccaccctcggtgtcagtcgtcccaggacaaacggccaggatcacctactctggagatgcattgccataccagcagaagtcagaccacgcccctgttctggtcatctggtggagaccaaccgaaaccgacccgtccgggactcccctaggacgagtacttcctcgtggcctccgagctacgagggacaagtcggacctacttgacttatacgaggtcggggcccagggtggaggatacgaaccgtgaactacttagttgttaactacaacagacgagcagtgtactaatcgagttggggtagttcgggacgggagggtactacgagtcgtacggtacccggttcgtacggtacaccggacccgaaggcccgtccggtcccccgttcggtaccctaccgttccgttacccg

SEQ ID NO: 187453 - DNA, 640 bp, Homo sapiens
  misc_feature: GYAE6OF02GTZFD.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctactctggagatgcattgccataccagcagaagtcagaccacggcccctgttctggtcatctgtggacgacaaccaaaccgaccccgtccgggactccccgtgacgagtacttctcgtcggcctccagctacgagggacaacgtcggccctacgttgactatccgaggtcgggggaccctagggtacgggaggacgtacggaaccgttgaacttacttaagtttacggttaacctaccgtaaacgaacgtacgacgacgtaacggtcgtacgttaaagtccgtaagggttcgggggttacgttaccgggggacggggtaagggtacgtacgaacggtcgttacggaacccgttcggtaacggtccaaccggacccgaacggtccctcccggtccccgttccggtacctaccgtccgttaccccg

SEQ ID NO: 187454 - DNA, 676 bp, Homo sapiens
  misc_feature: GYAE6OF02J2O8D.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcactactctggagatgcattgccataccagcaagaagtcacgaccaggcccctgttctggtcatctgtggagacaccaaaccgacccgtccgggactccccgtgagagattctctggcctccagcctacacgggactaagtcggccaccgttgaactactccgaggttcgggggaccctaggggtacggaggacgtacgaacccgtgacttacgttactttaggttaacctacgaaacacggtaactagaccgtagtcggacttaaagtccgaaggttcgggggttacgtttaccgggggaccgggtagggtaacgttacgaaagggtccctagggtaccccgttacgttaacggggtaccctaacggtaccccgtaaacggggtcccgttacccggtacccccccgtttaccggggtacccgttaaccctttccccggtttacccggtttcccccggttaccccccg

SEQ ID NO: 187455 - DNA, 577 bp, Homo sapiens
  misc_feature: GYAE6OF02HF440.4.47.E03.1.454.CMB.1.raw
  modified_base (450)..(450): a, c, t, g, unknown or other
  misc_feature (450)..(450): n is a, c, g, or t
tcagagcactgtagcacgaccggtgctcgatttagactcgcgcacagagagaagggggtgggctcaggaggcagagctctgggaatctcaccatggcctggaccctctcctgctccccctcctcactttctgcacagtctctgaggcctcctatgagctgacacagcccaccctggtgtcagtcgtccccaggacaaacggccaggatcacctactctggagatgcattgccataccagcagaagtcagaccaggcccctgttctggcatctgtggagacaaccaaacgcccgtcggactccctgacgagtattctcgtggcctcacgctacgagggactaagtcggacctacgttagactatcgaggtcgggcccgaggtggaggagtacgaaccgtgaacttacgtagtttacgttaactacaaacgacgtaacagacagtcactaancgaagttggggtagttaccgggaggtaggagtacgaacgtcgtacggaccgttacggtacggtcgacggacccgtaaggcccgtcgcccccgttaggtacctaccgtcttccggtccccgtaccccg

SEQ ID NO: 187456 - DNA, 573 bp, Homo sapiens
  misc_feature: GYAE6OF02I96VV.4.47.E03.1.454.CMB.1.raw
  modified_base (281)..(281): a, c, t, g, unknown or other
  misc_feature (281)..(281): n is a, c, g, or t
  modified_base (479)..(479): a, c, t, g, unknown or other
  misc_feature (479)..(479): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctactctggagatgcattgccataccagcagaagtcagaccacggcccctgttctggtcatctgtgganaccaccgaaaccgacccgtccgggactccccgtgagagtattccgtctggctccagcctacgagggacaagtcggcctaccttgactatcgaggtcggggcccagggtggaggtacgtacggaaccgtgtactacttacgttcgttacctacaaccgtacgacagcgtagtcgactaagtcgaggttgggtgtcgggnggaggagtacgagtcgtagaccgttcgtcggtaccgacgccgaagggcctccggcccccgttcggtcccaccttccgttccgtcccctaccccg

SEQ ID NO: 187457 - DNA, 592 bp, Homo sapiens
  misc_feature: GYAE6OF02F3GZM.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatccacctactctggagatgcattgccataccagcagaagtcagaccaggcccctgttctggtcatctgtggagacaccaaacgaccctcgggactccctgagagattctctcggctccgagctcgaagggacaagtcggaccctacgttcgaactatccgaggtcggggaccctaggggtacgggaggtagtacggaaccgtgaccttaacttagttacgttaacctacaaacagaacagtacagtcgactaagtcaaggttcgggttgttcgggcgggtaggactacgaagtcgtacgtaccgtccgtaggtcacggacccgtaaggcctccggcccccgtcggtaccctaccgttccgttacccgttaccccctaccccccg

SEQ ID NO: 187458 - DNA, 911 bp, Homo sapiens
  misc_feature: GYAE6OF02HH722.4.47.E03.1.454.CMB.1.raw
  modified_base (226)..(226): a, c, t, g, unknown or other
  misc_feature (226)..(226): n is a, c, g, or t
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctactctgganatgctattgccataccagcagaagtcagaccacggcccctgttctggtcattctggtggacgaccaaccgaaaccgaccccgtccgggactccccgtagaacgagtacttccgtacgtcggtaccttaccgaacggtccgttaccggaacgggggtaaccctaaaacggtccgggtaacccctaacccgtttacggtaacccttaagttaccgtaacgggggtttaccggggggacccccgtaaggggggtttacggggtaaacgggtaaccgtttaaccggggtaaaacccccggttttaggtaaaccccgtttaaaaccggttttaaacggtttttacccgggttttaaaacccgttaacccgtaaaaaacccgggtaacggtaaacccgaaacggttaccgtaacgggtttaacggtaaacccgtttaaaacgtttcgggtaaacggggttttacgggggggtttacggggttttaccgggggtaaacccgggggtaaagggggtaaccgttaacccgggaaacgggttacccgttaccggggttaacccccggttaacccgggtttaaccggggtacccctaaccgggaacccccgggtaaccgggtacccgttacccccgggtacccccccggtttaccgggtaccccttaacccggtttccccgttttaacccccccgg

SEQ ID NO: 187459 - DNA, 719 bp, Homo sapiens
  misc_feature: GYAE6OF02HN88N.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtcgtccccaggaacaaacggccaggactcacctactctggagatgctattcgaccaataccagacaagaagtacagacccgaacggtcccccttagttccgtggtacatcgtggtaggacgaccaaccgaaaaccgaccccgtccgggaactcccgtaggaacgacgtactttcgtcgttacggccttaccacggtcctacgacgggaactaacgtcggtacctaaccgttcgaaccttagtaccgtagggttcggggacccgtaggggtcgggaacggtatacggtaaacctacggtaacttaacgttagtttacgttaactacgaacgaacgacaacggacctagtactactaagtccgtaaggttcgggggtacgtttacggggacgggtaacgggtaacgttacgaaaggtccgtacggtacccgttccgttacgggtactaaccggacccggtaaacggcccgttacccggaccccccgtttacgggtacccttaacccggttcccgtttacccgttcccccggttacccc

SEQ ID NO: 187460 - DNA, 545 bp, Homo sapiens
  misc_feature: GYAE6OF02GQ9C7.4.47.E03.1.454.CMB.1.raw
  modified_base (418)..(418): a, c, t, g, unknown or other
  misc_feature (418)..(418): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaaccgccctccgggactccctgagagattctctggctccagctcgaggacaatggcctaccttgactatcgaggtcgggcccagggtggaggatgaacctgacttactattgttactcaaacagacagcagtnactaatcagttggggtgttcgggcggtagggatacgaagcgtagaccgtcgtaggtccaacggcccgaaggtccgtccggcccccgttcgggtaccctaccgttccgttccggttccccctcccccg

SEQ ID NO: 187461 - DNA, 563 bp, Homo sapiens
  misc_feature: GYAE6OF02GPPVT.4.47.E03.1.454.CMB.1.raw
  modified_base (320)..(320): a, c, t, g, unknown or other
  misc_feature (320)..(320): n is a, c, g, or t
  modified_base (389)..(389): a, c, t, g, unknown or other
  misc_feature (389)..(389): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctactctggagatgcattgccataccagcagaatcagaccacggcccctgttctggtcatctgtggacacaccaaacgccctcgggactcccgtgacgagtacttcncgtcggcctccagtctcgaagggacaagtcggacctacgttgactagtcaggtcgggccagggtggagntcgaactgactacgttattcgttacacgaacagacagacagtcactaatcgtaggtggggtcgttcgggacggtaggtactacgaacgcgtacggtaccgttacgtacggcgtaacgccgaacggtccgtccgaccccgtcggtaccacccgttcggttccctccccggtcccc

SEQ ID NO: 187462 - DNA, 533 bp, Homo sapiens
  misc_feature: GYAE6OF02HN9OJ.4.47.E03.1.454.CMB.1.raw
  modified_base (419)..(419): a, c, t, g, unknown or other
  misc_feature (419)..(419): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctactctggagatgcattgccataccagcagaagtcagaccaggcccctgttctggtcatctgtggagacaccaaacgaccctccgggactccctgagagattctctggctccagctcgagggacaatcggccaccttgactatcaggtcggggcccagggtggaggatgaacctgactactattgttactcaacagacagcagtnactaatcagtggggtgttcgggcggagggactcgaagcgtgaccgttctacgggtcacgacccgaaggtcctccggcccccttcggtcctaccgtccttccggttcccctcccc

SEQ ID NO: 187463 - DNA, 606 bp, Homo sapiens
  misc_feature: GYAE6OF02ITRIS.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaaccgacccgtccgggatcccgtgacgagacttctctggctcagctcgagggacaagtcggacctacttgactactcgaggtcggggacccgagggtcggaggtactacggaacctggtaactacgttagtttgttacctactaaacgaacgacgagacgagtacgtactaaattccgaagttgggggtcggtttaccgggcggggtaagggtacgttacgaaggtccgtacggtacccggtacgtacgggtcaccggtacccgtaacggtcctacccggtcccccgttacgggtaccctaccgttccgttaccccgg

SEQ ID NO: 187464 - DNA, 533 bp, Homo sapiens
  misc_feature: GYAE6OF02JEQPL.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctactctggagatgcattgccataccagcagaagtcagaccaggcccctgttctggtcatctgtggagacaccaaaccgcccgtccgggatcccgtgagagtacttctctggctccagtctcgagggacaagtcggccacttgactatcaggtcgggccaggtggagatgactgactatattgttactcaacagacacgacagtgactaatcgtagtaggggtcgttcgggagggaggtactcgaagtcgtaggtaccggtcgtacggtacgcggacccgaaggcctccgcccccgtcgggtcctaccgtccttcccg

SEQ ID NO: 187465 - DNA, 559 bp, Homo sapiens
  misc_feature: GYAE6OF02GFUHO.4.47.E03.1.454.CMB.1.raw
  modified_base (490)..(490): a, c, t, g, unknown or other
  misc_feature (490)..(490): n is a, c, g, or t
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctactctggagatgcattgccataccagcagaagtcagaccaggcccctgttctggtcatctgtggagacaccaaacgacccctccgggactcccgtagacgagtattctcgtggcctccgagtctacgaggggtaacaagtcggaccctaaccgttagaacttactcgaggtcggggacccgagggtaggaggatacggaaccttgacttactattcgttactacaacagacagcagtgtactaatcgtagtgggttggtcgggcggagggtanacgaagctacggaccgtcggtaggtcgaacgcccgaaggcctacggccccctggtcctacctcgtcccg

SEQ ID NO: 187466 - DNA, 551 bp, Homo sapiens
  misc_feature: GYAE6OF02FXHVD.4.47.E03.1.454.CMB.1.raw
  modified_base (306)..(306): a, c, t, g, unknown or other
  misc_feature (306)..(306): n is a, c, g, or t
  modified_base (418)..(418): a, c, t, g, unknown or other
  misc_feature (418)..(418): n is a, c, g, or t
tcagagcactgtagcacgaccggtgctcgatttagactcgcgcacagagagaagggggtgggctcaggaggcagagctctgggaatctcaccatggcctggacccctctcctgctcccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgcccgtccgggatcccngagagtattctcgtggctccagctacgagggacaagtggacctacttgactatcgaggtcgggccaggtggagatgaacctgaactactattgtactcaacagacagcagtnactaatcgagtgggtgttcgggcggtagggtatacgaagccgtagacccgttacgtaggtccacggacccgaaggtccgtaccggtcccccgttcggtacccaccgttccgttacccgttaccccctaccccg

SEQ ID NO: 187467 - DNA, 514 bp, Homo sapiens
  misc_feature: GYAE6OF02F3LJI.4.47.E03.1.454.CMB.1.raw
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgccctccgggatccctgagagtattctctggcctccagctcgagggacaagtcggacccaccttgactatccaggtcggggacccagggtggaggagtgaacctggaacttactattcgttaactcaacagacagcagtgactaatcagtggggtgttcggnggaggntcgaagctgaccgtctaggtcagcccaggctcgcccctggccactctcgtccctaccc

SEQ ID NO: 187468 - DNA, 714 bp, Homo sapiens
  misc_feature: GYAE6OF02GPWKN.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatccacctactctggagatgcattcgccataccagcaagaagtcacgaccacggcccctgttcgtggtcatcgtggtggacgaccaaccgaaaccgaccccgtaccgggactcccgtagacgtacgtacttccgtcgtcggcctaccgacgtcctacggaacgggaactaacgtcgggaccctaaccgttagaaccttacgtaccgtagggtccgggggacccgtaggggtacgggaagggtacgtacggtaaaccgtacgtaaccttaacgttacgtttacgttaacctaaccgaaacgtaacgaacacggacgtaacggtacgtaacgttaaacgttacggtaagggtttcgggggttacggttccggggaacggggtaagggtacgtacgaacggtccgtacggtacccggttaccggtaacggtaccgtaccggacccgtaacggtcccgtacccggtcccccggttaccggtacccttacccgttcccgttacccccg

SEQ ID NO: 187469 - DNA, 581 bp, Homo sapiens
  misc_feature: GYAE6OF02HJIJU.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctactctggagatgcattgccataccagcagaagtcagaccacggcccctgttctggtcatctgtggagacaccaaacgaccctccgggactcccctgagagattctcgtggcctccagctcgagggacaagtcggacccaccttgactagtcgaggtcggggcccagggtgggaggagtagaaccgtgaactacttagttcgttactacaacagaacagcagtgactaatcgtagttggggttgttccggggacgggtagggtactacgaaggcgtcggtacccggttccgtacggtaccgaaccggaccccgaagggtcccgtccggccccccgttacgggtccctaccgtccgtttaccccg

SEQ ID NO: 187470 - DNA, 543 bp, Homo sapiens
  misc_feature: GYAE6OF02GZIGA.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctactctggagatgcattgccataccagcagaagtcagaccaggccccctgttctggtcatctgtggagacaccaaacgccctccgggatcccctgagagattctctggctccagctcgagggacaatcggccaccttgactatcgaggtcggggcccagggtggaggatgaacctgactatattgtactcaacagacagcagtgactaatcgagtggggttgttcgggcgggtagggatacgaagcgtaggacccgttcgtaggtcacggcccgaaggccctccggcccccttcgggtcctacccgttcttcccggttccccgtcccccg

SEQ ID NO: 187471 - DNA, 676 bp, Homo sapiens
  misc_feature: GYAE6OF02H66B1.4.47.E03.1.454.CMB.1.raw
  modified_base (229)..(229): a, c, t, g, unknown or other
  misc_feature (229)..(229): n is a, c, g, or t
  modified_base (493)..(493): a, c, t, g, unknown or other
  misc_feature (493)..(493): n is a, c, g, or t
  modified_base (512)..(512): a, c, t, g, unknown or other
  misc_feature (512)..(512): n is a, c, g, or t
tcagagcactgtagcacgaccggtgctcgatttagactcgcgcacagagagaagggggtgggctcaggaggcagagctctgggaatctcaccatggcctggaccctctcctgcctccccctcctcactttctgcacagtctctgaggcctcctatgagctgacacagcccacccgtcggtgtcagtcgtacccaggacaaacggccaggactcacctactcgtaggganatgctagttcgacctaactaccgagcaacgaagtcgaacgaaccgacggccccttgttcgtacggtacacgttcgtggtaggacgaaccgaacccgaaaaccgtccccggtaccgggtacctcccgtaggagaacgttacgttcctacgtcggtcctaccgacgccgtacgacgggactaacggtcgacctacgtgaactactacgacggtcgggccgtaggaggtacggagtacgtaacgtcgtaactactacgttacgtacncgaactagacagtacagtnaactagtacgaggtgggtcggttaccgggacgggtaagtaacggtactaacgtcgggtacgtacccggtaccgttacggggaacctacggacccggaacggtcccggtccggttcccccgacggttaccttaccggtttccttccccggtcccccgttaccccg

SEQ ID NO: 187472 - DNA, 563 bp, Homo sapiens
  misc_feature: GYAE6OF02IJ8MH.4.47.E03.1.454.CMB.1.raw
tcagagcactgtagcacgaccggtgctcgatttagactcgcgcacagagagaagggggtgggctcaggaggcagagctctgggaatctcaccatggcctggaccccctctcctgcctccccctcctcacttttctgcacagtctctgaggcctcctatgagctgacacagcccaccctcggtgtcagtcgtccccaggacaaacggccaggatcacctactctggagatgcattcgccataccagcagaagtcagaccacggccctgttctggtcatctgtggagacaccaaacgcccgtccgggactcccgtgagacgtatttcgtcgtcggctccagcctcgagggacaagtcggacctaccttgactagtcgaggtcgggacctagggtggaggagtacgaacgtgacttactattcgttactcaacgacgacagcagtgactaagtctaggttgggttgtcgggcgggtaagggatcgaagctacgtaccgtcgtaggcaccggaccgtacggtcctaccgtccccgtcggtccacctccgttcccgtaccctaccccg

SEQ ID NO: 187473 - DNA, 528 bp, Homo sapiens
  misc_feature: GYAE6OF02FSGK4.4.47.E03.1.454.CMB.1.raw
  modified_base (453)..(453): a, c, t, g, unknown or other
  misc_feature (453)..(453): n is a, c, g, or t
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaacgaccctcgggactccctgagagtattctcgtcggctccagcctcgagggacaagtcggaccctaccgttgactatcgaggtcggggcccaggtgaggatgaacctgactactattgttactcaacagacagcagtgactaatcagtgggtgttcggcggaggntacgaagcgtaggaccgttccgtaggtccacgacccgaaggcctccggcccccgttggtcctaccgtccttcccg

SEQ ID NO: 187474 - DNA, 725 bp, Homo sapiens
  misc_feature: GYAE6OF02HYMIH.4.47.E03.1.454.CMB.1.raw
  modified_base (226)..(226): a, c, t, g, unknown or other
  misc_feature (226)..(226): n is a, c, g, or t
tcagagcactgtagcacgaccggtgctcgatttagactcgcgcacagagagaagggggctgtgggctcaggaggcagagctctgggaatctcaccatggcctggacccctctcctgctccccctctcactttctgcacagtctctgaggcctcctatgagctgacacagccaccctcggtgtcagtcgtccccaggacaaacggccaggatccacctactctgganatgcattcgccataccagcaagaacgtcagaccacggcccctgttctggtcatctgtggagacaaccgaaccgaccctccgggactcccgtagacgagtacttctacgtcggtacctccgacgtccgtaccgagggaaccaagtcggaccctaaccgttgaaccttacgtacgacgggttacgggggaccccgtaggggtacgggaagggtacgttacggaaacccgttacggtaaccttaaccgtttaacgtttacggtttaaccttaacccgaaacgtaacggaaccgtaacggacgtaacggttacgtaaccgttaaagttaccgtaagggttcgggggttacgggtttccggggacggggtaacgggtaagtaccgaacggttaccgtaccgggtaacccggttccggttaccgggtaccgtaaccggtacccgtaacgggtcccgttcccggtaccccccggttacggtacccgtacccgttccgttaccccgg

SEQ ID NO: 187475 - DNA, 603 bp, Homo sapiens
  misc_feature: GYAE6OF02HXVR9.4.47.E03.1.454.CMB.1.raw
  modified_base (280)..(280): a, c, t, g, unknown or other
  misc_feature (280)..(280): n is a, c, g, or t
tcagagcactgtagcacgaccggtgctcgatttagactcgcgcacagagagaagggggtgggctcaggaggcagagctctgggaatctcaccatggcctggaccctctcctgctccccctcctcactttctgcacagtctctgaggcctcctatgagctgacacagcccaccctcggtgtcagtcgtccccaggacaaacggccaggatcacctactctggagatgcattgccataccagcagaagtcagaccaggcccctgttctggtcatctgtgganacaccgaaacgaccctccgggactccctgagagattctctggctccagctcgagggacagtcggcctaccttgactatcgaggtcgggcccgagggtggacggtatcgaacctgacttaactagtttacgttactacaacacgaacagactagtcgacttaatccgaagttgggggtacgtttcgggcgggtaagggtactacgaacggtcgttaccggtaccgttccgtacgggtccgaaccggacccgtaaacgggtcccgtaccggtccccccggtcggtccctacccggttccttaccccggttcccccgttacccccg

SEQ ID NO: 187476 - DNA, 612 bp, Homo sapiens
  misc_feature: GYAE6OF02HRE1K.4.47.E03.1.454.CMB.1.raw
  modified_base (228)..(228): a, c, t, g, unknown or other
  misc_feature (228)..(228): n is a, c, g, or t
tcagagcactgtagcacgaccggtgctcgatttagactcgcgcacagagagaagggggctgtgggctcaggaggcagagctctgggaatctcaccatggcctggaccccctctcctgcctccccctctcactttctgcacagtctctgaggcctcctatgagctgacacagcccaccctcggtgtcagtcgtccccaggacaaacggccaggatcacctactctgganatgcattgccataccagcagaatcagaccacggcccctgttctggtcatctgtggagacaccaacgacccgtccgggatcccgtgagacgtacttctcgtggcctccagctcgaagggacaagtcggacctacttgactatcgacgggtcggggacccgtagggtgggaagtagtacgaaaccgtgaaccttacgttagttcgttaacctacaaacagtaaccaggacctagtgaacttaagtccgtaggttgggggttcgtaccggggtagggaggtaactacgaacggccgttacggtacccggtccgtacggtccaaccggtacccgaacgggtccctaccccggtcccccggttggtaccctaccgttcccgttaccccg

SEQ ID NO: 187477 - DNA, 568 bp, Homo sapiens
  misc_feature: GYAE6OF02JG7P1.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgaccctccgggatccctgagagattctcgtggcctccagctcagggacaagtcggccacttgactatcgaggtcggggcccagggtggaggatcgaacctgactactattgttactacaacagacagcagtcgacttaatcgtaggttcggggtagttcgggacgggtagggtactacgaagtcgtacggaccgttcggtacggtccgacgacccgaacggtccgtacccggtccccccgtcggtaccctaccgttccgtaccgtttaccccctaccccg

SEQ ID NO: 187478 - DNA, 742 bp, Homo sapiens
  misc_feature: GYAE6OF02GJZ55.4.47.E03.1.454.CMB.1.raw
tcagagcactgtagcacgaccggtgctcgatttagactcgcgcacagagagaagggggtgggctcaggaggcagagctctgggaatctcaccatggcctggaccctctcctgctccccctcctcactttctgcacagtctctgaggcctcctatgagctgacacagccaccctcggtgtcagtcgtccccaggacaaacggcaggatcactactctggagatgcattgccataccagcagaagtcagaccagccctgttctggtcatctatggacgaacaccgaaacgacccgtccgggaactccctagacgagtagttctcgtacggtcttaccgacgtctccgaacgggaacaaacgttcggacccgtaacgttacgaacttacgtacgaacggggtccgggggtaccccgaaggggttacgggaacggtaagtacggtaaccctacggtacgttaaaccgtttagtttaccgtttaacgtaaccctaaaccgttaacggaaaccgttaacgtccgtaaacgggttctaacgttaaactcccggtaaagggttcggggggtttacggttaccggggacgggtaaggggtaactacgtaaacggtaccgtacggtacccgttacccgttaaggggtccgtaaaccggtaccccgtaaagggtcccttaccccgggtaccccccgttccgggttaactacccgggtttacccgttcccggttacccccccggttaccccccg

SEQ ID NO: 187479 - DNA, 596 bp, Homo sapiens
  misc_feature: GYAE6OF02HVI7M.4.47.E03.1.454.CMB.1.raw
  modified_base (226)..(226): a, c, t, g, unknown or other
  misc_feature (226)..(226): n is a, c, g, or t
tcagagcactgtagcacgaccggtgctcgatttagactcgcgcacagagagaagggggctgtgggctcaggaggcagagctctgggaatctcaccatggcctggacccctctcctgcctccccctctcactttctgcacagtctctgaggcctcctatgagctgacacagcccaccctcggtgtcagtcgtcccaggacaaacggccaggatcacctactctgganatgctattcgccataccagcaagaagtcagaccacggcccctgttctggtcatctgtggacgacaccaaacgccctcgggactcccgtgacgagtattctcgtggcctccgagtcctacgacgggacaagtcggacctacgttgacttactcgtaggtccggggaccctagggtgggacggtatacggaacctggtaactacttagttacgttactacaacagacagcagtagtactaatcgtaggttggggttcgtacgggacgggtaggaactacgaacgtcgtacggtacccgtacgttacggtccaaccgtacccgaaggtcccgtacccggtcccccgttcggtaccctaccgttccttccccgg

SEQ ID NO: 187480 - DNA, 822 bp, Homo sapiens
  misc_feature: GYAE6OF02G6EIZ.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagcccacccgtcggtgtcagtcgtacccccgaggaaccaaacggccaggactaccaccttactcgtaggagatcgactattcgaccataccagcaagaaacgtcaacgacccgtacggtccccttgttccgtggtactacttcgttggtacgggaacaccaaacccgaaaacccggtccccgttacccggggaaccttccccgtaggaacggacgttaactttccgtacgtacggtcctccgaacggtcctacggtaaacgggactaaacgtccgggacccttaaccgtttacgtactaaccgtacggacgggttacccgggggaccgtaggggttaacgggaacgggttaacgttaaccgggtaaccgttaacgggtaaaccctttaacgtttaaacgtttaccgggtttaaaccctaaccgaaaaccgttacggaaccgtaacggtaacgtacggttacgtaacctaagttaccggaaggggttttacgggggccggtttacggggaacgggttaacgggacgtaacgaacggtccgttaccgggtacccgttcggtaacggtccgtaaccggacccggtaacgggtccctaccccggttaccccggttaccggtaccttaccccggtccgtttcccggtacccccgtacccccg

SEQ ID NO: 187481 - DNA, 589 bp, Homo sapiens
  misc_feature: GYAE6OF02G5HNL.4.47.E03.1.454.CMB.1.raw
  modified_base (222)..(222): a, c, t, g, unknown or other
  misc_feature (222)..(222): n is a, c, g, or t
  modified_base (485)..(485): a, c, t, g, unknown or other
  misc_feature (485)..(485): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctgganatgcattgccataccagcagaagtcagaccacggcccctgttctggtcatctgtggagacaccaaaccgacccgtccgggactccctgagagtattctctggcctccgagctcgagggaccaagtcggcctaccgttgaacttactcgaggtcggggacccgaggggtcggaggatacggaacccgtggtaccttaacgttagttacgttactaccaacgtagacagcagtacacttaactcgtagttcggggtgttccgggngggagggactcgaagtcgtacggccgtacgtacggtccacgtacccgaacggtccgtcccgtaccccgtcggtacctaccgtccttaccgttcccctacccccg

SEQ ID NO: 187482 - DNA, 808 bp, Homo sapiens
  misc_feature: GYAE6OF02GEQIZ.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatccacctactcgtaggagatgcattgccataccagcagaagtcagaccgacggccctgttctggtcatctgtgacgaccaaccgaaacgaccctccgggactccccgtagacgacgtacgttcgtcgtcggccttaccgacgtcgtaccgtaacggggaacctaaaggtccggaccctaaccgtttacggaacctttaacgtaccggtaacggggttccgggggaccccggtaggggttacggggaaacgggtacgttaaccgggaaaccccggttacggtaacccgtttaaacgttaacgtttacggtttaacccgtactaaaccggtaacgtaaccgaacggtacctaaagggttacgtaaccgttaaacgttaccgtaagggtttcggggggtttacggtttaccgggggaacggggtaacgggggtaacttaaccgggtaaacgtaccggttacccgggtacccggtttacccgggtaacgggttacccggaaccggttaccccggaaacggttaccccgttccccggttaccccccggttacgggttacccgtacccgtttacccgtttaccccgttacccccgttaaccccccg

SEQ ID NO: 187483 - DNA, 548 bp, Homo sapiens
  misc_feature: GYAE6OF02GB4AT.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatccacctactctggagatgcattgccataccagcagaagtcagaccaggcccctgttctggtcatctgtggagacaccaacgccctccgggactccctgagagtattctcgtggcctccagctcgagggacatcggacctaccttgactatcgaggtcgggccaggtggagatgaacctgactactattcgttactcaactagacagacagtgtactaatcgaggttgggtgttcgggcggtaaggagtcgaagtcgacgtaccgtcgtaggtcgacgtacccgaaggtccgttccggccccgttcggtaccacccgtttcgtaccgttccccctaccccg

SEQ ID NO: 187484 - DNA, 725 bp, Homo sapiens
  misc_feature: GYAE6OF02GVA08.4.47.E03.1.454.CMB.1.raw
  modified_base (325)..(325): a, c, t, g, unknown or other
  misc_feature (325)..(325): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacacgcccaccctcggtgtcagtcgtccccaggacaaacggccaggactccaacctactcgtggagatgctattcgccataccagacagaagtcagaccacggcccctgttcgtggtcatctggtggacgaccaaccgaaaccgcccgtccgggactccgngagacgtacttctcgtcggtcctccgacgtcctcgaagggaacctaagtcggaccctaaccgttacgtaaccttagtaccgtacggggtccgggggtaccccgaagggggttcgggaacgggtacgtaacggtaaacccgttacggtaaaccgtttaaccgttaagtttaccggtttaaccctaacccgaaaaccgtaagaaccgtagtaccgttaacgggttacgtaaccgttaaacgttaccggtaagggtttcggggggtttacggttaccgggggacgggttaaggggtaactacgaacggtccgtacggtacccgttaccgtaggtccgaacgtacccggaaggtcccgtccggccccgttcggtacctccgttaccttcccgtcccctaccccg

SEQ ID NO: 187485 - DNA, 790 bp, Homo sapiens
  misc_feature: GYAE6OF02G4TYI.4.47.E03.1.454.CMB.1.raw
  modified_base (227)..(227): a, c, t, g, unknown or other
  misc_feature (227)..(227): n is a, c, g, or t
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctactctgganatgcattgccataccagcagaatcagaccacggcccctgttctggtcatcgtggtggacgaccaaccgaaaccgacccgtaccgggactcccgtagagacgtactttccgtacgtcggcctacccgagtccgtacggaacgggaacctaaacggtccgggacccttaaccgtttacggaaccttaacgtaccggtaacggggttccgggggaaccccggtaagggggttacggggaaacgggtaacgtaaccggtaaacccgttaggtaaacccgtttaaccgttaagttttaccggtttaacctaacccgtaaaaccgtaaacggtaacctaacggaccgtaaggttacgtaaccgttaaacgtaccggtaaggggtttacggggggttaccgggtttaccggggggaacggggtaaacgggttaacgtaccgtaacgggtccgttaccgggttaacccggttccggttaacgggtaccgtaaccggaccccggtaacggtacccgtaccccggttcccccgttaccgggttacccttacccgtttccccgtttacccccgg

SEQ ID NO: 187486 - DNA, 570 bp, Homo sapiens
  misc_feature: GYAE6OF02FIZYA.4.47.E03.1.454.CMB.1.raw
tcagagcactgtagcacgaccggtgctcgatttagactcgcgcacagagagaagggggctgtggactcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtgagacaccaaacgccctcgggactccctgagagattctctggctccagctcgagggacaagtcggccaccttgacttatcgaggtcggggcccagggtggaggatcggaacctgactactattagttactacaacagacagcagtcactaatctaaggttggggttacgttcgggacgggtagggtataccgaaggtcgtacggacccggttaccgtacgggtaccaaccggtaccccgtaagggcccttaccggccccccgttacgggtccctaccgttccgttaccccgg

SEQ ID NO: 187487 - DNA, 541 bp, Homo sapiens
  misc_feature: GYAE6OF02G0ED8.4.47.E03.1.454.CMB.1.raw
  modified_base (226)..(226): a, c, t, g, unknown or other
  misc_feature (226)..(226): n is a, c, g, or t
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatcacctactctgganatgcattgccataccagcagaagtcagaccaggcccctgttctggtcatctgtggagacaccaaacgaccctccgggactccctgagagtattcctctcggctccagctcgagggacaatcggccaccttgactatcgaggtcggggcccgaggtggaggagtcgaacctgactactattgttactacaacagacagcagtgactaatcgtagttggggtgttcgggcgggaggagtacgaagtctacggtacccgtcgtacggtcacgcccgaaggccgtccggcccccgtcggtcctaccgttcttaccccgg

SEQ ID NO: 187488 - DNA, 720 bp, Homo sapiens
  misc_feature: GYAE6OF02HDPGC.4.47.E03.1.454.CMB.1.raw
tcagagcactgtagcacgaccggtgctcgatttagactcgcgcacagagagaagggggtggctcaggaggcagagctctgggaatctcaccatggcctggacccctctcctgcctccccctcctcactttctgcacagtctctgaggcctcctatgagctgacacacgcccacccgtggtgtcagtcgtccccgaggaccaaacggccaggactccaccgtactctggagatgctattcgaccataccagccgaagacgtcaacgaccgacgtcccttgttctcggtcatcgtgtacggactaccgaaccgaaaccggtccccgtacgggacttcccgtaggacgtacgtactttcctcgtacggcctccgacgcctacggaacgggactaacgtcggccttaccgtacgacttacgtcgagggtcgggaccgtagggtagggacgtagtaaccggtaacctcgtaaccttaacgttacgttacttaaccgtacaaacgacgtacagtacgtacgttacgacttaacgccgttaagggtcggggttagtaccggggtagggtacggtaacgtacgaacggtaccgtacggtaccccgttacgtaaccgggtacgacccggtaacccggtaccgggttccccgttacccgggttaccccccgttccggttaccccgttaacccgtttacccggtttaccccgttaccccccgttacccccg

SEQ ID NO: 187489 - DNA, 633 bp, Homo sapiens
  misc_feature: GYAE6OF02G290M.4.47.E03.1.454.CMB.1.raw
  modified_base (224)..(224): a, c, t, g, unknown or other
  misc_feature (224)..(224): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctactctgganatgcattcgccataccagcagaagtcagaccacggcccctgttctggtcatctgtggagaccaccaaaccgaccctccgggactcccgtgagacgtattcctcgtggctccagctacgagggtacaagtcggaccctaccgttagacctatcgacgggtcggggacccgtaggggtggacgggtagtacggtaaacctgtaaccttacttagttacgtttaactacgaaacgaagacgaacgtctagtagtactaatcgtaggttggggttggttaccgggcggggtaaggtacgtacgaagtcgtacgtacccggtcgttaacgggtccgaacggacccgtaacgggccgtacccgaccccgttcggttacccgtacccgttaccgtttcccgttaccccctaccccg

SEQ ID NO: 187490 - DNA, 789 bp, Homo sapiens
  misc_feature: GYAE6OF02GME4T.4.47.E03.1.454.CMB.1.raw
  modified_base (222)..(222): a, c, t, g, unknown or other
  misc_feature (222)..(222): n is a, c, g, or t
tcagagcactgtagcacgaccggtgctcgatttagactcgcgcacagagaggagggggtgggctcaggaggcagagctctgggaatctcaccatggcctggacccctctcctgctccccctcctcactttctgcacagtctctgaggcctcctatgagctgacacagccaccctggtgtcagtcgtccccaggacaaacggccaggatcacctactctgganatgcattgccataccagcagaagtcagaccaggcccctgttctggtcatctggtggacgacaccaaaccgcccgtccgggactcccctgagagattccgtcgtcggctccagctacgagggactaagtcggacctacttcgaacttagtccgaggggtccggggacccgtagggggtcgggaacgggtagtacggtaacccgtaggtaaaccctttaacgttaagtttaccggttttaaccctaaccggtaaacctaaacgggaacctaaacggtaccgtaagggtttacggtaaccctttaaaagttaccgttaaacgggggtttcgggggggttacgggtttttacccggggggaacggggtaaacgggggttaacgttaacggtaaaaccgggtccggttaccgggttaacccccgggttccggtttaaccgggggtacccctaacccggggtaacccccggtaaaccgggtccccggttacccccggtcccccccggttacgggtttaccccctaacccccggttttcgtttacccccgggttacccccccttaacccccccg

SEQ ID NO: 187491 - DNA, 584 bp, Homo sapiens
  misc_feature: GYAE6OF02I1G8G.4.47.E03.1.454.CMB.1.raw
  modified_base (436)..(436): a, c, t, g, unknown or other
  misc_feature (436)..(436): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggactcacctactctggagatgcattgccataccagcaagaagtcagaccacggcccctgttctggtcatctgtggagacaccaacgccctcggactcccgtgagagacttctcgtggcctccgagcctacgacgggacaagtcggcctacgttgactatcgaggtcggggccagggtggaggatacgaacctgacttacttagttagttacctacaacagacagctagtnactaatcgtagttcggggtgttccggggaggagggtatacgaacgtcgtacggacccgtacggtacggtccgaccgacccgaacggtccgtacccggtacccccggtcggttaccctaccgttccgtttcccgttaccccctaccccg

SEQ ID NO: 187492 - DNA, 681 bp, Homo sapiens
  misc_feature: GYAE6OF02I9O8I.4.47.E03.1.454.CMB.1.raw
  modified_base (223)..(223): a, c, t, g, unknown or other
  misc_feature (223)..(223): n is a, c, g, or t
  modified_base (348)..(348): a, c, t, g, unknown or other
  misc_feature (348)..(348): n is a, c, g, or t
tcagagcactgtagcacgaccggtgctcgatttagactcgcgcacagagagaaggggcgtgtgggctcaggaggcagagctctgggaatctcaccatggcctggacccctctcctgctccccctcctcactttctgcacagtctctgaggcctcctatgagctgacacagccaccctggtgtcagtcgtccccaggacaaacgggccaggactccaccttacnctggagatgcattgccactaccagcagaacgtcacgaccaggcccctgttctggtccagtctgtggagacaaccaaccgaccccgtccgggactccctagacgagtacttctcgtggcctaccgngctacgagggactaacgcggtaccctaacccgtttggaaccttatccgtaacgggtccgggggtacccctagggggtacgggaacggtagtaccggtaaacctcgggtaacctttaactaagtttcggttaaccgtactaaccgtaacgacacggacctagggcgtacttaactaccgtaagttcggggtagggtttccggggaccgggtagggtaacttccggaacgttccgtacggaccccggttacgttacgggtaccaacccggtacccgtaacgggtacccgttccccggacccccgtttcgggaccttacccgttcccgttcccggg

SEQ ID NO: 187493 - DNA, 492 bp, Homo sapiens
  misc_feature: GYAE6OF02GLDSD.4.47.E03.1.454.CMB.1.raw
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
  modified_base (401)..(402): a, c, t, g, unknown or other
  misc_feature (401)..(402): n is a, c, g, or t
  modified_base (404)..(404): a, c, t, g, unknown or other
  misc_feature (404)..(404): n is a, c, g, or t
  modified_base (406)..(406): a, c, t, g, unknown or other
  misc_feature (406)..(406): n is a, c, g, or t
  modified_base (412)..(412): a, c, t, g, unknown or other
  misc_feature (412)..(412): n is a, c, g, or t
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgaccctccgggatccctgagagattctctggctccagctcagggacaatggccaccttgactatcagtgggcccaggtggaggatgaactgactatattgtaccacananagnngngntatatntggtggtgcggaggagnagngngacgtctcgtgcgaccacgcgtcgcccgtcccgtcgcctctcgtcccgtccctccccg

SEQ ID NO: 187494 - DNA, 562 bp, Homo sapiens
  misc_feature: GYAE6OF02FL767.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtgagacaccaaacgaccctcgggatccctgagagattctcgtggctccagctcgagggacaatggaccacttgactatcaggtcggggccaggtggagatcgaaccgtgactactatagttactacaacagaacagcagtcgactaagtcaagttgggggtagttcgggacgggagggtaatacgaacgtcgtacggtacccgtaccgtaacgggtccgaacggacccgaaggtcccgttacccggtaccccccgttcggtacccctaccgttccgttacccccg

SEQ ID NO: 187495 - DNA, 747 bp, Homo sapiens
  misc_feature: GYAE6OF02J1KMF.4.47.E03.1.454.CMB.1.raw
tcagagcactgtagcacgaccggtgctcgatttagactcgcgcacagagagaagggggctgtgggctcaggaggcagagctctgggaatctcaccatggcctggaccctctcctgctccccctctcactttctgcacagtctctgagcctcctatgagctgacacagccaccctggtgtcagtcgtaccccaggacaaacggccaggactccacctactcgtaggagatgctagttcgaccataccacgacaagtaacgtcagaccgacggtcccctagttcctggtcattctggtggaacgactaacccgaaaccgtaccccgtccgggtacctacccgtaggaacgtagtactttcgtacgtcggaccttccgacgtaccgtaccggtaacggggaactacgtaccgggtaccctaaccgtttacggaaccttaagtaccgtacggggtacggggtcccgtaaggggtcggtaaaggacgtaccggtaaccgtagtaacccttacttagtttccggttaacctactaaccgtagaccgtagtacgtaggtacgaccttaagtacggtaacggttacgggggttacgttaccgggggtacgggtaacggtaaccggttaacctaacgggccgttaccgggtaaccccgttaaacgggtacgtaaccggtacccggtaaccccggtaaggtcccgttaaccccgggccccgtttacccggtaccgttacccttccgggtttaccccc

SEQ ID NO: 187496 - DNA, 659 bp, Homo sapiens
  misc_feature: GYAE6OF02FOTGS.4.47.E03.1.454.CMB.1.raw
tcagagcactgtagcacgaccggtgctcgatttagactcgcgcacagagagaagggggctgtgggctcaggaggcagagctctgggaatctcaccatggcctggaccctctcctgcctccccctctcactttctgcacagtctctgaggcctcctatgagctgacacagcccacccgtggtgtcagtcgtcccaggacaaacggccaggactccacctactcgtggagatggctagttcgccaataccagtacaaggaacgtcaacgaccacggcccctgttctggtctatcgtgtgacgtacaaccgaaaccgcccgtccgggtactccctaggacgtagtacttctcgtcgcctacgacgctacgacgggacaagtcgacctacgttacgactactacgacgggtcggggaccgtagggtcgggtaaggtacgtacgtaaccgtacgtaacttacgttaacgtttcgttaactaccgaaacgtacgacgaacgtacgtaggtacgtacgttaactcgtagggttcgggttcggttacggggacggtagggactacgaacgtcgtaccggaccggttccggtaacggtaccggaaccgacccggtacggtcccgtacccggtcccccggtacgtaccgtacccgttcttacccccggg

SEQ ID NO: 187497 - DNA, 627 bp, Homo sapiens
  misc_feature: GYAE6OF02FXAF7.4.47.E03.1.454.CMB.1.raw
tcagagcactgtagcacgaccggtgctcgatttagactcgcgcacagagagaagggggtgggctcaggaggcagagctctgggaatctcaccatggcctggaccccctctcctgctccccctcctcactttctgcacagtctctgaggcctcctatgagctgacacagccaccctcggtgtcagtcgtccccaggacaaacggccaggatccacctactctggagatgcattgccataccagcagaagtcagaccacggcccctgttctggtcatcgtgtggacgacaccaaacgccccgtccgggactcccgtagacgacgtattctcgtcggcctccgagcctacgacgggactaagtcggacctaccgttacgacttactcgaggtccggggacccgtaggggtcggaagggtactacggaaccgtgtaccttacgttagttcgttaactaccgaacgtagacctagctagtacgacttaagtcgaggttgggtcgttagggacgggtagggtatacgaaggtctacgggtacccgttacgtacgggtccaaccggtacccggaagggtccctcccggtaccccgttcggtaccgtccttcccgttaccgttccccctaccccg

SEQ ID NO: 187498 - DNA, 663 bp, Homo sapiens
  misc_feature: GYAE6OF02HMWY1.4.47.E03.1.454.CMB.1.raw
  modified_base (226)..(226): a, c, t, g, unknown or other
  misc_feature (226)..(226): n is a, c, g, or t
  modified_base (280)..(280): a, c, t, g, unknown or other
  misc_feature (280)..(280): n is a, c, g, or t
tcagagcactgtagcacgaccggtgctcgatttagactcgcgcacagagagaagggggtgggctcaggaggcagagctctgggaatctcaccatggcctggacccctctcctgcctccccctctcactttctgcacagtctctgaggcctcctatgagctgacacagcccaccctcggtgtcagtcgtccccaggacaaacggccaggactcacctactcgtggantgcattgccataccagcagagtcagaccacgccctgtctggtctatctgtgganaccaaccaaacggaccctcgggactccgtaggacgagtattcgtctcggtcctccgagcctcgaagggacctaagtcggtacctacgtttgaacttacgtcgagggtccggggacccgtagggtacggaacggtagtaacggtaaacccgtggtaaaccttaacgtttaagtttaccggttaacctacggtaaacgaaacgtacgaacgtacgtaagttcggaacttaaagtccgtaagggttagggggttccgttacgggacgggacgggtaatacccggaaagtccgtaggtacccgttaccggtacgtaccggcgtaaccgacggtcccgtaccgtccccggtaggtccctaccgtttccgtacccggttcccccgtccc

SEQ ID NO: 187499 - DNA, 629 bp, Homo sapiens
  misc_feature: GYAE6OF02F1I5T.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagccaccctcggtgtcagtcgtcccaggacaaacggccaggatcacctactctggagatgcattcgccataccagacagaagtcagaccacggcccctgttctggtcatctggtggacgaccaaccaaaccgaccccgtccgggactccccgtagagagtacttcctcgtcggtcctccagtcctacgaagggaccaagtcggaccctacgttcgaaccttataccgtagggtccggggacccgaggggtcggaaggtagtacggaaccgtgtaaccttaacttacgtttacgttacctacgaaactacgacagctagtacgacttaagtacgtagggttcggggttcggttacggggacgggtagggtactacggaacgtcgtacggcccgttacggtacggtccgacgacccgaaggtcccgtaccgtcccccgtcggtcctaccgttccgttccccgg

SEQ ID NO: 187500 - DNA, 670 bp, Homo sapiens
  misc_feature: GYAE6OF02GBB9O.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacacgccaccctcggtgtcagtcgtccccaggacaaacggccaggatccacctactcgtggagatgctattcgccataccagcagaagtcagaccacggccctcgttctggtcatctgtggagacaccaaaccgacccgtccggactcctcgacgacgtacttctcgtcgtctccgacgtccacgttttttacgggaacgtaacgtacggtacctaccgttacgtaactactacgtacggtcggggacccggagggtagggacggtacgtacgtaacgtacgtaacgttaacttacgtttacgttaactactaacgtaacgaacacgacgtacgtagtactaacgttacgtacggttggggttcggttacgggtacgggtaacgggtacgtacggaacgtacgtaccggtaccgttaccgttacggtacgacgacccggtaaccggtccgtcccggtccccgttaccggttcccgtaccgttcccgttcccgttccccgtacccccg

SEQ ID NO: 187501 - DNA, 692 bp, Homo sapiens
  misc_feature: GYAE6OF02H9FJF.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgcctccccctcctcactttctgcacagtctctgaggcctcctatgagctgacacagcccaccctcggtgtcagtcgtcccaggacaaacggccaggatccacctactcgtaggagatgacattcgccataccagcaagaacgtcaacgaccgacggtccccttgttcgtggtacattcgtgtaggaacgtaaccaacccgaaaaccgtccccgtaccgggacttaccccgtggaagtacgtacttccgtcgtcggacctcccgagtccgtacggaacgggaactaacgtccggacctacgttacgactacgtccggacgggttcggggacccgtaggggtacggacggtaagtacggtaacctgtaaccttagttacgtttagttaaccacgtaaacacgacacgactagtcgtaacttaagtcgtaagggttggggttcgtaccggggacggtacgggtaactaccggacgtaccgttaccggtaccggtaccggtacggtaccgaacccggacccgtacggtccctacccggtacccccgttaccgggtaccttacccggttccgttacccccgg

SEQ ID NO: 187502 - DNA, 816 bp, Homo sapiens
  misc_feature: GYAE6OF02FLA68.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgcccataccagcagaagtcagaccaggccccctgttctggtcatctgtggagacaccaaacgaccctccgggatcccgtgagagtacttctactggcttccagtctacgaggggtaaccaagtcggacctaccgttgaaccttatccgagggttcgggggaccccaaggggttacgggaagggacgtacgaaacccgtggtaacccttaaacgttaacgtttacggttaaccctacctaaaaccgtaacgtaaccgaagtacccgtaagttaccgggtaaccttaaaacgttccggtaaacgggtttacgggggggtttaccgggttttttaaccgggggggaacccggggggtttaaacgggggggtaactttaaacccgggtaaaaccggggttacccggtttaacccgggggtttaaacccccggggtttaccccggtttaaacggggggtttaaccccaaaccggggtaaacccccggtaaacggggggtaaccccttccccggggtaccccccccgtttacggggtttacccgaacccgttttaccccgttcccgggtttaccccccgtttaaccccccccg

SEQ ID NO: 187503 - DNA, 825 bp, Homo sapiens
  misc_feature: GYAE6OF02HM1O0.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctagacacagccaccctcggtgtcagtcgtcccaggacaaacggccaggatcacctactctggagatgcattgccataccagcaagaatcgaagaccacggccccctgttctgtcatctgtggacgacaaccaaaccgacccgtccgggactccccgtagacgagtacttctgtcggcctaccagtccgtcgaacgggacaacgttcggaccctaaccgtttgaacccttaacgtacgtaacgggggttaccggggtaccccggtaaagggggttacggggtaacggggaaacgttaacgggtaaacccccgtttaaggggtaaaccctttacgtttaaacgttttaaccggtttaaaccgttacccgtaaaaaccgtaacggtaaacccgaaacggtcccgttaaagggtacggttaaacttaaacgttacggttaaacggggtttcgggggtttaacgggtttaccgggggtacggggtaaacggggtaaccgttacgtaaaacggggtcccgttaaccgggtaccccgggtttaaccggttacgggttaaccggacccggtaaccccggtaaacggggtccccgttaccccggccccccggttttacgggtaccccgtttaacccgtcccggttttacccggttcccccccgtttaacccccg

SEQ ID NO: 187504 - DNA, 648 bp, Homo sapiens
  misc_feature: GYAE6OF02H5Q6D.4.47.E03.1.454.CMB.1.raw
  modified_base (170)..(170): a, c, t, g, unknown or other
  misc_feature (170)..(170): n is a, c, g, or t
tcagagcactgtagcacgaccggtgctcgatttagactcgcgcacagagagaagggggctgtgggctcaggaggcagagctctgggaatctcaccatggcctggacccctctcctgcctccccctctcactttctgcacagtctctgaggccctcctatgagctgacacngcccaccgtggtgtcagtcgcccgaggaccaaacggccaggactccacctactcgtggagatgctattcgaccataccagcaagaagtccgacgaccacggtcccttgttctggtcatcgtgtaggacaccaaccgaaaccggcccgtcgggactcccgtaggagtagtacttctcgtcggctccgagtcgtacgagggaacaacgtccggtacctacgttagaccttacgtcggtacgggtccggggaccgtagggtacgggaaggtagtacggtaacgtcgtaaccttaacgttacgtttacgttaacctacgaaacgtacgaaccagtacgtacgttagtacgttaagtcgtagggttggggttacgtcgggagggaggtactagacgtcgtaccggtaccgttcggtacggtaccgaaccgaccgtacggtccgtcccggtccccgttggtacccttaccgttcccgttcccgg

SEQ ID NO: 187505 - DNA, 561 bp, Homo sapiens
  misc_feature: GYAE6OF02FKBQK.4.47.E03.1.454.CMB.1.raw
  modified_base (384)..(384): a, c, t, g, unknown or other
  misc_feature (384)..(384): n is a, c, g, or t
tcagagcactgtagcacgaccggtgctcgatttagactcgcgcacagagagaagggggctgtgggctcaggaggcagagctctgggaatctcaccatggcctggacccctctcctgcctccccctcctcactttctgcacagtctctgaggcctcctatgagctgacacagcccaccctcggtgtcagtgtccccaggacaaacggccaggatcacctactctggagatgcattgccataccagcagaagtcagaccaggcccctgttctggtcatctgtggagacacaaaccgcccgtcgggactccctgagagtattctctggcctccgagctcgagggacaagtcgcctaccttgactatcgacggtcggggacccagggnggtaggatacgaacgtgactactagttcgttactacaacagacagacagtagactaatcgtagttggggttagttcgggcggaggtatacgaagtcgtacggtacccggttccgtacggttaccgacggtacccgaaggcctcccggtcccccgtcggtacctacctcgttccccgg

SEQ ID NO: 187506 - DNA, 677 bp, Homo sapiens
  misc_feature: GYAE6OF02GXYZK.4.47.E03.1.454.CMB.1.raw
  modified_base (227)..(227): a, c, t, g, unknown or other
  misc_feature (227)..(227): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgacgctgacacagcccaccctcggtgtcagtcgtccccaggacaaacgcgcagactcacctactctagganatgctagtcgacctacaccagacgaagaacgtcaacgaccgaccggtcccttgtcgtggtactagtcgtggtacggaacgaaccctaaccgaaacccggacccgtacggacctccgtagacgacgtacttcctacgtcgtcctacggtacgtcgtacggaacggtaactaacggtccggacccttacgtacgtaactacgcggtacggggtccgggacggtagggtaggagtacgtaacggtaccgtagtaacttacgttattaccgtacctaacgaacacgtaacgtagacgtagtacgtaactaagtacggtagggttcgggttacggtaccggggtaggaggtaacctaaggaccgtccgtacggtaccgtcggtaaccgacgtaaccgtaccggacggtaccgtcccggacccgttccggtactaccgttcccttacccgtacccc

SEQ ID NO: 187507 - DNA, 551 bp, Homo sapiens
  misc_feature: GYAE6OF02GE5ZP.4.47.E03.1.454.CMB.1.raw
  modified_base (314)..(314): a, c, t, g, unknown or other
  misc_feature (314)..(314): n is a, c, g, or t
  modified_base (428)..(428): a, c, t, g, unknown or other
  misc_feature (428)..(428): n is a, c, g, or t
tcagagcactgtagcacgaccggtgctcgatttagactcgcgcacagagagaagggggtgggctcaggaggcagagctctgggaatctcaccatggcctggaccccctctcctgcctccccctcctcactttctgcacagtctctgaggcctcctatgagctgacacagcccaccctcggtgtcagtgtccccaggacaaacggccaggatcacctactctggagatgcattgccataccagcagaagtcagaccaggcccctgttctggtcatctgtggagacaccaaacgaccctccgggatcccctgaganattctctggctccagctcgagggacaatcggcctaccttgactatcgaggtcggggacccgagggtggaggagtagaacctgactactattgttactcaacagacagacagtcnctaatcagtggggttgttcgggcgggagggatagaaacgcgtagaccgtacgtaggtcacgacccgaacggccgtccggtcccccgtccggttcctaccgtccgttccgttccccgtcccccg

SEQ ID NO: 187508 - DNA, 781 bp, Homo sapiens
  misc_feature: GYAE6OF02GV2FQ.4.47.E03.1.454.CMB.1.raw
tcagagcactgtagcacgaccggtgctcgatttagactcgcgcacagagagaaggggctgtgggctcaggaggcagagctctgggaatctcaccatggcctggacccctctcctgcctccccctctcactttctgcacagtctctgacggcctcctatgagctgacacacgcccacccgtcggtcgtcagtcgtccccaaggaaccaaaccggccaaggactccaacctactcgtggagatgctattcgaccactaccagcaagaacgtaccaacgaccgacggtcccccttgttccgtggtacctagttcgtaggtggaacgtaaccaacccgaaaccggtaccccgtccggggaacttcccgtaggtaacggacgtacttcctacgtcggtacctccgagccgtacgaaggaactaacgtcggtaccctaccgtttacgtaacttacgtcgtaacgggtccgggggacccgtaaggggtcggaaagggtacgtacggtaaaccgttcggtaacttaacgttaacgtttacgtttaaccgttaaccgtaaacgaactaaccgtaacgtaaccgtagggtaccgtaacgttaaacgttaccggtaagggtttggggggttcggttaccgggggaagggtaacgggtaaccgtaccggaaacggttccgttaaccggtcccggttaaccggttaccgggtaaccgtaacggtaccccggtaacgggtacccggttccccggtacccccggttcggtaccctaccggtttccccttaccccgg

SEQ ID NO: 187509 - DNA, 777 bp, Homo sapiens
  misc_feature: GYAE6OF02JJ9D1.4.47.E03.1.454.CMB.1.raw
  modified_base (239)..(239): a, c, t, g, unknown or other
  misc_feature (239)..(239): n is a, c, g, or t
tcagagcactgtagcacgaccggtgctcgatttagactcgcgcacagagagaagggggtgggctcaggaggcagagctctgggaatctcaccatggcctggacccctctcctgcctcccccctcctcactttctgcacagtctctgacggcctcctatgagtctgacacacgcccacccgtcggtgtcagtcgtccccgaggaaccaacggccaggactccacctactctaggagatcnctagtcgccagtaccagcaagtaacgtcaacgaccgaccggtcccctgttaccgtggtacctatcgtgtaggacgaacctaacccgaaaccggtaccccgtccgggacctcccgtaggaagtacgttacgttaccgttcgtcggtacctaccgtacgtaccgtaccgtaagggaacctaagtcggacccttacgttacgtaacttacgtaccggacggttccggggacccgtaaggggtacgggtaacgtagtaccgtaaccgtacgtaaccgttaacgttagtttacgttaccctaacgaaacgtacgaactacggagttacgtcggaaccttaacgtactaacgggttcggggttacggtaccgggtaacgggtaacgggtacgttaaacggtaacgttaccggtaccgttacccgggtaccgttaaccgggtcccggtaacctaacccgggtaacgtcccccggttacccggtacccccggtcggttacccgtacccgttttcccgggttaccccggtttccccccgtacccccg

SEQ ID NO: 187510 - DNA, 777 bp, Homo sapiens
  misc_feature: GYAE6OF02FNAB3.4.47.E03.1.454.CMB.1.raw
  modified_base (225)..(225): a, c, t, g, unknown or other
  misc_feature (225)..(225): n is a, c, g, or t
tcagagcactgtagcacgaccggtgctcgatttagactcgcgcacagagagaagggggctgtgggctcaggaggcagagctctgggaatctcaccatggcctggacccctctcctgctccccctctcactttctgcacagtctctgaggcctcctatgagctgacacagccaccctcggtgtcagtcgtccccaggacaaacggccaggatcacctactctgganatgcattgccataccagcagaagtcagaccacggcccctgttctggtcatctgtgagaccaccaaaccgaccctccgggactccctgacgagtactttctcgtcggctccgacgtctacgaagggacctaagtccgggaccctaacccgttgtaaccgttactaccggtaacgggtccggggggtacccggtaaggggtcggggaacggggtaattaccgggtaaaacccgttggtaaaccgtttaaccgtttaacgttttacggtttaaacccgttaccgtaaaaccgtaacgtaaaccgtacggaccgtaaacgggttcgaaccgtttaaacgttaccgtaacggggtttaggggggtttaccggtttaccggggggaaccggggtaaacggggtaatttaccggaaaccggggtccgttaaccgggtaacccgggtttaacccggttaggggttaccccgtaaccgggtaccccgtaacggggtacccgtttaccccggtccccccggttacccgggttacccttacccggttcccgtttacccccggg

SEQ ID NO: 187511 - DNA, 789 bp, Homo sapiens
  misc_feature: GYAE6OF02JDHK8.4.47.E03.1.454.CMB.1.raw
tcagagcactgtagcacgaccggtgctcgatttagactcgcgcacagagagaagggggtgggctcaggaggcagagctctgggaatctcaccatcggcctcggacccctctcctgcctcccccctctctactttctgcacagtctctggacggcctcctatgagctagacacacgcccacccgttcggtgtccaggtccgtaccccgaaggaaccgaaaccggccaaggactaccaaccttactcgtaggagatgcctattcgacctacaccagacaaggaacgtcaacgaccgacggtcccttgttcgtcggtactagtcgtggtaacggaacgaccaaacccgaaaccggtaccccgtcgggtacctacccgtagaacgtacgttaccttcgtccgtggtacccacgaccgtacgtacgaaacgggtactaacggtccggtaaccctacgttagtaacttacgtaccgggtaggggtccgggaccgtaaggggtacggaaggacttaaccggtaactgttaaaccgttatttacgttaaccgtactaaccgaacgaagtaccgtaacgacgtacggtactaaccgttaattcggtacgggtttacggggttcggtaacggggtacgggtaaacggttactaacggtaacggttacccgtaccgggtaaccccgtttacggtaacggggtcccaaacccgggaccggttacccggtaccccggtccgttaacccccgggttgtaaccccgttcccgtttacccgtttaccccggtaccccccttaccc

SEQ ID NO: 187512 - DNA, 647 bp, Homo sapiens
  misc_feature: GYAE6OF02F2Z48.4.47.E03.1.454.CMB.1.raw
  modified_base (167)..(167): a, c, t, g, unknown or other
  misc_feature (167)..(167): n is a, c, g, or t
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacncagccaccctcggtgtcagtcgtccccaggaccaaacggccaggatcacctactctggagatgcattgccataccagacagaacgtcacgaccacggcccctgttctcgggtcacttctggtaggacgaccaacccgaaaccggacccgtccgggacctcccgtagacgagtacttcctcgtcggtcctccgacgtctcgaacgggacaaagtcggccctaacgtttcgaacctacgtaccggtacgggttccggggacccgtaggggtacgggaagggtagttaccggaaaccgttacggtaaccgttaaccgtttagtttaccgtttaactaaccgaaaccgtacgaacgtacggaccaagggttccgacttaagtcgtagggtggggttacgttcgggacgggtagacgtacgagttcgacgaccgttcgtacggctaccgacgacgcgtacccgcccgttgcctcgtccgtccccg

SEQ ID NO: 187513 - DNA, 748 bp, Homo sapiens
  misc_feature: GYAE6OF02FVXAA.4.47.E03.1.454.CMB.1.raw
  modified_base (224)..(224): a, c, t, g, unknown or other
  misc_feature (224)..(224): n is a, c, g, or t
  modified_base (281)..(281): a, c, t, g, unknown or other
  misc_feature (281)..(281): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatccacctactctgganatgcattgccataccagcagaaatcagaccaggcccctgttctggtcatctgtgganacacaacgaccctcgggatccctgacgagtacttctctggctccagtcctacgacgggtacaaagtcgggaccctaacgttcgaaccttaattccggaaacgggttccgggggacccctaagggggtacgggtaagggaacttacgggaaaaccctgggtaaacccttacgtttaaacgtttacggtttaaacccttaccgaaaccgtaaggtaaccgtaggtaccgtaaacggtcggtaaccttaaagttaccggtaagggttacggggggtttacggttttaccgggggacggggttaaacggggtaactaacggtaaacggttccgtaccgggtacccgggtttaccgtaaccgggttccggaaaccgtaccccgggaaacgggttcccgtacccggtacccccccggttagggtaaccccctaccgtttacccggtttcccggtttcccccgttaccccccgg

SEQ ID NO: 187514 - DNA, 688 bp, Homo sapiens
  misc_feature: GYAE6OF02GF2Q3.4.47.E03.1.454.CMB.1.raw
tcagagcactgtagcacgaccggtgctcgatttagactcgcgcacagagagaagggggtgggctcaggaggcagagctctgggaatctcaccatggcctggaccctctcctgctccccctcctcactttctgcacagtctctgaggcctcctatgagctgacacacgcccaccctcggtgtcagtcgtccccaggaccaaacggccaggactccacctactcgtaggagatgctattcgaccataccagcaagaacgtcacgaccacggtcccctgttcgtggtcattctggtacggacaccaccgaaaccgcccgtcgggactcccgtagacgagtacttctacgtcggcctaccgagtcctcggaaggaccaagtcgacctacgttgaacttctacgagggtccgggacccgtaggggtacggaaggacgtacgtacccgtacgtaacttacgttatttacggttaaccctacaaacgtacgaacgtacgtacgtagtacgtacttaactcggtaacggttcggggttacgttcgggagggtacggtactacggtaaacgtccgtaacgggtacccgttacggtacggttaccgaccggtaccccgtaagggtaccccgttcccggtacccccggttacggtacccttaacccggttcccgtttacccgttcccccgttacccccg

SEQ ID NO: 187515 - DNA, 673 bp, Homo sapiens
  misc_feature: GYAE6OF02F7SVU.4.47.E03.1.454.CMB.1.raw
  modified_base (226)..(226): a, c, t, g, unknown or other
  misc_feature (226)..(226): n is a, c, g, or t
  modified_base (282)..(282): a, c, t, g, unknown or other
  misc_feature (282)..(282): n is a, c, g, or t
tcagagcactgtagcacgaccggtgctcgatttagactcgcgcacagagagaagggggctgtgggctcaggaggcagagctctgggaatctcaccatggcctggacccctctcctgctccccctctcactttctgcacagtctctgaggcctcctatgagctgacacagcccaccctcggtgtcagtcgtccccaggacaaacggccaggatcacctactctgganatgcattcgccataccagcagaagtcaagaccacggccctgttctggtcatctggnggacgaccaaccaaaccgaccctccgggaactccccgtaggaacgacgtaactttcctcgttcggacctccgtacgctacggaacgggacaagtcggacccacgttagaccttagtacgaggtccggggaccgtagggtacggaggtacgtacggtaacccgtagaacgttaacgttattacgtttaacctactaaaccgacgtaacacggactaacggtacgtaacttaagttccgaggttcggggttcgggttacgggacggtagggtactacggtaacggtacgtacggtacccggttacggtacggttaccgtaacggacccggtaacggaccggttacccggaccccccgtttacgggtaccctacccgttaccgtttacccccgg

SEQ ID NO: 187516 - DNA, 600 bp, Homo sapiens
  misc_feature: GYAE6OF02GVMJ3.4.47.E03.1.454.CMB.1.raw
  modified_base (239)..(239): a, c, t, g, unknown or other
  misc_feature (239)..(239): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctggtgtcagtcgtccccaggacaaacggccaggatcacctactctggagatgcattgaccataccngcagaagtcagaccacgcccctgttctggtcatcgtgtggacgacaaccaaaccgacccgtccgggactccccgtgacgaagtactttcctcgtcggctaccgagtcctacgaggggacaagtcgaccctaccgttgaacctatcgaggtccggggaccagggtcggaggtactacggtaaccgtgtaactacgttacttacgttaacctacgaacgtaagacacgtacagtgtactaatcgacgtgggttcgtgggacggtaaggctacgaagtcgtacgaccgttacgtacgggtacacgacccgtaaggcctaccgtccccgtcggttacctccgtaccgttccgttccccgtccccg

SEQ ID NO: 187517 - DNA, 563 bp, Homo sapiens
  misc_feature: GYAE6OF02JFZ4T.4.47.E03.1.454.CMB.1.raw
  modified_base (445)..(445): a, c, t, g, unknown or other
  misc_feature (445)..(445): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctactctggagatgcattgccataccagcaagaagtcagaccacggccctgttctggtcatctgtggacaccaaccaaaccgacccgtccgggatcccgtgacgagtacttctctggcctccagtctacgagggacaagtcggcctacgttgactactcgaggtcgggaccgtagggtggagactagaaccgtagacttacttagttacttaacctacaacagacagcagtnactaagcgtagtgggtgttcgggacggtggaatacgaagtcgtacgtaccgtcggtacggtccacgtacccgaaggtcctaccgtccccgtcggtccaccgttctccgtccccgtccc

SEQ ID NO: 187518 - DNA, 602 bp, Homo sapiens
  misc_feature: GYAE6OF02FK31H.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggacgatgcattcgccataccagcagaagtcagaccacggcccctgttctggtcatctgtggagacaccaaaccgcccgtccgggactcccgtaggacgtagtacttctcgtgctccagcctacgacgggaacaagtggaccctaccttacggacttactacgtaggtccggggcccgaggggtacgggagggactgaaccgtgacttaactagttacgttactacaaacagacagacaagtctacttaactcgtaaggttcggggtagttccgggacgggtagggagtcggaagtccgtaggtacccgtacggtacggtccgacggacccgaaggtcccgccggtcccccgcggtcctaccgtccttccgttacccctacccc

SEQ ID NO: 187519 - DNA, 755 bp, Homo sapiens
  misc_feature: GYAE6OF02JOLJL.4.47.E03.1.454.CMB.1.raw
  modified_base (209)..(209): a, c, t, g, unknown or other
  misc_feature (209)..(209): n is a, c, g, or t
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (240)..(240): a, c, t, g, unknown or other
  misc_feature (240)..(240): n is a, c, g, or t
  modified_base (546)..(546): a, c, t, g, unknown or other
  misc_feature (546)..(546): n is a, c, g, or t
tcagagcactgtagcacgaccggtgctcgatttagactcgcgcacagagagaaggggtgggctcaggaggcagagctctgggaatctcaccatggcctggacccctctcctgcctccccctcctctactttctgcacagtctctgaggcctcctatgagctgacacagccacccgtcggtgtcagtcgtccccaggaacaacggcaggntcacctctcngganatgcatgaccataccancagaagtcacgaccgacggccccttagttcctggtctacgtccgttaggtggggaacaccaaacccaaaaccggtaccccggtccgggtacctcccggtacggaacggtaacgttatttcccgttcggtaccggggtccctacccggtagtacccgttacggaacggggaacctaagtaccgggtaccctaccgttacgtaccttaacgtcgtacgggtccggggacccgtaggggtagggacggtagtacggaaacccgtcgtaaccgttattacgttacgttaaccacgaacgtacgaacgtanacgagtcgtacgtaagtcgtaaggttcggggttcggttaccggggacgggtaaagggtacctaaacggtacgtacggttacgaccccggtttacgggcgggttaaacccgtaccggacccgtaaacggtccccggttccccggtacccccccggtttaccggtacccggtttccttaccccggtttcccggttacccccccgtcccccg

SEQ ID NO: 187520 - DNA, 758 bp, Homo sapiens
  misc_feature: GYAE6OF02JKF2Y.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgacgcctcctatgagctgacacacggcccacccgttcggtcgtctaggtcctacccccgaaggaaccgaaaccggtccaggacttcaacccttacctcgtacggagtatcgcctattacgcccaagtaccagacaagaacgacaacgacctacgggtccccttggtttcgtacgttccgacttccgtagggtcgggaacgaacctaaaccccgaaaccccggtaccccgtacccgggactccccggtagaacggtaacgtacgtttccgtacgtccggtactacccgtacggtctaccggaaacggtaactaacgtacggtacccaacgtttcgaacctttaagtccgtaacggggtcgggacccgtaggggtacggacggtatacgaaccgtgtacttacttagttaccttaactaccgtaacgagtacgagcgtaacgtcgtaactacgtcgttaggtcggggtttcgtacgggacgggtaacggttaacacgtacgtaccgtaccggtacggttacctacggggaccgtaaccgacccggtaggtacccttccccggtccccggtacggttaacccgtacccttacccggtttcccctacccccgtacccc

SEQ ID NO: 187521 - DNA, 858 bp, Homo sapiens
  misc_feature: GYAE6OF02ITVZC.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgacggcctcctatgagctgacacacgccaccctcggtgtcagtcgtccccgaggacaaacggccaggactcacctactctaggagatgactagttcgccaactaccagacaagaagtcaacgaccacggccccttgttcgtggtcacttcgtggtacggaacgacctaaaccgaaacccggtaccccggtaccgggtaactaccccgtggaacggacgtaacgtttccgtacgttcggtcctaccgacggtaccgtacggaaacggggtaacctaaacggtccgggtaaccctaaaccgtttacggtaaccttaacgtaccggtaacggggttcccggggggtaacccgtaagggggtacgggtaaacgggtaacgttaaccggtaaacccgttacggtaaaccctttaacgtttaacgtttaacggtttaaccctaaccgtaaaacgtacgtaaaccgtacgtaccgttaacgttacggtaacttaaacgtacggttaaggggttacgggggttttacgggttaccgggggtaacggggtaacggggttaacgtacccggtaaagggttcccgttaaccggtaccccgggtttaacggttaaccgggtaaccctaaccgggtaaccccggtaacggtcccgtaccccggttacccccgggttacggttacccgttaacccgtcccggttttaccccgttcccccctaacccccg

SEQ ID NO: 187522 - DNA, 839 bp, Homo sapiens
  misc_feature: GYAE6OF02HGX7X.4.47.E03.1.454.CMB.1.raw
  modified_base (180)..(180): a, c, t, g, unknown or other
  misc_feature (180)..(180): n is a, c, g, or t
  modified_base (228)..(228): a, c, t, g, unknown or other
  misc_feature (228)..(228): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagcccaccctcggtntcagtcgtccccaggacaaacggccaaggatccacctactcgtagganatgcattcgaccataccagcaagaagtcacgaccacggcccttgttctggtcatcgtgtggacaccaaccaaccgcccgtcggactccgagagagtcttctcgtcggtacctcgacgctacgaaggacacgtcggacctacgtacgtactacgtcggacgggttccgggaccgtaggggtacgggtaacgggaacgtttaaccgggtaaacccgttacggttaaaacccgtttaacgtttaacggttttaacccgtttaaacccgtaacccgtaaaacggtaaccggtaaaccgtaacggtaccggttaacggtttaacgtaaacccgttttaaaacgttccgggttaaacgggggttttcggggggggtttaaccgggttaccgggggtacgggggttaaacgggttaaccgtaaaccgggtaacggtacccgggtttaacccgggtaccccgggtttacccgggttaacccggggtacccgtaaaccccgggtaacccgggtaaaccggggttccccttacccccggggttaccccccggtttaccgggtaccccgttaacccccggttttccccgttacccccggtttaacccccccttaccccccgg

SEQ ID NO: 187523 - DNA, 689 bp, Homo sapiens
  misc_feature: GYAE6OF02FT0QO.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctctactttctgcacagtctctgaggcctcctatgagctgacacacgcccacccgtcggtgtcagtcgtccccgaggacaaacggccaggatccacctactcgtaggagatgctagttcgaccataccgagacaggaacgtcaacgaccgacggtcccctgttcttcggtctattcgtggtacggaacgaaccaaccgaaaacccggtaccccgtaccggggacctcccgtaggaagtacgtacttcctcgtcggcctccgagtccgtacggaacgggaacacgtcggacctacgttacgactatcggacggtcgggacccgtagggtggacggagtacgacgtacgtacttacgttacttacgttaaccacgaacgtaacgacgacgtacgtacgtagtacctaagtacgtagggttacggggttacgggttcggggacgggtaaggtacgtacgtaacgtcgtaccggtacccgttaccgtacgggtacgaccggacccgtaacggtcccgtcccggtaccccgtcggtacctaccgttccgttacccgtcccccgttaccccg

SEQ ID NO: 187524 - DNA, 606 bp, Homo sapiens
  misc_feature: GYAE6OF02IWNLE.4.47.E03.1.454.CMB.1.raw
  modified_base (225)..(225): a, c, t, g, unknown or other
  misc_feature (225)..(225): n is a, c, g, or t
  modified_base (291)..(291): a, c, t, g, unknown or other
  misc_feature (291)..(291): n is a, c, g, or t
  modified_base (395)..(395): a, c, t, g, unknown or other
  misc_feature (395)..(395): n is a, c, g, or t
tcagagcactgtagcacgaccggtgctcgatttagactcgcgcacagagagaagggggtgggctcaggaggcagagctctgggaatctcaccatggcctggacccctctcctgcctcccccctcctcactttctgcacagtctctgaggcctcctatgagctgacacagccaccctcggtgtcagtcgtccccaggacaaacggccaggatcacctactctgganatgctattcgccataccagcaagaagtcgaacgaccgacggcccctgttctggtcatcgtgtgganaccaaccaaccgccctccgggactccaggacgagtacttctcgtgcctccagctacgacggacaagtcgacctacctgactatcgacggtccgggccgtagggngggagagtcgaacgtgactacttattcgttactacaacgtacgacgagcgtagtgtactaactcgagggttggggtcggttacggggcggtaagggactacggacgtccgtacgtaccgtacgtacggaccgacgaccgtaacggtcccgttacccggccccgttacccggtaccctaccggttcccgttaccccgttccccttacccccg

SEQ ID NO: 187525 - DNA, 557 bp, Homo sapiens
  misc_feature: GYAE6OF02I4A4M.4.47.E03.1.454.CMB.1.raw
  modified_base (445)..(445): a, c, t, g, unknown or other
  misc_feature (445)..(445): n is a, c, g, or t
  modified_base (454)..(454): a, c, t, g, unknown or other
  misc_feature (454)..(454): n is a, c, g, or t
  modified_base (469)..(469): a, c, t, g, unknown or other
  misc_feature (469)..(469): n is a, c, g, or t
  modified_base (475)..(475): a, c, t, g, unknown or other
  misc_feature (475)..(475): n is a, c, g, or t
  modified_base (488)..(488): a, c, t, g, unknown or other
  misc_feature (488)..(488): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggactcacctactctggagatgcattgccaataccagcagaagtcagaccacggcccctgttctggtcatctgtggacacaaccaaacgacccgtccgggaactccccgtagacgagtactttcgtcgtggtcctccacgtcctacgaacgggacaagtcggacctacgttcgactagtcgaggtcgggcccgtagggtggagtagtcgaacctgaccttattagttagtactacaacanacagcagtnactatcgagtgggtntcgggnggaggatacgagngtacgtccgtcgtagtcgacgtaccgacgtaccgtcgcccctcgtcctactccgtccgtcccctacccg

SEQ ID NO: 187526 - DNA, 701 bp, Homo sapiens
  misc_feature: GYAE6OF02JD259.4.47.E03.1.454.CMB.1.raw
  modified_base (172)..(172): a, c, t, g, unknown or other
  misc_feature (172)..(172): n is a, c, g, or t
  modified_base (213)..(213): a, c, t, g, unknown or other
  misc_feature (213)..(213): n is a, c, g, or t
  modified_base (229)..(229): a, c, t, g, unknown or other
  misc_feature (229)..(229): n is a, c, g, or t
  modified_base (541)..(541): a, c, t, g, unknown or other
  misc_feature (541)..(541): n is a, c, g, or t
tcagagcactgtagcacgaccggtgctcgatttagactcgcgcacagagagaagggggcgtgtgggctcaggaggcagagctctgggaatctcaccatggcctggacccctctcctcgcctccccctcctcactttctgcacagtctctgaggcctcctatgagctgacacncgccaccctggtgcagtcgtcccaggacaaaccggcaaggntcacctactcgtgganatgcagttcgaccactaccaggacagaacgtccaacgaccaccgggtcccccttggtttcctcgggtctaacgttcctggggtacggaacgaaacccgaacccgaaaacccggacccccggtaccgggtactaccccggtaggaacggtagtacttttcctcgttcggcctcccaagtctaccggaaggaccctaagtccggacccttaccttagaaccttacgtacgagggttccgggggacccgtagggtggggaacgtagtacggtaacctagtaactacgttatttcgtactctaaacgacgtacganccaggtactactacacgtaggttcggggttacggtcgggacggggaaggtacgtacgaagttccgtaacggacccgttaaccggtaggtccaaccgggtacccaacggtcccggttacccggtaccccgtccggtacccgtaccgttcccgttcccccgg

SEQ ID NO: 187527 - DNA, 614 bp, Homo sapiens
  misc_feature: GYAE6OF02FSTCJ.4.47.E03.1.454.CMB.1.raw
  modified_base (367)..(367): a, c, t, g, unknown or other
  misc_feature (367)..(367): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctcggtgtcagtcgtccccaggacaaacggccaggatccacctactcgtggagatgcattgccataccagcagaagtcagaccacggcccctgttctggtcatctgtggagaccaccgaaaccgcccgtccgggactcccgtgagagtacttctcgtcggctccgagctcgagggacaagtcgcctacttgactntcgaggtcggggcctagggtgggagatacggaaccgtgtacttacttagtttacgtaactacaacgagactagactagtcgacttaagtcgtagggttggggtcggttcggggacgggtaagggtatacggaacgtcgtaccggtacccgttaccggtagggtaccgaccggacccggtaacgggtccgtccccggtacccccgtcggttaccctaccgttcccgttccccgttacccctacccccg

SEQ ID NO: 187528 - DNA, 780 bp, Homo sapiens
  misc_feature: GYAE6OF02I35QK.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgcctccccctctccactttctgcacagtctctgaggcctcctatgagctgacacacgcccaccctcggtgtcagtcgtccccaggaaccaaacggccaggatcacctactctaggagatgcattcgaccataccagacagaacgtacaacgaccgaccggtccccttgttcgtcggtactatccgtggtaggaacgaccaacccgaaaccggtaccccggtaccgggtaccttacccggtggaaacgtacgttaccgttaccgttcggtaccggtcctaccgaaccggttccgaccgggaaacggggtaacctaacggttccgggtaaaccccttaaccggtttacgtaaaccttaaccggtaccgggtacggggttaccgggggaccccgggtaaggggtacggggaacggggtaacgtacggtaaacccgttacggtaaaccgttaaccgttaaacgtttacggtttaaccctaaccgtaaacggtacgaaccggaacgtacgtacggttaacgtaacgttaaacgttacggtaaggggttggggttaccgggttacggggtaacgggtaggtaactacggtaacgtcgtaccggtaccgttaacggtacgcgtaaccgaccggtacgaccgtcccgtccccggtgtcctaccgtccgtcccg

SEQ ID NO: 187529 - DNA, 749 bp, Homo sapiens
  misc_feature: GYAE6OF02GCZDZ.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgagcctcctatgagctgacacacgcccacccgtcggtcgtcacgtcgtacccccgaggaaccgaaaccggccgaacgggactacctaacctaccgtcgtagggagagtcgactagttcgaccactaccagccaaggaacgtacaacgaccgaccggtccccttggttcgtcggtcacgttccgtggtacggaacgaccaacccgaaaccggccccgtacgggacctccgtgaagagtacttcgtcgtggccctccgacgtccgtacggaacggtacctaacgtccggaccctaccgttagacctacgttacggacgggtccggggacctaggggtacgggaagtacgttaccgaaccggttcgtaaccttaacgtttacgtttacggttaacctaacgtaaaccgacgaacgtacggtacaacggttcgtaacttaactacggtagggttacggggtggttacggggacgggacgggtactacggtaacggtccgtaccggtaccgttacggtacggaccggtaaccggacccgtaaccgggtcccgtaccccggtaccccggtacggttaccctaccgtttccgttccgttacccgtacccccg

SEQ ID NO: 187530 - DNA, 687 bp, Homo sapiens
  misc_feature: GYAE6OF02J049D.4.47.E03.1.454.CMB.1.raw
  modified_base (227)..(227): a, c, t, g, unknown or other
  misc_feature (227)..(227): n is a, c, g, or t
  modified_base (282)..(282): a, c, t, g, unknown or other
  misc_feature (282)..(282): n is a, c, g, or t
tcagagcactgtagcacgaccggtgctcgatttagactcgcgcacagagagaagggggctgtgggctcaggaggcagagctctgggaatctcaccatggcctggacccctctcctgctccccctctcactttctgcacagtctctgacggcctcctatgagctgacacagcccacccgtggtgtcagtcgtcccaggacaaacggccaggatccactactcgtgganatgcattcgccaataccagcagaacgtcacgaccacggcccttgttctggtcatnggtacgacaccaaccgaaccgacccgtccgggactcccgtagagtacgtacttcctcgttacggcctccgacggccgttacgaacgggtaacaaacggtcggtaccctaacccgtttgaaaccgtactacgggtaaccgggtccgggggtaacccggtacggggtacgggtaaacgggtacggttaaaccggtaacgttacggtaaaccgtttaacgtttacgttacgtttaaccgtaacgtaaccgtaacgtaacgtacgacgtagttacgtaacgttaacgtcggtaagttcgggttacgggttcggacgggtaggtagtacgacgtcgtaacgtccgtcgtacgtacgacgtaccgaacgtcccgtaccgtccccgtacggtaccctacgtccgttaccccg

SEQ ID NO: 187531 - DNA, 778 bp, Homo sapiens
  misc_feature: GYAE6OF02IQ5DL.4.47.E03.1.454.CMB.1.raw
  modified_base (180)..(180): a, c, t, g, unknown or other
  misc_feature (180)..(180): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagccaccctcggtntcagtcgtccccaggacaaacggccaggactcacctactctggagatgcattcgccataccagacaagacgtcacgaccgacggcccttgtctggtcatcgtgtggacgacaaccgaaccgcccgtcggactccctgacgagtattctcgtgtcctccgagcctacgaacgggacctaagtcggaccctaccgttagaccttagtccgaacgggtccggggacccgtaaggggtacgggaacggtaacgtaaccggtaaccgtcgtaaacctttaacgtttacgtttaaccggtttaacctaaccgaaaccgtaacggtaaccgtaaacggtacctaaccgggttaactaaccgtttaaacgttcggttaacggggtttcggggggtttaccggggtttaccggggggtaaccggggttaagggggttaaaccttaccgggaaaacggtcccgttaacgggtaccccgttaacccgggtaacgggttacccaacccgggacccgtaaaccgggtcccggttacccccggtccccccggtttacggttaccccgtaccccggtttacccggttttcccccggtccccccttccccccgg

SEQ ID NO: 187532 - DNA, 695 bp, Homo sapiens
  misc_feature: GYAE6OF02IQSTF.4.47.E03.1.454.CMB.1.raw
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (399)..(399): a, c, t, g, unknown or other
  misc_feature (399)..(399): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgacggcctcctatgagctgacacacgccacccgtggtgtcacgttcgtccccgaggaaccaaaccggccaaggtactccaacccttactcgtgganatgactnttacgccataccagaccagaagtacacgaaccgacgccctgttcgtgtcatcgtgtggacaccgaccaaaccgacccgtccggactccccgtagaacgacgtacttcctcgtcggcctaccagcctgaggtacagtcgacctcgttagactntacgacggtccgggaccgtagggtaggaggtaagacgtactacgtacttaacgttacgttacgttacctaacctaacgaacgaacgtacgactaggtaacgtacttaacgtacggtaggttacggggttcgttaccggggacggggtaacggtacggtacgtaaacggtccgtaccgtacccggttaccggttaccggtaacggtacccggacccggtaacggtccccttacccgggtccccgttacccgggttacgacccccgttttacggttcccccgttaccccgtacccccg

SEQ ID NO: 187533 - DNA, 771 bp, Homo sapiens
  misc_feature: GYAE6OF02GFQQ8.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctcccccctcctcactttctgcacagtctctgaggcctcctatgagctgacacagcccaccctcggtgtcagtcgtccccaggacaaacggccaggatcacctactctggagatgcattgccataccagcagaacgtcagaccacggtccccctgttctggtctactcgtggtaggacgtaaccaacccgaaaaccggtaccccgtccgggacttccccgtaggaacgtacgtatttccgtcgtcggcctcccgaagtcctacggaacgggaacaacgttcggacccgtaccttaggaaccttacgtacgtaacggggtccggggacccgtaaggggtcggggtaaacgggagtaccggtaaaccgttaggtaaccttaacgtttacgttacggtttaacctaccgtaaaccgaagaacgtacgaccgtaacggtacgtacgttaaacgttccggtaaggtttgggggttacggttacggggtacgggtaaagggttaccgtaacggtaaacggtcggttacccggtacccggttacccggttaacgggtccggaacccggtaaccccggtaaccgggtcccgttccccggtacccccccgttcggggttaccccctacccttttccccggttaccccgttaccccccgttacccccc

SEQ ID NO: 187534 - DNA, 737 bp, Homo sapiens
  misc_feature: GYAE6OF02H4NKO.4.47.E03.1.454.CMB.1.raw
  modified_base (242)..(242): a, c, t, g, unknown or other
  misc_feature (242)..(242): n is a, c, g, or t
tcagagcactgtagcacgaccggtgctcgatttagactcgcgcacagagagaaggggctgtggctcaggaggcagagctctgggaatctcaccatggcctggacccctctcctgcctccccctctctactttctgcacagtctctgacgtcctctatgagctgacacacgcccacccgtcggtgtccagtccgtaccccgaggaaccgaaaaccggccaaggactaccaaccttaccttcgngggaagtagtgacctgtccgacaactaccagctaaaggacgtcgaacgacccacggtccccgttgttccgtggtacctagtccgttaggtacggaacaccgtaaacccgaacccgtccccggtaccgggaccttccccgaaggaacgtagttacttccgtccgttcggccctacacgtccttacgacggtaaatcggtccgtacctacgttacggacttacgcgtacgggcgggtacccgtagggtacggaggtacgtcgtaactaccggtacttaacgtacggtttacttaaccgtacgaacgaacacgtagacgtacgtacgtaacttaagtacgttacgggtcgggttacgggttacggggacggtaaagggtacgttagaacgggtccgtacggtaccccgtacggtaccggtaccggtaaccggaaccgtccggccgttaacccccggtccccgtttaccggccctttacccggttcccgttacccccgg

SEQ ID NO: 187535 - DNA, 932 bp, Homo sapiens
  misc_feature: GYAE6OF02I8GLY.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgaccacacgcccacccgtcggtgtcagttcgtaccccgaggaaccgaaaccggccgaggactccaaccttacctcgtaggaacgtagtcgacctagttcgaccctaactaccgacggacgaaaggtaacggtaccgaaccggtaaccccgacccgggttcccccgttaggtttaccgtcgggttaccaacgtttccgttagggtacgggaaaccgtaacccgaaaaccccgtaaaaaccccggtaacccccgggttacccggggtaaacccttcccccggtaagggtaaacggtaacggtttaaccttttccgtaccggttccgggtacccttacccgaaacggtccggtaccggtaaaacggggtaacctaaaacggttccggacccccgtttaaaccgttacgtaacccgttaacgttaccgggtaacgggggttacccggggggtacccggtaggggggttacgggaaacgggtacggttaaccggtaacccggtttaagtaacccgtttaaacgtttaacgttttaacggtaacccaacgtaaccaacgtacgtaacgtacgtagttacgtaacttaacgttacgtaggggtttcgggtacggttacggggacgggtagtaacgtaccgtaacggtccgttaccggacccgttaccggtaacggtacccgaaccggtacccggtaaccgtcccgttaccccggaccccccggtttcggtaaccctttacccggtccccgtttccccggtaccccccgtttacccccg

SEQ ID NO: 187536 - DNA, 726 bp, Homo sapiens
  misc_feature: GYAE6OF02IZSMG.4.47.E03.1.454.CMB.1.raw
  modified_base (188)..(188): a, c, t, g, unknown or other
  misc_feature (188)..(188): n is a, c, g, or t
  modified_base (236)..(236): a, c, t, g, unknown or other
  misc_feature (236)..(236): n is a, c, g, or t
  modified_base (614)..(614): a, c, t, g, unknown or other
  misc_feature (614)..(614): n is a, c, g, or t
  modified_base (689)..(689): a, c, t, g, unknown or other
  misc_feature (689)..(689): n is a, c, g, or t
  modified_base (718)..(718): a, c, t, g, unknown or other
  misc_feature (718)..(718): n is a, c, g, or t
tcagagcactgtagcacgaccggtgctcgatttagactcgcgcacagagagaagggggtgggctcaggaggcagagctctgggaatctcaccatggcctggacccctctcctgcctccccctctcactttctgcacagtctctgacggcctcctatgagctgacacacgcccacccgtggtcgtacgngtccgtacccgaggaaccaaacggccaggactcacctactcgtagganatgctatcgaccataccgagacgaagaacgtccaacgaccgaccggtccccttgttccgtggtacctagttccgttaggacggaacgaaacccaacccggaaacccgtaaccccggtcgggaaccttaccccgtaggacgtaacgttacgttcctcggttacggaccttaacccggaactaccggaacgggaaacttacggtaccggtacccccttaacgttacgtaacttacggtcgggaccgggttaacccgggggcgtaacggggtaacggggacgtaacggttaaccggaaaccgttaggttaacctaaccgtttagtttaccggtaacctaaacgtaaccgaagaccgttagacgtacgtactacgttaacgnggtacggtggggttcgtacgggagggaacgtgtacgagtcgacgtacgtcgaggtacgaccgaccgcggtacccnccgccctagtactcctccgttcgtccccncctacccg

SEQ ID NO: 187537 - DNA, 613 bp, Homo sapiens
  misc_feature: GYAE6OF02F118R.4.47.E03.1.454.CMB.1.raw
  modified_base (183)..(183): a, c, t, g, unknown or other
  misc_feature (183)..(183): n is a, c, g, or t
  modified_base (479)..(479): a, c, t, g, unknown or other
  misc_feature (479)..(479): n is a, c, g, or t
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagcccaccctcggtntcagtcgtccccaggacaaacggccaggatcacctactctggagatgctagttcgccataaccagcagaagtcagaaccacggcccctgttctggtcatctggtgacgacaccaaacgcccgtaccgggactccctgagagtacttctcgtcggccttcacgctcgaagggacaagtcggaccctaccttgaacttactcgaaggtcggggacccgagggtggaagggtagtacggaactcgtaaccttacgtaagtttgttacctacaaacgagtacagcgagtacgacttaacncgtagtcggggttggttacgggacggtagggactacgaaggcctcggtaaccgtccggtacggtaccgaacggtacccgaaggtccgtcccgtaccccccgttacgggtaccctacccgttccgtttacccccg

SEQ ID NO: 187538 - DNA, 826 bp, Homo sapiens
  misc_feature: GYAE6OF02F1HR7.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagcccaccctcggtgtcagtcgtccccaggaccaaacggccaggatccacctactctggagatgctattcgccaataccagacagaagtcaacgaccgacggtcccctgttctggtcatctggtggagaccaacccgaaccgaccccgtccgggactcccgtgagtagtacttcctcgtcggcctaccgacgtccgtacggaacgggacctaagtccggaccctaccgttagaccttacgtcgaacgggttccggggacccgtaggggtacgggaacggtacgttaccggtaacccgttaggtaaccttaacgtttacgtttaccgtttaaacccgtaacgtaaaccggtaacgtaaccgtacgttaaccggtaacggtttacgtaaccgttaacgttaccggtaacggggttttacggggggtttaccggtttaccgggggggaacggggttaacggggtaacgttaaccgggtaacggttaccggttacccggtacccgggtttacccggtaaccggggttaccggtaaacccggtaccccgggtaaacccgggttccccggttaccccgggttaccccccggtttcccggggttaacccccttacccgggtttccccccgttttaccccgggtttacccccccccttaacccccccgg

SEQ ID NO: 187539 - DNA, 661 bp, Homo sapiens
  misc_feature: GYAE6OF02FME4S.4.47.E03.1.454.CMB.1.raw
  modified_base (229)..(229): a, c, t, g, unknown or other
  misc_feature (229)..(229): n is a, c, g, or t
  modified_base (290)..(290): a, c, t, g, unknown or other
  misc_feature (290)..(290): n is a, c, g, or t
tcagagcactgtagcacgaccggtgctcgatttagactcgcgcacagagagaagggggctgtgggctcaggaggcagagctctgggaatctcaccatggcctggacccctctcctgcctccccctcctcactttctgcacagtctctgaggcctcctatggagctgacacacgccaccctcggtgtcagtcgtacccaggacaaacggccaggatcacctactctgganatgcattcgaccactaccagacaagaacgtcaacgaccgacggtccccttgttcgtggtcncgttctcggtggtacgaaccaacccgaaaccgaccccgtaccgggtactacccgaggagtacgtactttccgtacgtcggtcctaccgacgtcctacggaacgggactaacgtcggaccctacgttacgacttacgtcgtacgggtcggggcgtagggtaggacggatacgacgtagtactagttacgttacttacgtacaacgaactacgacgtcgtaatcgtaactaatccggtagggttccggggttagtaccggggtacgggtaggtaagtacggtaacgtcgtacgaccgggttccgtacggtaccgaaccgtaccggaacggtcccgtacccggccccggtacgtcctacccgtcgttacccccg

SEQ ID NO: 187540 - DNA, 592 bp, Homo sapiens
  misc_feature: GYAE6OF02F58YS.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagcccaccctcggtgtcagtcgtccccaggacaaacggccaggatcacctactctggagatgcattcgccataccagcaagaagtcacgaccacggcccctgttctggtcatctggtggagaccaccgaaaccgaccccgtccgggactcccgtagacgacgtattcctcgtcggcctccgagctacgagggactaagtcggacctacttgaactacgtcgaggtcgggacccgagggtggagagtcgaacctgtacttactagttcttaactcaaacgagaacagactagtcgactaatcgtaggttcggggttacggttcgggacggaggtacgtacgtagcgtacggtaccgttcgtacggtaccgaacgacccgaagtcccgtcccggtaccccgtcggtccctacgttcccgttacccg

SEQ ID NO: 187541 - DNA, 911 bp, Homo sapiens
  misc_feature: GYAE6OF02JIBMT.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctcgcctccccctcctctactttctgcacagtctctgacggcctcctatgagctagacacgacgccctacccgtcggtgtcgacgtccgtccccgaaggaaccgaaaccggccgaggactaccaaccgttctcgtagggagtactcgactacgttcgaccgtaactaccgaacgacaacggtaaacgtacgaaaccggtacccgtaaccggtaccccctttggtttaccgtcgggttacctacgttacgtacggttacgggaaaccaaccgtaaaaccccgaaaacccgtccccggtaccgggaccttaccgtaaggaacgtacgttacgttccgttacgtacggtccttaccgacgttaccgtacggaacggtaaaccgtacggtccggaacccgttaacgttacgtaaccttaaccggtaccgggtaccggggttacccggggaacgtaacggggggtaacggtaacgggtaacccgtaacgggttaacccgttaacgttaaacccgtttaacttaacgggtttaaccgttaacccgtaaaccgtaaccggtaaacgtaaccggtaccggtaacgttaccgtaaagttaacctaaagggttaccggttacggggttttccggggttaacgggttaccggggtaaaccgggggtacgggtaaattacccggaaacggttacgtttaaccggacccgggttttaccgtacgggtacccgacgggttacccgaacccgttccggtacccgtccccggttaccgaccttacccgtttcccttacccggttaccccctacccgg

SEQ ID NO: 187542 - DNA, 815 bp, Homo sapiens
  misc_feature: GYAE6OF02FFW3S.4.47.E03.1.454.CMB.1.raw
  modified_base (134)..(134): a, c, t, g, unknown or other
  misc_feature (134)..(134): n is a, c, g, or t
  modified_base (181)..(181): a, c, t, g, unknown or other
  misc_feature (181)..(181): n is a, c, g, or t
tcagagcactgtagcacgaccggtgctcgatttagactcgcgcacagagagaagggggctgtgggctcaggaggcagagctctgggaatctcaccatggcctggacccctctcctgctccccctctcactttcngcacagtctctgaggcctcctatgagctgacacagcccacctcggtntcagtcgtcccaggacaaacggcaggactccacctactctggagatgcctagtttcgaccaacgtaccagtacagaacgtcacgtacccacgggtccccttgttacctggtacctacgttcgttggtacggaacgaaccaacccgaaaacccggtccccgtacggggacctaccccgtaggaacggtacgttaccgtttcctaccggtcggacccttaccggtacgtccgttaacggaaccggggtaaactaaccggtttccgggacccctttaacccggtttacggtaaacccttaaccgtccgggtaaccgggggtccgggggtaccccggttaggggtacgggtaaccgggtaacggttaacccggtaaacccgttaccggttaacttaaccgtttaagtttaccgtttaacgttaacctaaaccgtaacgaaccgtaacgtacgtaacggtacgtaaccttaacgttaccgtaaggttccggggttacgggttaccgggaggtaacggggtactaaccggacgttaccgtaccggtacccggttaaccgtaccggacccgtacccgaccggtaaccggtcccgtacccggttaccccggtaccggtaccctaccgttcccgtttaccccg

SEQ ID NO: 187543 - DNA, 624 bp, Homo sapiens
  misc_feature: GYAE6OF02GNGJQ.4.47.E03.1.454.CMB.1.raw
  modified_base (272)..(272): a, c, t, g, unknown or other
  misc_feature (272)..(272): n is a, c, g, or t
  modified_base (390)..(390): a, c, t, g, unknown or other
  misc_feature (390)..(390): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagccaccctcggtgtcagtcgtccccaggaccaaacggccaggatcacctactcgtggagatgctattcgccataccagcagaagtcacgaccacggccctgttcnggtcactctgtggagacctaaccaaaccgtcccgtaccgggactcccgtaggacgacgtacttcgtcgtcggccttccacgtctacgaacgggacaagtcggacctacgttgaactanacgtacggtcgggaccgagggtcgggaagactacgaacctgtaaccttacttaacgttcgttaactaccaaacgacgtaacagacgtagtctactaacgtgaggttggggtacgtacgggacgggtagtacgtacgaagtccgtacggtacccgttacggtacggtccgaaccgaccgtaacgtccgtacccgtcccgtcggtcccacgttccttcccggttacccctaccccg

SEQ ID NO: 187544 - DNA, 736 bp, Homo sapiens
  misc_feature: GYAE6OF02IMTNP.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagcccacccgtcggtgtcagtcgtccccaggacaaaccggccaggactcacctactcgtggagatcgctattcgccactaccagacaagaacgtcaacgacccgacggtccccttgttcgtggtctagtcgttggtacggacgaccgaaacccgaaaccggaccccgttaccgggacctccccgtagaacgtacgtactttccgtcgtcggcctccgacgtccgtacgaacgggacctaagtccggaccctaccgttagaaccttacgtacgtacggggtaccggggacccgtaggggtcgggaaggtaacgtacgtaaaccgtacgtaaactttaacgttacgtttaccggttaacctaaccgtaaaccgtaacgaaccgtaacgtacctaagttcgtaaacttacgtacggtagggttcggggtacgttccggggagggtaacggtacgtacgacggtacgtaccggtaccgttccggtacggccggaaccgtaccggtaacggtcccgtaccccggtccccgtaccgttccgtacccgtttccgttccccggttccccttacccccg

SEQ ID NO: 187545 - DNA, 724 bp, Homo sapiens
  misc_feature: GYAE6OF02JJXSN.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagccaccctggtgtcagtcgtccccaggacaacggccaggactcaccttactcgtggatatgctattcgaccataccagacagaagtcacgaccgacggcccctgttctggtcatcgtgaggacaccaccaaaccgtcccgtaccgggactcccgtgagacgtacttcctcgtcggcctccgacgtcctacggaaggtactacgtcggtccctacttgtaaccttactccggacgggtaccggggaccctagggggtacggtaacggtaacgtaccggtaaacccttacggtaaccgttaacgtttacgtttacgttaacccgtaaacctaacggtaacgtaaccgtaggaaccgtagttacgaccgttaagtacggtaacgggtttcgggggtttaccgggttacgggacggggttaacgggtaactaccggtaagtcccggtaacggtaccggttaccggacggttacccgaaccggtacccggaacggttccccgtaccggtcccccggttacgtacccgttaccttcccggtacccggtttaccccctaccccg

SEQ ID NO: 187546 - DNA, 770 bp, Homo sapiens
  misc_feature: GYAE6OF02FWQ42.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctggaggtcctcctatgagctgacacacgcccacccgtcggtgtcagtcgtccccgaggaaccgaaaccgggccaggactccaaccttactcgtaggagtatcggactagttcgacctaataccgagaccgaagaacgtacgaacgaaccgaccggtccccttggttccgtacggttcacgttcgtgggtacggaacgtaacccgaacccgaaaaccccggacccggttcccggggaacttccccggtaggtaacggtacgttacttccgtacggtcggtaccgtaccgtaacgtccgtacggaacgggtactaacgtccgggaccttaccgttagtaactacgttaccggacggggttccggggacccgtaaggggtcgggaaagggtacgtaaccggtaaaccgtcggttaacccgtaacgttttaacgtttaaccgttaaccgtaacgtaaaccggagtaaccgacggtacgtaagtcgtaacttaagtccggtaggtttcggggtacgggttacgggcgggtagtaacgcggtacgtccgtacgtaccgtagtacgtccgaacgacccgtagaccgtcccggtcccgtaggttcccacgttccctcccggttccccttaccccg

SEQ ID NO: 187547 - DNA, 505 bp, Homo sapiens
  misc_feature: GYAE6OF02FGXK6.4.47.E03.1.454.CMB.1.raw
  modified_base (460)..(460): a, c, t, g, unknown or other
  misc_feature (460)..(460): n is a, c, g, or t
  modified_base (498)..(498): a, c, t, g, unknown or other
  misc_feature (498)..(498): n is a, c, g, or t
tcagagcactgtagcacgaccggtgctcgatttagactcgcgcacagagagaagggggctgtgggctcaggaggcagagctctgggaatctcaccatggcctggacccctctcctgctcccccctcctcactttctgcacagtctctgaggcctcctatgagctgacacagccacccctcggtgtcagtgtccccaggacaaacggccaggatcacctactctggagatgcattgcccataccagcagaagtcagaccaggcccctgttctggtcatctgtggagacaccaaacgaccctccgggatcccctgagagattctctggctccagctcagggacaatcggaccaccttgacctatcaggtcggggcccaggtggaggatgaacctgacttactaattgttactcaacagacagcagtgataatacagtggggtgttcgggcgagggatcagcngccgtcctaggtcagcccgaaggctcgccccgtggtcnctctccg

SEQ ID NO: 187548 - DNA, 620 bp, Homo sapiens
  misc_feature: GYAE6OF02FLNR1.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgctccccctcctcactttctgcacagtctctgaggcctcctatgagctgacacagcccaccctcggtgtcagtgtccccaggacaaacggccaggatcacctactctggagatgctattcgccataccagcagaagtcacgaccgacgcccctgttctggtcatctgtgacgacaaccaaaccgaccctcggactcccgtgagagtacttctcgtggtctccacgctacgacgggaacagtcgcctacttgactatcgaggtcgggacctagggaggaggatacggtaacgtcgaactactaacgttcgttaactacaaacagacgagctagtagactacgtacgtaggttgggggttacgttcggggacggtaacgggtagtacgtaaggccgttcggaacccggttccggtaacgggtacccggtaaccggtacccccggtaaagggtcccgtccccggttacccccggtacccggttacctaacccgttccgttaaccccgg

SEQ ID NO: 187549 - DNA, 796 bp, Homo sapiens
  misc_feature: GYAE6OF02GH6IY.4.47.E03.1.454.CMB.1.raw
  modified_base (220)..(220): a, c, t, g, unknown or other
  misc_feature (220)..(220): n is a, c, g, or t
tcagagcactgtagcacgaccggtgctcgatttagactcgcgcacagagagaagggggtgggctcaggaggcagagctctgggaatctcaccatggcctggaccctctctgcctccccctctcactttctgcacagtctctgacggcctctatgacgctgacacagccaccgtggtgtcagtcgtcccaggacaacgccagactcacctactcgtagganattgactagttcgcctaactaccgagcaagtaacgtcaacggtaccggaccgttccccgttgttaccgtcggtactacgttcgtaggtaggaacgtaaccaacccgaaaccggtcccgtacgggtaactccgtagacgtacgtacttcctacgcggtcctaccgaggtctacggaacgggtaccaacggttccgaacccgttacttagtaacgtacgtccgggtacgggtccggggaacccgtagggggttacggtaacgggttacgtaacggtaaccgttaacgtaaccgtttacgtttaacgttttaaccggttaacgtaaccgtaaacgaaccggttaacgaacggttaccgtaacggttacgttaaacgttaacgttagggtacgggtttccgggggtttacgggttacggggtaacggggttaacggggtaccgttaacggtaacggtacccggttaccggttacccggttaccgaccgggttaaccgaccggttaacccggacggtcccgttcccgtacccggttcggtacccgttacccgttcccgttacccgttcccccgtaaccccg

SEQ ID NO: 187550 - DNA, 773 bp, Homo sapiens
  misc_feature: GYAE6OF02FM66M.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagcccacccgtcggtgtcgagtcgtacccccgaggaaccaaacggccgaaggactccaaccgttactcgtagggactagtcgctattcgaccaatacccgagacgaagaacgtcaacgaacccgacggtcccccttgttcgtcggtctacgttcgtggtacggaacgtaaccaacccgtaaaaccccggaccccgttacccgggaccttacccgtaggaacgtaacgtacgtttccttacgtcggtccttccgacgtccgtacgaacgggtaactacggtcggtacccttaaccgttacgaacttacgtaccggacggggtcccgggacgtaggggtagggagtacgtacgaacgtacgtacgttaacgttacgtttacgtactacgaacacgacgacgacgtacgtacaacttaacgtacgtagggttaggggtttaccggtacggggtacgggtaagggtactaacggagttaccgtaccgggttaccgtacggttaccggtaaccggaaccggtaccggtaaaccggtcccgttacccggtcccccgttaccggttaccctaacccgtttccccggtttacccggtttaccccctaacccccgg

SEQ ID NO: 187551 - DNA, 853 bp, Homo sapiens
  misc_feature: GYAE6OF02IYUJA.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctctcactttctgcacagtctctgaggcctcctatgagctgacacagcccacccgtggtgtcagtcgtccccgaggaaccaaacggccaggactaccaccttacgtctaggacgtatcgactacttcgacctaactaccaggactaaggaaacgtcacgaaccgaccggtccccttgttccgtacggtcactttcggtaggtacggaacgaccctaaacccgaaacccggtacccccgttacgggacctttccccggaggaacgtaacgtactttccgtcggtacggtcctaccgaacggtcctaacggacgggtaaccgtaaacgttccggacccttacgttaacggacctttaacgcggtacgggtacccggggacccgttaagggggtacgggtacggtaacgttaccggaaaccgttaacggttaaccttaaccggttttaaggttttaaccgtaaccttaacccgtaaaacgggaccgttaacgaccggtaaccggttaacgttaacgttaacccgtttaagtaaccggtcgggggttttaccggggttaggggtttacccgggggaaagggggtaaccggtttacaaaccgggtaaagttcccgggtaacggttaaccccggtcgggttaacggttacccggacccgtaccggaacgggtttcccgaccccggttccccggttacttaccccgtccgttacccggttaccccgttcccccgtaccccg

SEQ ID NO: 187552 - DNA, 742 bp, Homo sapiens
  misc_feature: GYAE6OF02GK3RT.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggccaggactcacctactctggagatgacattcgccataccagacaagaacgtcacgaccgacggtccccttggttcctggtctattcgtggtaggacgaccaaccgaaacccggtaccccgtccggactcccgtaggacgacgtacttctcgtcgtcctccgacgtaccgtacggacgggaactaacggttccggtaccctaaccgttacgtaaccttaacgtaccgaggggtccggggacccgtagggggtacgggaacgggtacgtaaccggtaaccgttacggtaacctttaaacgtttacgtttaaccgtttaacccgtaacgaaaaccgaacgtaaccgaacggtacgtaagtacgtaaccttaaagtccggtaggggtttgggggtttaccggttacgggggaccgggtaggggtaactacggtaacgtcgttaccggtaccggttaccgtacgggaccaccggtacccggtacggcccgtccccgtaccccgtcggtacccgtccgttccgttccccgttccccctaccccg

SEQ ID NO: 187553 - DNA, 788 bp, Homo sapiens
  misc_feature: GYAE6OF02H7RFN.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctctcactttctgcacagtctctgacggcctcctatgagctgacacagcccacccgtcggtgtcagtccgtaccccaggaaccaacggccaggatcaccttactcgtcggaagtatcgactattcgaccactaccacggacaggaacgtaccgacgaccaccggtccccgtgttaccgttacggtactacgttatggtaccggagtaacccgaaaccgaaaccggacccgtccgggtacctaccccggtagaacggtaacgtacgtttccgtcgtcggtcctccgacgtaccgtaccgaacgggactaacgtacggtacccttaaccgttacggtactagtaccggtacggtacggggtccccggtaagggtcggggtaaggaccgtacggtacccgtaagtaccgttaaacgttacgtttaacggttacctacctaaaaccggacgtaaaccgtacgtacggttaagtaccgtacgttaactcggttaagggggttccggttagggttccggggtacggtaaggggacgtttaacggacggttcggtaaccgtacccggttaccgggtaacgaacccgaaccggtacccgtaacgggacccgttccccgggaccccgtttcggaacccgttcccggtttaccctttccccggttaccccttcccccg

SEQ ID NO: 187554 - DNA, 811 bp, Homo sapiens
  misc_feature: GYAE6OF02F6S41.4.47.E03.1.454.CMB.1.raw
  modified_base (643)..(643): a, c, t, g, unknown or other
  misc_feature (643)..(643): n is a, c, g, or t
tcagagcactgtagcacgaccggtgctcgatttagactcgcgcacagagagaagggggtgggctcaggaggcagagctctgggaatctcaccatggcctggaccccctctcctgcctccccctctcactttctgcacagtctctgacggccctcctatgagctgacacacgcccacccgttggtctacacgttccgtacccccgaagggaaacccgaaaaccgggcctaagggtactacccgtaacccttacgtcggtaggacgtatcgctattcgaccctataccagacaagaacgtaccgaacgacccgaccggtcccccttgtttaccgtcggttacctacgttcgttggtacggtaacgaaccctaaaccgaaaccccggtaccccgtacccgggtaaccttcccgacggaacgtagttactttccgttacgtacggtcctaccgaacgtccgtacggaacggggtaacctacggtaccggtacccctaacgtttcgtaacgttagttaccgggtaccgggttacggggacccgtaagggggtacggaacggtaacgtaccgtaaccgtacttaacgttaactttacgttacgtaacctacgaacacgactacggacgtagtacgtacgttactacggngggtttaggggtcgtacgggtacgggacgtacgtacgtacgtaccggtacgttacccgtcggttaccggtaacgtaccccgggaccgtaacccgggttcccgtaacccggttcccggttaaccggtccccgttcctttacccggtttcccctacccccttaaccccgg

SEQ ID NO: 187555 - DNA, 871 bp, Homo sapiens
  misc_feature: GYAE6OF02G9RYA.4.47.E03.1.454.CMB.1.raw
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
tcagagcactgtagcacgaccggtgctcgatttagactcgcgcacagagagaagggggctgtgggctcaggaggcagagctctgggaatctcaccatggcctggacccctctcctgcctccccctcctcactttctgctacagtctctgagcctctatgagctgacactacgccaccctggtagtcagttcgtaccccaggacaaacggccaggactcacctactcnggagntgcattgacctactaccagttaagaagtcaacgaccaacggtccccctggttcctacggtcctaagttccgtggttacgggacgaaacccgtaaccccgaaaaacccggtacccccgtaccggggttaacctcccgtaccggtaaggaacgttaactttacccgttacgtccggtacccgttaccacggcccgttaggaaccgggggtaaactaaacggttaccggtaccctaaccgtttaccgaacttaaccgtcggaacggggtttcccgggggacccgtaacgggggtacgggaaacggacgttaaccggtaaccgttaaggtaacctttaacgtttaacttttacggtttaaacccgttaacccgaaaaacggtaccgttaacgacggttaacgtacggtttagaaccctttaaagtccgggttaaggggttttccgggggtttaacgggtttaccggggtacggggaaccggggtaattaccgttaacgggtccgtaacccgggttacccgggttaaccgtaacccggggtttaccgaaaccgggttaccccggacgggtaaccccgttccccgggaaccccccgtttgggtacccccttacccggtttcccgggtccccttttaccccccccg

SEQ ID NO: 187556 - DNA, 667 bp, Homo sapiens
  misc_feature: GYAE6OF02JI4CC.4.47.E03.1.454.CMB.1.raw
  modified_base (226)..(226): a, c, t, g, unknown or other
  misc_feature (226)..(226): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgacgcctcctatgagctgacacagcccaccctcggtgtcagtcgtcccaggacaaacggccaggatcacctactcgtagganatgctatcgaccagtaccagcagaacgtcacgaccgacggccccttagtcgtcggtcaatcgtgtggacgaccaaccaaaccgcccgtaccggactcccgtagaagtacgtacttccttcgtcgcctaccgagtcctacggtaacggactaagtcggacctacgttacgtaactactacgtacggtccgggtaccgagggtacggaaggtacgtacgtaaccgtacggtactaacttacggtttacgttactaaccgaagaacgtaacgacgtacgcgtacgtattacgtacgtacggttgggtacgttacgggtagggacgttataacggaacgtacctacgggtaccttaccggtacggtacgtacggaacccgtacggacccgtcccggtaccccgttcggtacccgttccgttaccgttccgtcccccggttacccg

SEQ ID NO: 187557 - DNA, 829 bp, Homo sapiens
  misc_feature: GYAE6OF02JNPFY.4.47.E03.1.454.CMB.1.raw
  modified_base (497)..(497): a, c, t, g, unknown or other
  misc_feature (497)..(497): n is a, c, g, or t
tcagagcactgtagcacgaccggtgctcgatttagactcgcgcacagagagaagggggtgggcgtcaggaggcagagctctgggaatctcaccatggcctggacccctctcctcgcctccccctcctccactttctgcacacgtctcctgaggccctcctatgagctgacacacgccctaccctcggttcgtctacgtcgtacccccgaggaaccgaaaaccggccctaaggactccgaaccttactcgtaggagagtcgtactaattcgaccctaactaaccagacgaagtaaacgtacaaccggacccgtacggccccccgttgtttacgtcggttaccaagtttccggttaggtacggaaccgtaacccgaaaacccgtaaaaccccggaccccggttccggggaaccctacccggtagaacgtaacggtccttacggtcgtccggacctccgacgtccgtaccgaaggactaacgtcggtaccctaccggttnaaccgtttacgcgttaacgggccggggtaccgtaggggcgggtacgtaacggtacgtaccgtacgtaaccgttacttaacgttacgttaaccgtaacgtaaccgtaaccgtacgaacggtaccgtaacgttacgtaccgttaaacgtccggtagggttacggggttacggttaaccggggtaccgggtaacggtaacggttaaccgtaccgggttacgtaacccgggttacccgggttaacctcgggtaaccgtaaccgaccgggtaaccggtcccgtacccggtcccggtaccggtccttaaccgttcccgttacccgtacccctaccccg

SEQ ID NO: 187558 - DNA, 720 bp, Homo sapiens
  misc_feature: GYAE6OF02FPV3N.4.47.E03.1.454.CMB.1.raw
  modified_base (228)..(228): a, c, t, g, unknown or other
  misc_feature (228)..(228): n is a, c, g, or t
  modified_base (308)..(308): a, c, t, g, unknown or other
  misc_feature (308)..(308): n is a, c, g, or t
tcagagcactgtagcacgaccggtgctcgatttagactcgcgcacagagagaagggggctgtgggctcaggaggcagagctctgggaatctcaccatggcctggaccctctcctgctccccctcctcactttctgcacagtctctgacggcctcctatggagctgacacacgccaccctggtgtcagtcgtacccaggacaacggccaggatcacctactcgtagganatcgctagttcgccaactaaccaggacaagaagtcaacgaccgacgggcccctagttcctaggtcacttcgtggtggaanaccacccgaaaaccgtacccgtaccgggactacccgtagaacgacgtacttctacgtcggccctaccgtaacggccgttaccggaacggggtaaacctaaggttaccggacccctaacccgtttagtaacccttaacgttaccggtaacggggtccgggggaccccgtaaggggttaggaacgggtaaacttaaaacccgtaggtaacctaacgtttaacgttttaccgtaaccttacgaaacgagtaaccgagacgtagtaccgactaatccgagttcggggttagtacgggtcggaaggtacgtagaacgttcgtaccgtaccggtaccgttacgggaacgtacgtaccccgggaagtcccgtaccggtccccgttaccggtacctaccggtcccgttcgttccccccgg

SEQ ID NO: 187559 - DNA, 702 bp, Homo sapiens
  misc_feature: GYAE6OF02GI9I3.4.47.E03.1.454.CMB.1.raw
  modified_base (134)..(134): a, c, t, g, unknown or other
  misc_feature (134)..(134): n is a, c, g, or t
  modified_base (181)..(181): a, c, t, g, unknown or other
  misc_feature (181)..(181): n is a, c, g, or t
  modified_base (238)..(238): a, c, t, g, unknown or other
  misc_feature (238)..(238): n is a, c, g, or t
tcagagcactgtagcacgaccggtgctcgatttagactcgcgcacagagagaagggggtgggctcaggaggcagagctctggggaatctcaccatggcctggacccctctcctgcctccccctctctactttcngcacagtctctgacggcctcctatgacgctgacacagccacctggtntcagtcgtcccagacaacggcagatcacctatcgtgagatgactatcgacataccgngactaaggaacgtcaacgaccgtacggtcccccgtgttcgtggtactagttctacggtaggacgaacccaaccgtaaaacccggccccgttaccgggacttccccgtaggacgtaacggtatttacccgtacggtccgtccctacgacgtaccgtacgaacgggactaacgtcggtaccctacgtacgtaacgtacttcggtacgggtccggggtaccgtagggtacggtacggtacgtacgggtaacgtcggtaacttacgttacgtttacgtacctaacaactacgaacgacgtacgtagtacgtacgtaacgtccgtagggttcgggttcggtacggggaacgggtacggtacgtaccggtaagtacccgtacggtacccgttacggtaccgtcggaccaccgggtaacgccgtacccgtcccgtacgtccgttacccgtcttacccgtcccttacccccg

SEQ ID NO: 187560 - DNA, 655 bp, Homo sapiens
  misc_feature: GYAE6OF02F8XC7.4.47.E03.1.454.CMB.1.raw
  modified_base (482)..(482): a, c, t, g, unknown or other
  misc_feature (482)..(482): n is a, c, g, or t
  modified_base (542)..(542): a, c, t, g, unknown or other
  misc_feature (542)..(542): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacacgccaccctcggtgtcagtcgtccccaggaccgaaacggccaggatccacctactcgtggagatgctattcgaccataccagaccaagaacgtcacgaccacggtcccctgttcgtggtctatcgtgtaggacgacaaccgaaaccgacccgtaccgggactcccgtagagagtacttctcgtacggtcctccgagtcctacgaacgggacaacgtcggacctaccgttgtactactacgtacgggtcgggccgtaggggtaggagggtacgtacgaccgtgaaccttattagttacgttacctaacgaaccgaanacgacgacgtagtacgacttaacgtctagggttgggtagggtccgggtagggacgggtanacgacgtacgtaccggtaccgtacggtacggtaccgaccgtaccgtacggtcccgttcccgccccggttacggtaccttacccgtttccgttaccccggtccccgttaccccc

SEQ ID NO: 187561 - DNA, 708 bp, Homo sapiens
  misc_feature: GYAE6OF02GBJD4.4.47.E03.1.454.CMB.1.raw
  modified_base (282)..(282): a, c, t, g, unknown or other
  misc_feature (282)..(282): n is a, c, g, or t
tcagagcactgtagcacgaccggtgctcgatttagactcgcgcacagagagaagggggctgtgggctcaggaggcagagctctgggaatctcaccatggcctggacccctctcctgctccccctctcactttctgcacagtctctgaggcctcctatgagctgacacagccaccctcggtgtcagtcgtccccaggacaaacggccaggactcacctactctggagatgcattgccataccagcagaagtcagaccacggcccctgttctggtacatctggnggacgacaccaaacgccccgtccgggactcccgtaggacgtacgtacttccgtcgtcggtacctaccgacgacgttaccggaagggaaacctaaggttaccggacccttaaccgttacgaaccttaacgtccgtaaggggtccggggacccgtaaggggttacgggaacgtaacgttacggaaacccgttgtaaaccttactttaagttaacgtttacctaacgaaacgtagaaccgtacgacgtaacgtcgtaacttaacgtcgtaaggttcggggttacggttacggggtcgggtaaaggtaacgtacgtacggtaccgtaccggtaacccggttacggtaacggttacccgtaacggtaacccgtaacgggtaccgtccccggttacccccgtcgggtaccttacccggtcccgttaccccgg

SEQ ID NO: 187562 - DNA, 755 bp, Homo sapiens
  misc_feature: GYAE6OF02FFAJO.4.47.E03.1.454.CMB.1.raw
tcagagcactgtagcacgaccggtgctcgatttagactcgcgcacagagagaaggggtgggctcaggaggcagagctctgggaatctcaccatggcctggaccctctcctgctccccctctcactttctgcacagtctctgaggcctcctatgagctgacacagccaccctcggtgtcagtcgtccccaggacaaacggccaggactccacctactctggagatgctattcgccataccagccagaacgtcacgaccacggtcccctgttctggtcatctggtggacgaccaaccgaaaccgcccgtccgggactcccgtaggacgagtacttccgtcgtcggtccttaccgacggtccgttaccggaacggggtaacctaaacggtccggaacccttaccgttacggaaccttaacgtccggaacggggttccgggggaccccgtaagggggttacgggaacggtaacgttaccggtaaaccgttacggtaaacctttaaccgttaacgtttaccgttaaccgtaactaaaccgtaacgaaccgtaacggaccgttaaggttacgtaaccgtttaaacgtccggtaagggtttaccggggggttacggtttacccggggacggggttaacgggacttaacggtaacgtccgtaccgggtacccgtacgtacgggtaaccaccggacccgtaacggtccgtacccggtcccccgttacggtaccctacccgtccgttacccgttccccctccccg

SEQ ID NO: 187563 - DNA, 646 bp, Homo sapiens
  misc_feature: GYAE6OF02F0QLZ.4.47.E03.1.454.CMB.1.raw
  modified_base (233)..(233): a, c, t, g, unknown or other
  misc_feature (233)..(233): n is a, c, g, or t
  modified_base (421)..(421): a, c, t, g, unknown or other
  misc_feature (421)..(421): n is a, c, g, or t
tcagagcactgtagcacgaccggtgctcgatttagactcgcgcacagagagaagggggtgggatcaggaggcagagctctgggaatctcaccatggcctggacccctctcctgcctccccctcctcactttctgcacagtctctgaggcctcctatgagctgacacacgccacccgtcggtgtcagtcgtccccaggaaccaaacggccaggactccacctactctggagtangcattcgaccactaccagacgaagaagtcgaacgacccgaacggtccccgttgttccgtcggtctacttcgtggtaggacgaccaaacccgaaaccggaccccgtacccgggactacccgtaggacgtagtacttccgtcgtacggcctaccagtccgtacgagggaaccacgtcggaccctaccttnactacgtcgaggtccggggccgaggggtcggaggtagacgtaacgtagtaacttacttacgttgttacctacgaacgactacgacacgtagtcatacgttcgagggttagggtcggtacgggtgggaggctacgtaagcgtcgtaccgtcgtacggtacgaccggaccggaacgtccgtcccgtcccgtccgttaccgtccctcggttcccgttacccgtccccg

SEQ ID NO: 187564 - DNA, 691 bp, Homo sapiens
  misc_feature: GYAE6OF02FZC3A.4.47.E03.1.454.CMB.1.raw
  modified_base (129)..(129): a, c, t, g, unknown or other
  misc_feature (129)..(129): n is a, c, g, or t
tcagagcactgtagcacgaccggtgctcgatttagactcgcgcacagagagaaggggtggctcaggagcagagctctgggaatctcaccatggcctggacccctctcctgctcccccctctcactttcngcacagtctctgacggcctcctatgagctgacaccgagcccacccgttggtgtccacggttccgtcccccagggaaccaaaccgggtccaaggaccttcccgacctacctcgtacgggacactcgacctagtttcggcccaatacccgaggccaagtaacgtccacggaccacggtccccctgttccgtcggtcacgtcctgtacggacaccaacctaacggcccgttaccggactcccgtagagacgtacttccgtcgtcggccttccacgtctacggacggaaccagtccggacctaccgttagaacctcggtacgtacgggtccgggccctagggtacggacgtacgtacgaccgtacgtacctacgttacgttacgtaccacgaacgaactacgacacgtagtccacgtaactcgagggttcgggtacggtacggacggtacggtactaacggagtcccgtacggtacccgtccgtaggtcccgaacgtacccgtaacggcccgtacccggtcccgtacggtacccgttaccgtcccgttaccgtacccccgtacccg

SEQ ID NO: 187565 - DNA, 731 bp, Homo sapiens
  misc_feature: GYAE6OF02JHKYF.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagcccaccctcggtgtcagtcgtaccccaggacaaaccggccaggactccacctactcgtggacgatgactattcgacctataccagcaagaacgtcacgaccacggccccttgttcctggtcatcgtgtaggaacaccaaccgaaaccgtcccgtccgggactcccgagaacgtagtactttccgtcgtggcctaccgagtccgtacggacgggaactaacggtccggaccctaacgttcgaaccgtactacggtacgggttaccgggacccgtaggggtacgggaaggtacgtaccgtaaccgtaggtacccttaactttacgtttaccggttaacctacgtaaccgtaacgtaccgaacggtacgtacggtagtaaccgttaactacgggttagggttacgggggttcggttccgggggaacgggtagggtaccgtaacgtacgggtccgtaaccggttacccggtacgtaccgggtccgtaaccggaccggtaacggtcccgttcccgcccccggttacgtccctaccggtttcccgttacccgttcccccgttacccccg

SEQ ID NO: 187566 - DNA, 758 bp, Homo sapiens
  misc_feature: GYAE6OF02JRC8G.4.47.E03.1.454.CMB.1.raw
  modified_base (630)..(630): a, c, t, g, unknown or other
  misc_feature (630)..(630): n is a, c, g, or t
tcagagcactgtagcacgaccggtgctcgatttagactcgcgcacagagagaagggggtgggctcaggaggcagagctctgggaatctcaccatggcctcggacccctctcctgcctccccctcctctacttctgacacagtctctggacggtccctcctagtgacgtcgtcgacaccgacggcccacccgtcggtcgtccgaggttccgtaccccgaaggaaccgaaaccggccgacggactaccgacctaccgtcgtacggagagtcactacgttcgaccctactaccgaacgacgtaagtaaacgtacgaccggaacccgaccggtacccccgtttaggttccgtaggttacctacgttccggtacggttaccgggaacgtaaaccccgtaaaccgaaacccccggtaccccggtaaccggtaaccctccccgtagacgggtacgttaaccttccgttcgtaaccgggtcctaccggtacgtaccggtacgtaacggacgtaacggtcggtaacccttcgtaacgtcgtaacgaccggttacggggccgggtaccgaggggtcgaaggtcgacgtaccgtagtacgttactagttacgtacctacgaacgatacgaacgcgtacgtntacgttagacgtacgggtgggtcggttgggaacggtagtcgtacgtcgcgtaccgtcgtacgtacgccgtaacgtcgacgtcccgtacgtccccgtgtacccgtcgtcccgttacccgcccgttcccg

SEQ ID NO: 187567 - DNA, 711 bp, Homo sapiens
  misc_feature: GYAE6OF02JBVY0.4.47.E03.1.454.CMB.1.raw
  modified_base (180)..(180): a, c, t, g, unknown or other
  misc_feature (180)..(180): n is a, c, g, or t
  modified_base (329)..(329): a, c, t, g, unknown or other
  misc_feature (329)..(329): n is a, c, g, or t
tcagagcactgtagcacgaccggtgctcgatttagactcgcgcacagagagaagggggtgggctcaggaggcagagctctgggaatctcaccatggcctggaccctctcctgcctccccctcctctactttctgcacagtctctgaggcctcctatgagctgacacagccaccctcggtntcagtcgtcccaggacaacggcaggatcacctactctggagatgactagttcgccataccagcgaagacgtcaacgaccgacggccccttggttctggtactacgtctggtagacgacaaccgtaaccgacccgtccgggtactcccgngaacgctacttctcgtacggcctccgacgcgtacgaggacaacgtcggaccctacgtactacttagtccgtacgggtacgggacccgtagggggtacggaggtacgtacggtaaccggttacgaacgtttaactacggtttaacgtacccgtactaaaccgagtaccgaacggaccgtacgtaccgtacttaaagtcggtacgggttaggggttccgggttccggggaacgggtagggtaaacgttaccgacggtaccgttaccggacccgttacggtaaccggtccgtaaaccggtacccggtaacgtcccgtccccgggtttaccccgttccggttacctacccggtttccctacccccgggtttccccttaccccccgg

SEQ ID NO: 187568 - DNA, 685 bp, Homo sapiens
  misc_feature: GYAE6OF02HK5BJ.4.47.E03.1.454.CMB.1.raw
  modified_base (582)..(582): a, c, t, g, unknown or other
  misc_feature (582)..(582): n is a, c, g, or t
tcagagcactgtagcacgaccggtgctcgatttagactcgcgcacagagagaagggggctgtgggctcaggaggcagagctctgggaatctcaccatggcctggacccctctcctgcctccccctctctactttctgcactagtctctggacggccttctatgacgctgaccactacgcccaccgtcggtgtccagtccgtaccccgaggaaccgaacggccgaaggactcctaacctacgtcgtagggacatgactattcgacaacgtaccagacgtaagaacgtcaacgaccgacggtcccttagttcgcggttacacttcgtggtacggaactaaccgaacctaaccgcccgtcggactccgtagagtactactctcgacgtcctacgacgcttacggaacggtactaacgtcggtaccctacgttagaaccttcgacggtacgggtccggaccgtagggtacggacgtacgacgtaccgtagtaccttaacgttagttacgtaactaccgtaacgcgtaacgacacgtagtacgtaaccgttaacgtggttaacgggttacgggttcgtaacccgggngggtaacgtacgttacgacggttccgacggtacccggttacgcggttaaccaccggtaccgtacgccgttacccggcccgtcgtacctccgttccgtcccccg

SEQ ID NO: 187569 - DNA, 830 bp, Homo sapiens
  misc_feature: GYAE6OF02JLYRP.4.47.E03.1.454.CMB.1.raw
  modified_base (137)..(137): a, c, t, g, unknown or other
  misc_feature (137)..(137): n is a, c, g, or t
tcagagcactgtagcacgaccggtgctcgatttagactcgcgcacagagagaagggggtgggctcaggaggcagagctctgggaatctcacatggcctggacccctctcctgcctccccctcctcactttctgcacngtctctgaggcctcctatgagctgacacacgccaccctcggtgtcagtcgtccccaggaccgaacggccaggactccacctactctggagatcgctacgttcgaccgtaactaccgacgaccgtaaggtacgttaccgaaccggaaccgtaaccggtcccccgttcgttaccgttacgggtacctaacgttccgtacgggttacgggaacccgtaaacccgaaacccgttaaacccggtaccccgttacccggggtacctacccccggtaaggtaaccgtacgttaacgttcccgttccgttaccggccgtaacccgtcggtaccgtaaccggtaaacgggaccgttaaacgtcccgggaacctacccggttaaggaccttaacggttcggaccggggttaccggggaccggtaggggtacggtaaccggacggtacgttaacccgtaggttaaccgtaactttcgggttactttaaccacgttaaaccaggtaacccgcgttaccgaaagttcgtaacgtaacgttacggtggttacggggtttacggacgggtacgggtaggtaccgttaagacgtccgtacggttaccggtacctacgggaaccgtaccgaccggaaccggttccgttccccgaccccgtcggttaaccgttacccgtttacccggttcccggttaaccccctaccccgg

SEQ ID NO: 187570 - DNA, 975 bp, Homo sapiens
  misc_feature: GYAE6OF02FX0YQ.4.47.E03.1.454.CMB.1.raw
  modified_base (221)..(221): a, c, t, g, unknown or other
  misc_feature (221)..(221): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccaccctggtgtcagtcgtcccaggacaacggccaggatcacctactctggganatcgactagttcgaccctaatacccagaccaaggaacgtcaacgaccgacggccccttgttccgtggtacagttaccgtgtagggacgtaaccaacccgaaaaccggaccccgttacccggggaacttccccgtaggaacggtaacgtaactttccgttacgtccggtctacccgtacggtaccgttaccggaaacggggaaacctaaggtcccgggaaccccttaacccggtttaagggtaaccctttaacgttacccggtaacggggttacccggggggtacccccgtaaaggggggtttccgggtaaaggggtaaccgttaaccgggaaaacccgttaccgggttaaaccgtttaacgtttaaacggtttaccggtttaacccgtaacccgtaaaacggtaaacggtacccgttaaagggacccgtaaacgggttaaccgtacctttaaaacgtttacccggtaagggggttttaaccggggggttttaccggggttaacggggggtaaccgggggttaaaccgggggtttaaacgtacccggaaaaccgggtttacccggttaaccgggttacccccgggtttaccgggttaacgggtttaaccccggaaccccgggttaaacccccggggtaaacgggttccccccggttaaccccgggttcccccccggtttacccggggtttaacccccgtaccccggttttaccccggttacccccggtttaacccccccgtttaaccccccccgg

SEQ ID NO: 187571 - DNA, 967 bp, Homo sapiens
  misc_feature: GYAE6OF02HEV5W.4.47.E03.1.454.CMB.1.raw
tcagagcactgtagcacgaccggtgctcgatttagactcgcgcacagagagaaggggggtgggctcaggaggcagagctctgggaatctcaccatggcctggacccctctcctgcctccccctcctcactttctgcacagtctctgacgccttctatgacgctgacaccacgcccacccgtcggtgtctacgtcggtccccgaggaaccgaaaccggccgaggactaccacccttactcgtaggaagtagtcgactacttacgaccctactaaccacgacaacggtaagtaccaacggaaccgtaaccggtccccgtttagtccgttacggtactacgtcgttggtacggacgtaaccaaacccggtaaacccgtaccccggttacccggtaccgtaccccgttaaggaacggtaacgtaccgtttacgttcccgtacggttaccctacccgaacgttacccgtacggtaacgggtaaacgtaaaccggttccggtaaccccgttacgttttaaccggtaaccgttaacgttaaccccggttaacgggggtaccggggtaccccgggttaggggggtaacgggtaaaccggtaacgggtttaaccggaaaccggtttaccgtttaaaacgttaccgttttaaacgttttccgttaaccttaaaccggtaaaccggttaacggtaaacgtaacgggaaccctttaagggtaacctacccgtttaaagttacgggttaagggggttttacgggggttttacgggtaaccgggggttaaggggtaaccggggttaaccgtaaaccggtcgggttaccgttaacccgggtaccccggttttaccgaaccgggtccggttaaaccccggtaacccgggaacccgtttcccgtaacccccggtttcccccggtacggtttaaacccgttcccctttaccccggggttttacccttccccccccgggttacccc

SEQ ID NO: 187572 - DNA, 777 bp, Homo sapiens
  misc_feature: GYAE6OF02GYOYW.4.47.E03.1.454.CMB.1.raw
tcagagcactgtagcacgaccggtgctcgatttagactcgcgcacagagagaagggggtgggctcaggaggcagagctctgggaatctcacatggcctggacccctctcctgcctccccctcctcactttctgcacagtctctgacggtcctcctagtgagtctgacacacgcccacccgtcggtcgtcgacgttccgtaccccgaagggaaccgaaaccggccgaggtactaccaacctacgtcgtaggagtagtcgactattcgacctactaccgagtacaaggaacgtaccaacggaacccgtaccggtcccccgtttaggttccgttacggtactacgtttcgtcgggtacgggaaccgtaaacccgaaacccgtaaaaccccggtaccccggttacccggggacccttaccccggtaggaacgtaacgtttccttaccgttccggtcggtaccctaccggtacgccgtaacggaaccgggaacctaaggtcccggtacccttaccgttaacgtaaccgttacgtacgggtaacggggtcccggggaccgtaggggtacggaagggtacttacgggaaccttacgtaacttacgtttaacgttcgttaacccacgtaacgaacgtacagtactagtctaacgttagtcggtaggggttgggtcgggttcgggagggtagtacgtagtacgtcgtacgtaccgcgtacggtcaccggtaccgacggtccctccgccccgttcggtctacccgtccgttacccctacccctcccg

SEQ ID NO: 187573 - DNA, 827 bp, Homo sapiens
  misc_feature: GYAE6OF02FLQV6.4.47.E03.1.454.CMB.1.raw
  modified_base (162)..(162): a, c, t, g, unknown or other
  misc_feature (162)..(162): n is a, c, g, or t
  modified_base (266)..(266): a, c, t, g, unknown or other
  misc_feature (266)..(266): n is a, c, g, or t
tcagagcactgtagcacgaccggtgctcgatttagactcgcgcacagagagaagggggtgggctcaggaggcagagctctgggaatctcaccatggcctggacccctctcctgcctcccccctcctcactttctgcacagtctctggacgcctctatggacncgtacgaccacgacgaccctacccgtcggtcgtacgtacggtccgtaccccgaaggaaccgaaaccggccgaaggtacctacctaacctacgttcgaggatacncgtactagttccgaccaacgtaaccgacggacaagtaacggtacgaaccgaacccgtaccggttccccgttcgtttcgttacggtactacgttcgtgggttaaggaaccgtaaaccgaaaccccggtaaaccggtccccggttaccgggtaccctaccggaggtaacgtaacgttacttaccgtcggtacgtaccttaccgacggtccgtaacggaacgggtaactaacggtaccgtacccgttacgtacgtaccgttacgtacggtacggggtccggggaaccggtagggtaccgggtaagtaccgtacgtaaccgtagtaaccgttacgttactttaaccgtaactaccgaaagtacgtaccgacgtagtacgtacaacgttacgtaggtacgggtcggggttacggttacggggtacgggtaaggttaccgtaacggtaacgtccggtaaccgtttaccgtaccggttacgtaccgacccggtaacccggccgttaccccgtaccggtccccggtaccgtacccgttccgttccccggttcccgtcccccttaccccg

SEQ ID NO: 187574 - DNA, 732 bp, Homo sapiens
  misc_feature: GYAE6OF02FKHV1.4.47.E03.1.454.CMB.1.raw
  modified_base (314)..(314): a, c, t, g, unknown or other
  misc_feature (314)..(314): n is a, c, g, or t
  modified_base (612)..(612): a, c, t, g, unknown or other
  misc_feature (612)..(612): n is a, c, g, or t
  modified_base (678)..(678): a, c, t, g, unknown or other
  misc_feature (678)..(678): n is a, c, g, or t
tcagagcactgtagcacgaccggtgctcgatttagactcgcgcacagagagaagggggtgggctcaggaggcagagctctgggaatctcaccatggcctggaccctctcctgctccccctctcactttctgcacagtctctgaggcctcctatgagtctgacacacgtcccaccctggtgtcaggttccgtccccgagggtaaccaaacgggtccaaggctaccaccttactgtcgggagatgactatttgaccataccagtcaagaacgtcacgaccacgggccccttgtctaggtcactcgtaggtaggtanaccgaaccaaaccggtccctccggggtactcccgtaggacgtagtctttcgtacgtcgggtcctaccgcggtccttacggaacgggggtacctaaacggtcgggtaaccccttacggtttagaaccttacttaccgggacggggtaccggggtaccccgtaggggtacggtaacggtacgttaaccggaaaccgttggtaaaccttacgtttaacgtttacgttaacctacgtaaacgacgtaaccacgggtactacggtatacttaacgtcgtaccgggttggggttcgtacggggngggtaaggacttacggaagtccgtgtacccgtaggtaccggtacaccggtaacccgacgggttccncccggttaccccggtacggtcttacccgttcggttacccgttccccgttacccc

SEQ ID NO: 187575 - DNA, 810 bp, Homo sapiens
  misc_feature: GYAE6OF02GULFU.4.47.E03.1.454.CMB.1.raw
  modified_base (395)..(395): a, c, t, g, unknown or other
  misc_feature (395)..(395): n is a, c, g, or t
tcagagcactgtagcacgaccggtgctcgatttagactcgcgcacagagagaagggggctgtgggctcaggaggcagagctctgggaatctcaccatggcctggacccctctcctgcctccccctctcactttctgcacagtctctgacggtcctcctatgagctggacacacgcccacccgttcggtgtcgacggtcgtacccccgaaggaacgtaaaccggccgaaggtactcccacccttacgtccgttagggagatcgactacgttcgacccaactaccagacgtaaggaacgtacaacgacccgacggtccccttgttcgtgtactatcgtgtaggacgaaccctaaacccgaaccggtaccccggccgggtacctcccgtggatacgtnttcctcgtcggactcacggtctacggacgacgtaacgtccgtaccctacgtcgtaacgtacgtacggacgggttccggggaccggtaggggtacgggaaggttacgtacccggtaacggttacgtaacttacgtttacgttacgttaacgttaaccgaaaccgtacgaacacggtaccgtaggtaccgttaaacgtaacgttcggtaaggggttacggggttcggggttaaccgggacgggggtaaacggttacggtaacgtacgttacccgggtacggttaaccccgggtttaacggaacccgggtttacccggacccgttaacccgggttaccgggtaacccccgggttccccgttaaccccccgggttccgttaaccccggtttaccgtttacccccggtttaacccccccg

SEQ ID NO: 187576 - DNA, 758 bp, Homo sapiens
  misc_feature: GYAE6OF02FIZA9.4.47.E03.1.454.CMB.1.raw
  modified_base (620)..(620): a, c, t, g, unknown or other
  misc_feature (620)..(620): n is a, c, g, or t
tcagagcactgtagcacgaccggtgctcgatttagactcgcgcacagagggaaggggctgtgggctcaggaggcagagctctgggaatctcaccatggcctggacccctctcctgcctccccctcctctaccgtttctgcacagtctcgtgacggcctcgtatgagactgaacacacgcccacccgtggtatcaggtcgtacccgaggacgaaaccggccaaggactccacctacgtcgtacggagagtcggactagttccgacctaacgtacccgaagacgaagtaacgtaccgaacggaacccgtaacggtcccccctttggtttccgtacgggttcctacgttaccgtggtacgggaaccgaacccgtaaacccgaaacccggtaaccccggttccggggtacctacccggtaggaacggtacgttacgttaccgtcggtacggtcctaccgaacgtccgtaacgggaacggtaaccgtaaggtaccggtacccttaaccggttacgtaccgttaacgtaccggtacggggtacccgggtaccgtacggggttacggaacggtacggtaacgtaccgtacgtacttaacgttacgttacgtaactacgaacagtacngacgtagactacgtacgacgtacggtgggtacggtacggacgggtagtacgagtacgtccgtacgttaccgtacgtaacggtcgacgaccggtacgtccgtcccgccggtaccgacgtcccttacgtcccgtaacccc

SEQ ID NO: 187577 - DNA, 640 bp, Homo sapiens
  misc_feature: GYAE6OF02JENQT.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgcctccccctcctcactttctgcacagtctctgagcctcctatgagctgacacacgcccacccgtcggtgtcaggtcgtaccccaggaaccaaacggccaggactccacctactcgtggatatgctattcgccataccagcaagacgtcaagacccgcggccccttgtccgtggtctagtcgtggtacggaacgaccaacccgaaaccgtcccgtaccggtactacccgtagacgacgtacttccgtacgtcggacctccgacgtcctacggacgggactaaggtccggaccttaccgttagaacttagtaccgtacgggtccggggacccgagggtacggaaggacgtacgtaaccgtagtaacgttactacgtttacgtaacctacgaacacgacagacgtagtactacgtaatcggtaggttggggttcgtacgggcggtaggacgtagacgtccgtcgtaccgtcggtacgacgacgaccgacgtccgtacccgtcccgtacgtaccgtccgttcgtcccg

SEQ ID NO: 187578 - DNA, 774 bp, Homo sapiens
  misc_feature: GYAE6OF02IUL91.4.47.E03.1.454.CMB.1.raw
  modified_base (583)..(583): a, c, t, g, unknown or other
  misc_feature (583)..(583): n is a, c, g, or t
tcagagcactgtagcacgaccggtgctcgatttagactcgcgcacagagagaagggggtgggctcaggaggcagagctctgggaatctcaccatggcctggaccctctcctgcctccccctctcactttctgcacacgtctctgacggtcctcctatgagctgacacacgcctaccgtcggtgccacgtccgtaccccgaggaaccgaaaccggccaggacttaccaccttacgtccgaggacagtcgactacgttcggacctactaaccgacgtacgaacgtaacggtccaaccgacccgtacggtccccttggttaccgtacggtactcgttacggttacggtacggaacgaccgtaaaacccgaaccccgtaccccggtacggtacctacccggtaggaacgtcgttacgttcgtcgtcggtcctaccgataccgtggtaacgggacctaggttcccggaccttacgttacgtacgttacgtcccgggaagggttcccggggaccgagggtacggtacggtacgtacggtaccgtcgtacgttactacgttacgtactacgaacgtacgaacacgtacgngtacgtacgtacgtacgggttaggttacgggtcgggttaccgggacggggttaagggtacctaaccggtagtcccggttacggtacccgttacgggttaccgtccggaaccgtaccgggtaacccgtccggtaccccggtccccggttacccgtaaccgttcccgtaaccgttccccgttacccgtccccg

SEQ ID NO: 187579 - DNA, 804 bp, Homo sapiens
  misc_feature: GYAE6OF02F07WT.4.47.E03.1.454.CMB.1.raw
tcagagcactgtagcacgaccggtgctcgatttagactcgcgcacagagagaagggggctgtgggctcaggaggcagagctctgggaatctcaccatggcctggacccctctcctgcctccccctcctcactttctgcacagtctctgacggccctcctatgagctgacacacgcccacccgtcggtgtcagtcgtcccgaggaaccaaacggccaggactccgaacctactcgtaggagtagtcgactagttcgaccaacttaaccgagaccgaaggaacgtaccgaaacggtaccccggaaccggtcccccctttggtttccgtcggtacctaacttccgtagggtaggaacgtaacccgaacccgaaacccggtaccccggaccgggtaccttacccgtagaagtacgtactttccgtagtccggtcctacgacgtccgtacggaacgggtaacctaacggtaccggtaccccttaaccgttacggtaaaccttaacgtaccgggtaaggggttcccggggaacccggtaaggggtaacgggtaaggtaacgtaaccggttaaccgtagttaaacccttaacgtttacgtttacttaacccttaacaaacgaacgtaacgacgtacgtaggtacgtaacttaacgttacggtagggttcggggttacggttaaccggggacgggtaaggtactacgggaacgtccgtaaccgggtacccgtcggttaacgacgtaacccggaccgtaacggtccccgttcccgtacccccgttacgtacccttacccgttcgttacccccg

SEQ ID NO: 187580 - DNA, 786 bp, Homo sapiens
  misc_feature: GYAE6OF02GFFHK.4.47.E03.1.454.CMB.1.raw
  modified_base (182)..(182): a, c, t, g, unknown or other
  misc_feature (182)..(182): n is a, c, g, or t
  modified_base (227)..(227): a, c, t, g, unknown or other
  misc_feature (227)..(227): n is a, c, g, or t
  modified_base (230)..(230): a, c, t, g, unknown or other
  misc_feature (230)..(230): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagcctgacacagcccaccctcgggtntcagtgtccccaggaccaaacggccaggatcacctactctagganatncattgaccataccagcagaagtacagaccgaaggcccccttgttacgtggttacacgttctggttagggaacgaccaaacccgaaaaccggtaacccccgtacccgggggactaccccgtggaacggaacgtaaccgtttctaccgtggtctaccgtagccgtaccgtacggggaaccgtaaactcgggacctaccctttacggtaacttacgtaacctacggggtttcgggggaccccgaagggggttacgggtaacggggaacgtttaacgggaaaccccgttaacggtaaccctttaaacgttaaccggttttacgtttaacccgttaacccaaagttaacgaacccggacgaccgtaggttccggtacgttaaaacgttccgtaacggtttggggggttaaccgtttcgggggacggggttaacggggaacttcgggaaacgtaccgttccggtccggtaaccggtacggttaccggaccgtaccccggaggttccctacccggtcccccgttacgtccgtacgttcccgttccgttacccccttacccccg

SEQ ID NO: 187581 - DNA, 827 bp, Homo sapiens
  misc_feature: GYAE6OF02G34T8.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacgacgcccacccgtcggtcgtctaggtccgtaccccgaggaaccgaaaaccggcccgaaggactccaacccttaccgttccgtagggacgagttcgactagttcgacctaactaaccgacgacaaggaaacgtccgaacgtaacccgaaccggtcccccgtttggttcccgttcgggttcctaacttcgttacggtagggtaaccggaaccctaaaccccggaaaaccccggtacccccggtaccccgggtaccttaccccggtacggaaggtacgttacgtttccgtacggtcggtacctccgacgtcccgtaacggaacgggaactaacgtcgtacccgtaccgttacgtacttacgtccgacgggttccgggacccgtaggggtacggagggtactaacggtaacgtacggtaacttacgttatttacgttaactaccaaaccgtaacgacgacgtacgtacgtacgtactaacgtcgtacgggttcggggtttacggtccggggtaacggggtaaggtaccgtaacgtaacgtccgttacccgggtaccgttaccggtaccggtaccgtaacccggaccgtacccggtaccgtcccccgtacccccggttccggtacccttacccggttcccggttccccgtcccccgtttacccccg

SEQ ID NO: 187582 - DNA, 1010 bp, Homo sapiens
  misc_feature: GYAE6OF02G8GVK.4.47.E03.1.454.CMB.1.raw
tcagagcactgtagcacgaccggtgctcgatttagactcgcgcacagagagaagggggtgggctcaggaggcagagctctgggaatctcaccatggcctggaccctctcctcgcctccccctcctctactttctgcacagtctctgaggcctcctatgacgctagacacacgcccacccgtcggtgtcgacgtccgtaccccgaaggaaccgaaaccggccgaaggactaccaaccttactcgtaggacgatcgctacttcgacctaactaaccacgacgaacggtaacgtacgaacgaacccgtaccggtacccccttacggttaccgttacgggttactacgttacgttggtacggaaccgtaaaccgaaaaccccgtaaaaccccggtaccccggttacccggggtaacccgttaccccggtacgggtaaacggtaacggttaacttttacccggttaccgtaccgggtaccctacccgtaacggtacccggtaaccggtaacggggaaaccgtaaacggttacccgggaacccgttaaccggttaacgtaaccgttacggtaacggtaccggggtaccgggggtaacccgtagggggggtaaccggaacggggtaacgttaccgggtaaaccgtacggtaaactttaacgttaacgtttaaccgttaacccaaccgtaaacgaacgaaccgtaacgtacgtaacggttaccgtaactttaaaggtacgggttacggggtttagggggttaccgggttaccgggggtaacggggtaaacggggttaattaaaccgggaaaccgggtttccgttaacccggggttaacccggtttacccgggttaaccgggtaaacccccggtaacccgggtaaacccgggtacccggggttaacccccggttaccccccgggttaccccccgggtttaacccggggttaaccctttacccccggggtttttaccccgggtttttacccccggtaccccccccggttttaaccccccc

SEQ ID NO: 187583 - DNA, 793 bp, Homo sapiens
  misc_feature: GYAE6OF02HK4MX.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctagacacacgccctacccgtcggtactcagttccgtaccccgaaggaaccaaaccggccaaggactccgaaccttactcgtggacgagtcgctattcgaccaactaccgagtaccaaggtaacgtccaacggtaccccaccgggtcccccttgttccgttacggtcctattccgtggttacggacgaaccctaacccggaaaaccgtacccccgtccggggtaaccttcccgtggaacgtaacgttcgttaccgtccgtacggcccttaccgacgtccgtacggaacgggtacaacgtcggacccttacgttacgtacttaccgtaggtcgggtccgggtccgaggggtacggacggtacgtacgaaccgtacggttaaaccttagtttacgtttacggttaacctaaccgaaagtaaccgtaacgaccgtaacggtacttacggtaaacctttaagaccggttaagggggtttcgggtacggggtttaccggggacgggttaacgtaacggtacgaaagggttccgttacggggaccccgttagtaccggtaccgaccggtacgtcccggacccgttcccgtcccggtacggttacccctaccggtccgtttacccgtacccccgtaccccg

SEQ ID NO: 187584 - DNA, 632 bp, Homo sapiens
  misc_feature: GYAE6OF02F24RS.4.47.E03.1.454.CMB.1.raw
tcagagcactgtagcacgaccggtgctcgatttagactcgcgcacagagagaagggggtgggctcaggaggcagagctctgggaatctcaccatggcctggacccctctcctgctccccctcctcactttctgcacagtctctgaggcctcctatgagctgacacagccacccgtcggtgtcagtgtccccaggacaaacggccaggatcacctactctgagatgcattgccataccagcagaatcaagaccaggcccctgttctggtcatctgtggagaccaccgaaacgccctccgggatcccgtagacagacttctctggctccagctcagggacagtcggccaccttgactactctaggtcgggccctaggtggaggagttacgaactgaacttaactatttacggttactacgaacgtacgaacgacgacaaggtgtacctaaattccgaaggttcggggtagtttacgggagggaacggggtaactacggaacgtcgttaccggacccgttacccgttagggttacccaacggtacccccgtaaagggtcccttaccccgggtacccccggtttcggttaaccccgacctttccccggttacccgtttccccccgttaaccccccg

SEQ ID NO: 187585 - DNA, 682 bp, Homo sapiens
  misc_feature: GYAE6OF02IM28N.4.47.E03.1.454.CMB.1.raw
  modified_base (418)..(418): a, c, t, g, unknown or other
  misc_feature (418)..(418): n is a, c, g, or t
tcagagcactgtagcacgaccggtgctcgatttagactcgcgcacagagaggaaggggggtgggctcagggaggcagagctcgtgggatctcaccagtcggcctcggaccctctcctgcctcccccctctctactttctgccacgagtctctggacggcctcgtagtgagcgtagacacgacgtcccacccgtggtcgtctcgtccgtaccccaagggaaccaaaccggcgaaggcctaccaccttactcgtggagagtcgactatccgacactacagtacagaagtcacgaccgtccgccctgttcgtcggtcactcgtggcgacaactaaccgaaaccgtcccgtacggcctccaggagtatcgttccgcgtacgtcctcacgccgtagaacggtaccaagtcgtcccgtaacgtnaaccttgtcggtcggggtaccgggtccggagggttacggcggtaacgaccgtaccgtacgactttaactacgttacgttacaactaacgacgtacgacgtacgagtctaacgtacgttacggtcgggtaggttcgggtcgggtacggtacgtacgtacggtaccgtgtacccgtcggttacgaccggtctacccgggaccgtcgacccggttcccgtcccggttaccgcgtttaccctcccggtttccccgtccccgtttcccg

SEQ ID NO: 187586 - DNA, 872 bp, Homo sapiens
  misc_feature: GYAE6OF02GL90M.4.47.E03.1.454.CMB.1.raw
  modified_base (211)..(211): a, c, t, g, unknown or other
  misc_feature (211)..(211): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagctgacacagcccaccctcggtgtcagtcgtccccaggacaaacggcaggacncacctactcgtggagatcgctagttcgacccaacttacccagacaaggaaacgtcgaacggacccacggtccccccttgtttccgttcggtacctacgttcgttcggttaggaacgaaacccgaaacccgtaaaaccccggtaaccccccgttacccgggggaacccgttaccccgtttacggaacggtaacgttaaccgtttcccttacggtaccgggtccttacccgacgtccgtaccgaacgggacctaaggtccggaccctaccgtacgtactacgtcgtacggtccgggcccgaggggtacggaggtacgtaacggtaacccgtaggtaacctttaaccgtttaacgtttcgtttaacccgtaaccgtaaaccgtaaacggaaccgtacgtaaccggtagttaccgtaacgttaacgttaaggtaacggggtttcgggggttacgggttccgggggtaagggtaaacggggttaacgttaaccggtaacgttacccggttaccgttacccgtttaccggttaaccggttaaccggtaaccggtaaacccccgggtaaccgggtccccgtttaacccccgggcccccggtttaccggttacccccgttaacccgtttcccggtttaccccccgttaccccccggtttaacccccccc

SEQ ID NO: 187587 - DNA, 752 bp, Homo sapiens
  misc_feature: GYAE6OF02G27A8.4.47.E03.1.454.CMB.1.raw
  modified_base (161)..(161): a, c, t, g, unknown or other
  misc_feature (161)..(161): n is a, c, g, or t
  modified_base (276)..(276): a, c, t, g, unknown or other
  misc_feature (276)..(276): n is a, c, g, or t
tcagagcactgtagcacgaccggtgctcgatttagactcgcgcacagagagaagggggtgggctcaggaggcagagctctgggaatctcaccatggcctggacccctctcctgcctccccctcctcactttctgcacagtctctgaggcctcctatgagcngacacagcccacccgtggtgtcagtccgtaccccgaaggtaaccgaaaacggccgaagggtactaccaacccttactcgtagggaactatcgactatcgacctactaccaggtanaacggaactcaacgaaccgtaccggtcccttgttcgtggtactacgtcgtaggtacggaacgaaccctaacccgaaaccggtcccgtaccgggaccttaccgtaggagtacgtacttcgtcgtacggtacctaccgaactcctacggaaacgggtaacctaacggtcggtaccccttaagttacggtaacctacggttaccggacggggtacccgggaccgttagggtacgggaacggtacgttaccggaacgtacgtacttaacttagttacttaaccaacgtaacgaacgtacgtacgtagtgtaacgtacttagtaacggttacgggttgggtacgtcggggtacggagggttaactacgaccggtacgtacccgttacggtacgtccggtaacgcccggtaacgcgtacccgtcccgtaccccggtttaggtaccccgtaccgtttcccggtaccccgttccccgtaccccg

SEQ ID NO: 187588 - DNA, 819 bp, Homo sapiens
  misc_feature: GYAE6OF02HNDWL.4.47.E03.1.454.CMB.1.raw
  modified_base (132)..(132): a, c, t, g, unknown or other
  misc_feature (132)..(132): n is a, c, g, or t
  modified_base (178)..(178): a, c, t, g, unknown or other
  misc_feature (178)..(178): n is a, c, g, or t
  modified_base (659)..(659): a, c, t, g, unknown or other
  misc_feature (659)..(659): n is a, c, g, or t
tcagagcactgtagcacgaccggtgctcgatttagactcgcgcacagagagaagggggtgggctcaggaggcagagctctgggaatctcaccatggcctggacccctctcctgctccccctcctcactttcngcacagtctctgaggcctcctatgagctgacacagccaccctggtntcagtcgtaccccaggaaccaaacggccaggactcgaacctactcgtaggagtatacgcattcgacctacgtaccagacaagaaacgtacaacgtaccaacggtccccttgttactcggtactaacttccgtaggttacggaacgaaccctaaacccgaaaaacccggtacccccggtaccgggtaccttacccccgttaggaaacggtaagtaaccgtttcgttaccgtaccgggtaccttaaccgtacgtcccgttaacggaaaccgggggtaacctaaaccggtttacgggtaacccctaacccgtttaagggtaaaccctttaacggttaccgtaacggggttaccgggggaccccgtaagggggttaccggggaaaggttacgttaacgggtaaaccctacggtaaccttaaacttagtttaaccgttaactacgaaacgtaacgtaaccgaagtcctaaaggtgtaaccgttaanacggttaacggttagggggttcgttacggggacgggttaagggaccttagaaccggtcgtaccgtacccgttacgttaaccggacctaaccggacccgtaagtcccggtaccctcccggttaccggcttaccgttccgtacccgttaccccgtaaccccg

SEQ ID NO: 187589 - DNA, 762 bp, Homo sapiens
  misc_feature: GYAE6OF02IZX33.4.47.E03.1.454.CMB.1.raw
  modified_base (137)..(137): a, c, t, g, unknown or other
  misc_feature (137)..(137): n is a, c, g, or t
  modified_base (245)..(245): a, c, t, g, unknown or other
  misc_feature (245)..(245): n is a, c, g, or t
tcagagcactgtagcacgaccggtgctcgatttagactcgcgcacagagagaaggggtggctcaggaggcagagctcgtgggaatctcaccagtggcctggacccctctcctgcctcccctcctcactttctgcacngtctctggacgcctcctaatgagctgacacagccctacccgtcgggtcgttcaggttccgtaccccaaggaccgaaacggccaaggcttccaaccgtacttctagganatcgtactggttcaccagaccgtagcaacgtaacgtccgaacggtacccgaccggtccctttaggttcccgtggtaccattcgttgggaaggacggaacccaaccgaaacccggtacccggtaccgggtaccgtccgtagaccggtacgttagtttccgcgtacggtactcctacgtctaacggaagggtacctagtccggaccttactcgtacttacgtcgaggggttaccggaggtaacggaggtaggtacgacggtaacctagtaccgttacgttatttacgttaacgtaccgaaagtactaagccgtagtacgtataaccggttatacgggtacgtttacggggtaccgggttaggggcccgggttaaagggttacacggttaaccgttaccgttaccgttacccgggttcggttaaccggtaccggtaaccgttacccggaccggttccgtcccccggtaccggttaccgtacccttcccgtaccccgttttacccggcccccgttaccccg

SEQ ID NO: 187590 - DNA, 793 bp, Homo sapiens
  misc_feature: GYAE6OF02ITW0C.4.47.E03.1.454.CMB.1.raw
  modified_base (137)..(137): a, c, t, g, unknown or other
  misc_feature (137)..(137): n is a, c, g, or t
tcagagcactgtagcacgaccggtgctcgatttagactcgcgcacagagagaagggggctgtgggctcaggaggcagagctctgggaatctcaccagtggcctcggaccctctcctgcctccccctctctactttcngccacacgtctctggacggtcctcctatcggagctgacacacgccctaccgtggtgtcgtagtccgtacccaggaaccaaaccggcaggtactccaacctactcgagggactatcggactagttcgacctaacgtaccaacggacgaaggtaacgtacgaaccgaacccgaccgggtcccttaggtttctcgggtacctaacgttcgtagggtaggaaacggtaaccctaaacccgtaacccggtccccggttaccggtaccttacccggtaaggaacggtacttaccttcgtcgtccggactccgagtccgtagaacgggtctaacgtccgtaacctcgttacgacgtacgccggtaaggggcccgggtacggagggttacggaaacggtagtaaccgtacgtacggtaaacttaacgttacggttaccgtttaacaaccggtaaacaacggtactaactaccggtagtacttacgttaacgtcggttacgggtcggggtacgggtttaccggggacggtaagggtacgtaaccgacggttccgggtaaccgtttaccggaaggggttacccgaaccggtaaccggtaaccccggttggacccggttccccggggtacccttccgttacgggttacccctcccggtttacccccg

SEQ ID NO: 187591 - DNA, 144 bp, Homo sapiens
  misc_feature: GYAE6OF01ELNZR.1.44.D11.1.454.CMB.1.raw
  modified_base (140)..(144): a, c, t, g, unknown or other
  misc_feature (140)..(144): n is a, c, g, or t
tcagacgagtgcgtcacgaccggtgctcgatttagcgcagtacgatcgcggggagatcaaacgaactgtggctgcaccatctgtcttcatcttccaccctcctcacgcactcgtctgagcgggctggcaaggcgcatagnnnnn

SEQ ID NO: 187592 - DNA, 558 bp, Homo sapiens
  misc_feature: GYAE6OF01ATAOY.1.44.D11.1.454.CMB.1.raw
  modified_base (141)..(141): a, c, t, g, unknown or other
  misc_feature (141)..(141): n is a, c, g, or t
  modified_base (472)..(472): a, c, t, g, unknown or other
  misc_feature (472)..(472): n is a, c, g, or t
  modified_base (505)..(505): a, c, t, g, unknown or other
  misc_feature (505)..(505): n is a, c, g, or t
  modified_base (519)..(519): a, c, t, g, unknown or other
  misc_feature (519)..(519): n is a, c, g, or t
tcagacgagtgcgtcacgaccggtgctcgatttagcgcagtacgatcgcgggagatcaaacgaactgtggctgcaccatctgtcttcatcttccgccatctgaacgcactcgtctgagcggctggcaaggcgcagtacgcncgtcgcgcgtcgtcgtcgtcgtcgtcgtcgtcgtcgtcgtcgtcgtcgtcgtcgtcgcgtcgtcgtcgtcgtcgtcgtcgtcgcgtcgtcgtcgtcgtcgcgtcgtcgtcgcgtacgtcgtacgtcgtacgtctcgcgtacgtcgtacgtcgtcgacgcgtacgtcgtacgcgtcgtcgtcgtacgtcgtcgtcgcgtaccgcgtacgtccgacgtcgtacgtccgtagtccgacgtccgtacgtcgtccggctaccggtcgtccgtacgtcgtacgtcgcgtacgcgtacgtcgtcgtacgcgtcgcgtcgacgcgtacgcgtacgcgtnccgtgcgcgtcgcgtagctcgtgtccgcgtacncggtcgacgccgtnacggtcgtacgcgtagcccgtagcgtagccgtgacctgg

SEQ ID NO: 187593 - DNA, 142 bp, Homo sapiens
  misc_feature: GYAE6OF01EQ9Q5.1.44.D11.1.454.CMB.1.raw
  modified_base (142)..(142): a, c, t, g, unknown or other
  misc_feature (142)..(142): n is a, c, g, or t
tcagacgagtgcgtcacgaccggtgctcgatttagcgcagtacgatcgcgggggagatcaaacgaactgtggctgcaccatctgtcttcatcttcccgccatctgaacgcactcgtctgagcgggctggcaaggcgcatagn

SEQ ID NO: 187594 - DNA, 141 bp, Homo sapiens
  misc_feature: GYAE6OF01BQ9Y3.1.44.D11.1.454.CMB.1.raw
  modified_base (141)..(141): a, c, t, g, unknown or other
  misc_feature (141)..(141): n is a, c, g, or t
tcagacgagtgcgtcacgaccggtgctcgatttagcgcagtacgatcgcggggagatcaaacgaactgtggctgcaccatctgtcttcatcttcccgccatctgaacgcactcgtctgagcgggctggcaaggcgcatagn

SEQ ID NO: 187595 - DNA, 144 bp, Homo sapiens
  misc_feature: GYAE6OF01CNX04.1.44.D11.1.454.CMB.1.raw
  modified_base (142)..(144): a, c, t, g, unknown or other
  misc_feature (142)..(144): n is a, c, g, or t
tcagacgagtgcgtcacgaccggtgctcgatttagcgcagtacgatcgcgggggagatcaaacgaactgtggctgcaccatctgtcttcatcttcccgccatctgaacgcactcgtctgagcgggctggcaaggcgcatagnnn

SEQ ID NO: 187596 - DNA, 144 bp, Homo sapiens; identical to SEQ ID NO: 187595
  misc_feature: GYAE6OF01CBCTI.1.44.D11.1.454.CMB.1.raw
  modified_base (142)..(144): a, c, t, g, unknown or other
  misc_feature (142)..(144): n is a, c, g, or t

SEQ ID NO: 187597 - DNA, 143 bp, Homo sapiens
  misc_feature: GYAE6OF01E400Q.1.44.D11.1.454.CMB.1.raw
  modified_base (142)..(143): a, c, t, g, unknown or other
  misc_feature (142)..(143): n is a, c, g, or t
tcagacgagtgcgtcacgaccggtgctcgatttagcgcagtacgatcgcgggggagatcaaacgaactgtggctgcaccatctgtcttcatcttcccgccatctgaacgcactcgtctgagcgggctggcaaggcgcatagnn

SEQ ID NO: 187598 - DNA, 164 bp, Homo sapiens
  misc_feature: GYAE6OF01DYN1A.1.44.D11.1.454.CMB.1.raw
  modified_base (118)..(118): a, c, t, g, unknown or other
  misc_feature (118)..(118): n is a, c, g, or t
  modified_base (136)..(136): a, c, t, g, unknown or other
  misc_feature (136)..(136): n is a, c, g, or t
  modified_base (142)..(164): a, c, t, g, unknown or other
  misc_feature (142)..(164): n is a, c, g, or t
tcagacgagtgcgtcacgaccggtgctcgatttagcgcagtacgatcgcgggggagatcaaacgactgtggctgcaccatctgcttcatcttccgccatctgaacgcactcgtctgancgggcctgggcaagggcncatagnnnnnnnnnnnnnnnnnnnnnnn

SEQ ID NO: 187599 - DNA, 147 bp, Homo sapiens
  misc_feature: GYAE6OF02GE1IW.1.44.D11.1.454.CMB.1.raw
  modified_base (138)..(147): a, c, t, g, unknown or other
  misc_feature (138)..(147): n is a, c, g, or t
tcagacgagtgcgtcacgaccggtgctcgatttagcgcagtacgatcgcgggagatcaacgaactgtggctgcaccatctgtcttcatcttccgccatctgaacgcactcgtctgagcgggctggcaaggcgcatagnnnnnnnnnn

SEQ ID NO: 187600 - DNA, 145 bp, Homo sapiens
  misc_feature: GYAE6OF02H5YNA.1.44.D11.1.454.CMB.1.raw
  modified_base (141)..(145): a, c, t, g, unknown or other
  misc_feature (141)..(145): n is a, c, g, or t
tcagacgagtgcgtcacgaccggtgctcgatttagcgcagtacgatcgcgggggagatcaaacgaactgtggctgcacatctgtcttcatcttcccgccatctgaacgcactcgtctgagcgggctggcaaggcgcatagnnnnn

SEQ ID NO: 187601 - DNA, 156 bp, Homo sapiens
  misc_feature: GYAE6OF02HV9LC.1.44.D11.1.454.CMB.1.raw
  modified_base (143)..(156): a, c, t, g, unknown or other
  misc_feature (143)..(156): n is a, c, g, or t
tcagacgagtgcgtcacgaccggtgctcgatttagcgcagtacgagtcgcggggagatcaaacgaactgtggctgcaccatcctgtcttcatcttcccgccatctgaacgcactcgtctgagcgggctggcaaggcgcatagnnnnnnnnnnnnnn

SEQ ID NO: 187602 - DNA, 141 bp, Homo sapiens; identical to SEQ ID NO: 187594
  misc_feature: GYAE6OF02ILSWN.1.44.D11.1.454.CMB.1.raw
  modified_base (141)..(141): a, c, t, g, unknown or other
  misc_feature (141)..(141): n is a, c, g, or t

SEQ ID NO: 187603 - DNA, 179 bp, Homo sapiens
  misc_feature: GYAE6OF02F7IU8.1.44.D11.1.454.CMB.1.raw
  modified_base (144)..(179): a, c, t, g, unknown or other
  misc_feature (144)..(179): n is a, c, g, or t
tcagacgagtgcgtcacgaccggtgctcgatttagcgcagtacgagtcgcggggagatcaaacgaactgtggctgcaccatcctgtcttcatcttcccgccatctgaacgcactcgtctgagcgggctggcaaggcgacatagnnnnnnnnnnnnnnnnnnnnnnnnnnnnnnnnnnnn

SEQ ID NO: 187604 - DNA, 142 bp, Homo sapiens
  misc_feature: GYAE6OF02F5SY3.1.44.D11.1.454.CMB.1.raw
  modified_base (141)..(142): a, c, t, g, unknown or other
  misc_feature (141)..(142): n is a, c, g, or t
tcagacgagtgcgtcacgaccggtgctcgatttagcgcagtacgatcgcggggagatcaaacgaactgtggctgcaccatctgtcttcatcttcccgccctcctcacgcactcgtctgagcgggctggcaaggcgcatagnn

SEQ ID NO: 187605 - DNA, 146 bp, Homo sapiens
  misc_feature: GYAE6OF02GRC3S.1.44.D11.1.454.CMB.1.raw
  modified_base (142)..(146): a, c, t, g, unknown or other
  misc_feature (142)..(146): n is a, c, g, or t
tcagacgagtgcgtcacgaccggtgctcgatttagcgcagtacgatcgcgggggagatcaaacgaactgtggctgcaccatctgtcttcatcttcccgccatctgaacgcactcgtctgagcgggctggcaaggcgcatagnnnnn

SEQ ID NO: 187606 - DNA, 460 bp, Homo sapiens
  misc_feature: GYAE6OF02HK2AA.1.44.D11.1.454.CMB.1.raw
  modified_base (432)..(432): a, c, t, g, unknown or other
  misc_feature (432)..(432): n is a, c, g, or t
  modified_base (435)..(460): a, c, t, g, unknown or other
  misc_feature (435)..(460): n is a, c, g, or t
tcagacgagtgcgtcacgaccggtgctcgatttagcgcagtacgaaagggaaagagccaccctctcctgcagggccagtcagagtgttagcagcaggtacttagcctggtaccagcagaaacctggccaggctcccaggctcctcatctatggtgcatccagcaggtccactggcatccccagacaggttcagtggcagtgggtctgggacagacttcactctcacccatcagcagactggagcctgaagattttgcagtgtattactgtcagcagtatgtagctcactgaacttttggccagggaccaagctggagatacaaacgactgtggctagccacatctgtacttcacttccttccctaccctcctccacgtcctacgtccgtctgacggcgggtcgtggaccgaagggcgtacgaatagcatcancgnnnnnnnnnnnnnnnnnnnnnnnnnn

SEQ ID NO: 187607 - DNA, 415 bp, Homo sapiens
  misc_feature: GYAE6OF01CILQO.34.74.G08.1.454.CMB.1.raw
  modified_base (408)..(415): a, c, t, g, unknown or other
  misc_feature (408)..(415): n is a, c, g, or t
tcagtacacgtgatcacgaccggtgctcgatttagtagctctatcagggactggagtggattggccatatctattacagtgggagcaccaactacagcccctccctcacgggtcgagtcaccatctcagtagacacgtccaagaaccagttgtccctgaacctgcggtcagtgaccgctgcggacacggccgtctattactgtgcgaggagttgtagtagtggtacctgcgccttcgactactggggccgggaaccctggtcaccgtctcctcagcctccaccaagggcccattggtcttccccctggcaccctcctccagagcacctctggggcacagcggccctgggctgcctggtcaaggactacttccatcacgtgtactgagcgggctggcaaggcgcatagnnnnnnnn

SEQ ID NO: 187608 - DNA, 419 bp, Homo sapiens
  misc_feature: GYAE6OF01C4WUT.34.74.G08.1.454.CMB.1.raw
  modified_base (412)..(419): a, c, t, g, unknown or other
  misc_feature (412)..(419): n is a, c, g, or t
tcagtacacgtgatcacgaccggtgctcgatttagtagctctatcagggactggagtggattggccatatctattacagtgggagcaccaactacagcccctccctcacgggtcgagtcaccatctcagtagacacgtccaagaaccagttgtccctgaacctgcggtcagtgaccgctgcggacacggccgtctattactgtgcgaggagttgtagtagtggtacctgcgccttcgactacgtggggccgggaaccctggtcaccgtctcctcagcctccaccaagggcccatcggtcttccccctggcaccctcctccaagagcacctctgggggcacgagcggccctgggctgcctggtcaaggactacttccatcacgtgtactgagcgggctggcaaggcgcatagnnnnnnnn

SEQ ID NO: 187609 - DNA, 416 bp, Homo sapiens
  misc_feature: GYAE6OF01EDHB4.34.74.G08.1.454.CMB.1.raw
  modified_base (410)..(416): a, c, t, g, unknown or other
  misc_feature (410)..(416): n is a, c, g, or t
tcagtacacgtgatcacgaccggtgctcgatttagtagctctatcagggactggagtggattggccatatctattacagtgggagcaccaactacagcccctccctcacgggtcgagtcaccatctcagtagacacgtccaagaaccagttgtccctgaacctgcggtcagtgaccgctgcggacacggccgtctattactgtgcgaggagttgtagtagtggtacctgcgccttcgactactggggccgggaaccctggtcaccgtctcctcagcctccaccaagggcccatcggtcttccccctggcaccctcctccaagagcacctctgggggcacagcggccctgggctgcctggtcaaggactacttccatcacgtgtactgagcgggctggcaaggcgcatagnnnnnnn

SEQ ID NO: 187610 - DNA, 482 bp, Homo sapiens
  misc_feature: GYAE6OF01AXL20.34.74.G08.1.454.CMB.1.raw
  modified_base (179)..(179): a, c, t, g, unknown or other
  misc_feature (179)..(179): n is a, c, g, or t
  modified_base (449)..(450): a, c, t, g, unknown or other
  misc_feature (449)..(450): n is a, c, g, or t
  modified_base (452)..(482): a, c, t, g, unknown or other
  misc_feature (452)..(482): n is a, c, g, or t
tcagtacacgtgatcacgaccggtgctcgatttagtagctctatcagggactggagtggattggccatatctattacagtgggagcaccaactacagccccctccctcacgggtcgagtcaccatctcagtagacacgtccaagaaccagttgtccctgaacctgcggtcagtgaccgntgcggacacggccgtctattactgtgcgaggagttgtagtagtggtacctgcgccttgactacgtgggggcccgggaaccctggtccaccgtctcctcagccctccaccaacgggcccagtccggtcctttccccccgtggcccacccctcctaccaagacgccaccgtcgtcgggggcacgaggccggcccgtgggctcgccgtggtaccaaggtacctacgttccatcgacgtgtactggacggcgggctggacaaggcgacagtagnncnnnnnnnnnnnnnnnnnnnnnnnnnnnnnnn

SEQ ID NO: 187611 - DNA, 460 bp, Homo sapiens
  misc_feature: GYAE6OF01EV2TJ.34.74.G08.1.454.CMB.1.raw
  modified_base (438)..(460): a, c, t, g, unknown or other
  misc_feature (438)..(460): n is a, c, g, or t
tcagtacacgtgatcacgaccggtgctcgatttagtagctctatcagggactggagtggattggccatatctattacagtgggagcaccaactacagccccctccctcacgggtcgagtcaccatctcagtagacacgtccaagaaccagttgtccctgaacctgcggtcagtgaccgctgcggacacggccgtctattactgtgcgaggagttgtagtagtggtacctgcgtccttcgactacgtcgggggccggggaacctggtccaccgtctcctcacgcctccaccgaagggcccagtcgtcctcccctgccaccctcctcaagcgcaccgtcggtggggcacgacgccggcccgtgggctcgccgtggtacgaaggtactacttccatccgacgtgtactggcggcggcgtcgggacgaaggccacgagtagnnnnnnnnnnnnnnnnnnnnnnn

SEQ ID NO: 187612 - DNA, 539 bp, Homo sapiens
  misc_feature: GYAE6OF01A9EO0.34.74.G08.1.454.CMB.1.raw
  modified_base (162)..(162): a, c, t, g, unknown or other
  misc_feature (162)..(162): n is a, c, g, or t
  modified_base (169)..(169): a, c, t, g, unknown or other
  misc_feature (169)..(169): n is a, c, g, or t
  modified_base (207)..(207): a, c, t, g, unknown or other
  misc_feature (207)..(207): n is a, c, g, or t
  modified_base (227)..(227): a, c, t, g, unknown or other
  misc_feature (227)..(227): n is a, c, g, or t
  modified_base (461)..(461): a, c, t, g, unknown or other
  misc_feature (461)..(461): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (499)..(503): a, c, t, g, unknown or other
  misc_feature (499)..(503): n is a, c, g, or t
  modified_base (506)..(508): a, c, t, g, unknown or other
  misc_feature (506)..(508): n is a, c, g, or t
  modified_base (512)..(512): a, c, t, g, unknown or other
  misc_feature (512)..(512): n is a, c, g, or t
  modified_base (514)..(539): a, c, t, g, unknown or other
  misc_feature (514)..(539): n is a, c, g, or t
tcagtacacgtgatcacgaccggtgctcgatttagtagctctatcagggactggagtggagttggccatatctattacagtgggagcaccaactacagccccctcctcgacgggtcgagtcaccatctcgagtagacacgtccaaagtaaccagttgtcccngaacccnggcggtcagtcgacgctggcgacacggcctctattacngtgcgaggagttgacgtagnggtaccgtccgcttccgactcggtgggggacccggtaacctggccaccgtctccgacagccctccgaaccgtaaacgggccctaacgtccggtcccgtttacccccctggggtaacccacccccgtccgttaccgaaactacggacctaccgtacgcgggggaccacagggccgcccgtaggctacggtccctggaccaaaggtaccttacgtctaactcgaacgttcggtaanggacgacggtcgtagacgacggcgacaattganancgnnnnncannnacgntnnnnnnnnnnnnnnnnnnnnnnnnnn

SEQ ID NO: 187613 - DNA, 631 bp, Homo sapiens
  misc_feature: GYAE6OF01BPFSC.34.74.G08.1.454.CMB.1.raw
  modified_base (133)..(133): a, c, t, g, unknown or other
  misc_feature (133)..(133): n is a, c, g, or t
  modified_base (179)..(179): a, c, t, g, unknown or other
  misc_feature (179)..(179): n is a, c, g, or t
  modified_base (201)..(201): a, c, t, g, unknown or other
  misc_feature (201)..(201): n is a, c, g, or t
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (535)..(535): a, c, t, g, unknown or other
  misc_feature (535)..(535): n is a, c, g, or t
tcagtacacgtgatcacgaccggtgctcgatttagtagctctatcagggactggagtggattggccatatctattacagtgggagcaccaactacagcccctccctcacgggtcgagtcaccatctcaggtanacacgtccaaagaaccagttgccctgaacctgcggtcagtgaccgntgcggacacggcctctattacngtgcgaggagttgagtagtggtacctgccgccttcgactacgtggggacccgggaacctggtccaccgtctcctcagcctccaccgaacggccatcggtccttccccctggccaccctcctacaacgacgccaccgtccgtcgggggaccacgtacggccgggacccgttgggccgttcggccttacgggttaccgaaagggtaccttaaccttaccctaacgttccgtaaccggttacgtaaccgtacggaacggtccggggcgttacgggaccgaaagggccgacgtaagtaggacctagacagcganagntacacaattcacacccggaanacgtacgagacgacgtacgacgtcgacgacgagacgacgtacgtacgtacgtacgagacgcacgtacgtacgtacctactactcgtcgtacgtacg

SEQ ID NO: 187614 - DNA, 496 bp, Homo sapiens
  misc_feature: GYAE6OF02FFEEJ.34.74.G08.1.454.CMB.1.raw
  modified_base (459)..(459): a, c, t, g, unknown or other
  misc_feature (459)..(459): n is a, c, g, or t
  modified_base (479)..(496): a, c, t, g, unknown or other
  misc_feature (479)..(496): n is a, c, g, or t
tcagtacacgtgatcacgaccggtgctcgatttagtagctctatcagggactggagtggattggccatatctattacagtgggagcaccaactacacgcccctccctcacgggtcgagtcaccatctcagtagacacgtccaagaccagttgtccctgaacctgcggtcagtcgaccgctggcggacacggccgtctattactgtgcgtaggtagttgtagtagtggtacctggccgtccttcgacgtacggtcgggggcccgggtaacccctggtccaccgtcctcctccacgccctccaccgaacgggcccctacgttcccggttccttcccccgtcgccctacccctcctaccaacgacgccaccgtcgtcgggggccacgcggccggtcccgtggctcggccgtcggtacaacggtactaccttccacgtcgacgtgtacgtggacggcgggtcncggacgaacggcactagagnnnnnnnnnnnnnnnnnn

SEQ ID NO: 187615 - DNA, 426 bp, Homo sapiens
  misc_feature: GYAE6OF02HEPMR.34.74.G08.1.454.CMB.1.raw
  modified_base (413)..(413): a, c, t, g, unknown or other
  misc_feature (413)..(413): n is a, c, g, or t
  modified_base (418)..(426): a, c, t, g, unknown or other
  misc_feature (418)..(426): n is a, c, g, or t
tcagtacacgtgatcacgaccggtgctcgatttagtagctctatcagggactggagtggattggccatatctattacagtgggagcaccaactacagccccctccctcacgggtcgagtcaccatctcagtagacacgtccaagaaccagttgtccctgaacctgcggtcagtgaccgctgcggacacggccgtctattactgtgcgaggagttgtagtagtggtacctgcgccttgactacgtggggccggggaaccctggtcaccgtctcctcagcctccaccaaggccccatcggtcttcccccctggccacccctcctccaagacgcaccctcgtgggggcacgaggccggccctggggctgcctggtcaaggctacttccatcacgtgtactgagcggctggcaggcncatgnnnnnnnnn

SEQ ID NO: 187616 - DNA, 459 bp, Homo sapiens
  misc_feature: GYAE6OF02FKJCU.34.74.G08.1.454.CMB.1.raw
  modified_base (445)..(459): a, c, t, g, unknown or other
  misc_feature (445)..(459): n is a, c, g, or t
tcagtacacgtgatcacgaccggtgctcgatttagtagctctatcagggactggagtggattggccatatctattacagtgggagcaccaactacagcccctccctcacgggtcgagtcaccatctcagtagacacgtccaagaaccagttgtccctgaacctgcggtcagtgaccgctgcggacacggccgtctattactgttcgaggagttgtagtagtggtacctgcgccttcgactacgtgggggcccgggaacctggtcaccgtctcctcacgcctccaccaagggcccatcggtccttcccccctggccacccctccctcccaagacgccaccctcgtcgggggccacgacggccggccccgtgggcctggccgttgggtccgaaagggtacctacttccatcacgtgtacgtgaggcgggctggcgaaggcgcatagnnnnnnnnnnnnnnn

SEQ ID NO: 187617 - DNA, 421 bp, Homo sapiens
  misc_feature: GYAE6OF02IQK81.34.74.G08.1.454.CMB.1.raw
  modified_base (409)..(421): a, c, t, g, unknown or other
  misc_feature (409)..(421): n is a, c, g, or t
tcagtacacgtgatcacgaccggtgctcgatttagtagctctatcagggactggagtggattggccatatctattacagtgggagcaccaactacagcccctccctcacgggtcgagtcaccatctcagtagacacgtccaagaaccagttgtccctgaacctgcggtcagtgaccgctgcggacacggccgtctattactgtgcgaggagttgtagtagtggtacctgcgccttcgactactggggccggggaacctggtcaccgtctcctcagcctccaccaagggcccatcggtcttccccctggcaccctcctccaagagcacctctgggggcacagcggcctgggctgcctggtcaaggctacttccatcacgtgtactgagcgggctggcaaggcgcatacgnnnnnnnnnnnnn

SEQ ID NO: 187618 - DNA, 581 bp, Homo sapiens
  misc_feature: GYAE6OF02I322P.34.74.G08.1.454.CMB.1.raw
  modified_base (523)..(523): a, c, t, g, unknown or other
  misc_feature (523)..(523): n is a, c, g, or t
  modified_base (529)..(529): a, c, t, g, unknown or other
  misc_feature (529)..(529): n is a, c, g, or t
  modified_base (532)..(532): a, c, t, g, unknown or other
  misc_feature (532)..(532): n is a, c, g, or t
  modified_base (535)..(536): a, c, t, g, unknown or other
  misc_feature (535)..(536): n is a, c, g, or t
  modified_base (540)..(541): a, c, t, g, unknown or other
  misc_feature (540)..(541): n is a, c, g, or t
  modified_base (544)..(544): a, c, t, g, unknown or other
  misc_feature (544)..(544): n is a, c, g, or t
  modified_base (546)..(546): a, c, t, g, unknown or other
  misc_feature (546)..(546): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
  modified_base (556)..(558): a, c, t, g, unknown or other
  misc_feature (556)..(558): n is a, c, g, or t
  modified_base (560)..(581): a, c, t, g, unknown or other
  misc_feature (560)..(581): n is a, c, g, or t
tcagtacacgtgatcacgaccggtgctcgatttagtagctctatcagggactggagtggattggccatatctattacagtgggagcaccaactacagcccctccctcacgggtcagtcaccatctcagtagacacgtccaagaaccagttgtccctgaacctgcggtcagtgaccgctgcggacacggccgtctattactgtgcgtaggagttgtagtagtggtacctgccgctttcgactacgtgggggcccgggaaccctggtccaccgtctaccgtcagccttccaccaacgggcccagtccggttccttcccccgtggcccgtacccctcctaccctaagacgcctaccctcgttcgggggccacgacggcccggacccgttggggccctcggacccgttggtccgaaaacggggtaccttaaccgttccaacgttacccgtacggttcgttaaccgtgggaaccggtccgggggacctttcgggaccggaacgggtccggtaccgtacgtaacgggtnacggtncgngcnngacnnacngntgctcngntnnncnnnnnnnnnnnnnnnnnnnnnn

SEQ ID NO: 187619 - DNA, 499 bp, Homo sapiens
  misc_feature: GYAE6OF02GHNVK.34.74.G08.1.454.CMB.1.raw
  modified_base (181)..(181): a, c, t, g, unknown or other
  misc_feature (181)..(181): n is a, c, g, or t
  modified_base (196)..(196): a, c, t, g, unknown or other
  misc_feature (196)..(196): n is a, c, g, or t
  modified_base (361)..(361): a, c, t, g, unknown or other
  misc_feature (361)..(361): n is a, c, g, or t
  modified_base (453)..(454): a, c, t, g, unknown or other
  misc_feature (453)..(454): n is a, c, g, or t
  modified_base (457)..(457): a, c, t, g, unknown or other
  misc_feature (457)..(457): n is a, c, g, or t
  modified_base (459)..(470): a, c, t, g, unknown or other
  misc_feature (459)..(470): n is a, c, g, or t
  modified_base (472)..(484): a, c, t, g, unknown or other
  misc_feature (472)..(484): n is a, c, g, or t
  modified_base (486)..(499): a, c, t, g, unknown or other
  misc_feature (486)..(499): n is a, c, g, or t
tcagtacacgtgatcacgaccggtgctcgatttagtagctctatcaggggactggagtggattggccatatctattacagtgggagcaccaactacagccccctccctcacggggtcagtcaccatctcagtagacacgtccaaagaaccagttgtccctgaacctgcggtcagtgaccgntgcggacacggcctntattactgtgcgagggagtttgtagtagtggtacctggccgtccttcggaacttacgtggggggcccgggtaaccctggtccaccgtctcctcagcctccaccgaaggcccatcggtccttcccctggccaccctcctccaagacgcaccgtcgcggggacacgngccggcctgggcctcgcctggtacaacggactaccttccatacgtacgtagtactggacggtcggggctgggacaacgggcgacagtagcannagnannnnnnnnnnnnannnnnnnnnnnnngnnnnnnnnnnnnnn

SEQ ID NO: 187620 - DNA, 472 bp, Homo sapiens
  misc_feature: GYAE6OF02GNTK0.34.74.G08.1.454.CMB.1.raw
  modified_base (288)..(288): a, c, t, g, unknown or other
  misc_feature (288)..(288): n is a, c, g, or t
  modified_base (409)..(409): a, c, t, g, unknown or other
  misc_feature (409)..(409): n is a, c, g, or t
  modified_base (441)..(472): a, c, t, g, unknown or other
  misc_feature (441)..(472): n is a, c, g, or t
tcagtacacgtgatcacgaccggtgctcgatttagtagctctatcagggactggagtggattggccatatctattacagtgggagcaccaactacagccccctccctcacgggtcgagtcaccatctcagtagacacgtccaaagaaccagttgtccctgaacctgcggtcagtcgaccgctgcggacacggccgtctattactgtgcggaggagttgtaagttagtggtacctgccgtccttcgactacgtggggggacccgggtaacctggtccaccgtctcctcngcctccaccacggcccagtcgtccttccccctggccacccctcctccaagcgccacctcgtggggcacgagccggccgtgggctgcctggtcaacggtactcctcactcgacgtcgtacgnggcggcggggctggcgaacggcgacgagtagnnnnnnnnnnnnnnnnnnnnnnnnnnnnnnnn

SEQ ID NO: 187621 - DNA, 773 bp, Homo sapiens
  misc_feature: GYAE6OF02JE608.34.74.G08.1.454.CMB.1.raw
  modified_base (177)..(177): a, c, t, g, unknown or other
  misc_feature (177)..(177): n is a, c, g, or t
  modified_base (625)..(625): a, c, t, g, unknown or other
  misc_feature (625)..(625): n is a, c, g, or t
  modified_base (667)..(667): a, c, t, g, unknown or other
  misc_feature (667)..(667): n is a, c, g, or t
  modified_base (679)..(679): a, c, t, g, unknown or other
  misc_feature (679)..(679): n is a, c, g, or t
tcagtacacgtgatcacgaccggtgctcgatttagtagctctatcagggactggagtggattggccatatctattacagtgggagcaccaactacagcccctccctcaacggtcgatcaccatctcagtagacacgtccaagaacctgttgtccctgaacctgcggtcagtgaccgntgcgacacggccgtctattactgtgcgaggagttgtaagtaggtcgtacctgccgtaccgtttcggaccgttacgtgggggccccgggtaaaccctggtaccctaccggttcttccgtacctaacggtcccttacccgtaaccgaacggggccccaacgttccgggttcccttcccccccggttcgggaccctaacccccgtttaccctccccgtaaaacggacgtacccgtaaccgtcggttccgggggggaccaaccgtaaccggcccggggttacccccttacggggggacccgttaccgggaccccgttcgggtacccgtaaaaccggggttaaccttaacccggtttacccgaacgttccggtaacgtaccggttacgtaacgggtaaccggtcccggggtacgttacggccggtaaacggtccgacgggttaactaacgggnttccggcgtatacgtacgacgtacgtacgcgtctcacgtacncgtcgagacgtnacgagtcgtcgtcgtacgtacgtcgtacgtacgtacgacggtacgtactacgtaacgtacgtacgtacgtacgtaccgtactactacgtacgac

SEQ ID NO: 187622 - DNA, 642 bp, Homo sapiens
  misc_feature: GYAE6OF02H8BI2.34.74.G08.1.454.CMB.1.raw
  modified_base (373)..(373): a, c, t, g, unknown or other
  misc_feature (373)..(373): n is a, c, g, or t
  modified_base (570)..(570): a, c, t, g, unknown or other
  misc_feature (570)..(570): n is a, c, g, or t
  modified_base (576)..(577): a, c, t, g, unknown or other
  misc_feature (576)..(577): n is a, c, g, or t
  modified_base (581)..(581): a, c, t, g, unknown or other
  misc_feature (581)..(581): n is a, c, g, or t
  modified_base (584)..(584): a, c, t, g, unknown or other
  misc_feature (584)..(584): n is a, c, g, or t
  modified_base (589)..(589): a, c, t, g, unknown or other
  misc_feature (589)..(589): n is a, c, g, or t
  modified_base (592)..(592): a, c, t, g, unknown or other
  misc_feature (592)..(592): n is a, c, g, or t
  modified_base (594)..(595): a, c, t, g, unknown or other
  misc_feature (594)..(595): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (601)..(602): a, c, t, g, unknown or other
  misc_feature (601)..(602): n is a, c, g, or t
  modified_base (604)..(605): a, c, t, g, unknown or other
  misc_feature (604)..(605): n is a, c, g, or t
  modified_base (607)..(609): a, c, t, g, unknown or other
  misc_feature (607)..(609): n is a, c, g, or t
  modified_base (611)..(612): a, c, t, g, unknown or other
  misc_feature (611)..(612): n is a, c, g, or t
  modified_base (626)..(630): a, c, t, g, unknown or other
  misc_feature (626)..(630): n is a, c, g, or t
  modified_base (632)..(634): a, c, t, g, unknown or other
  misc_feature (632)..(634): n is a, c, g, or t
  modified_base (636)..(641): a, c, t, g, unknown or other
  misc_feature (636)..(641): n is a, c, g, or t
tcagtacacgtgatcacgaccggtgctcgatttagtagctctatcagggactggagtggattggccatatctattacagtgggagcaccaactacagccccctccctcgacgggtcgagtcaccatctcagtagacaccgtccaagaaccagttcgtcccctggaaccctggccggtcaggttgacccgcgtggccgggaacaccggtccgttctaatttacctggtggacgaggggtagtttggtaacggttaggtcgggtaccctggtccgaccttttacgacttaccggtcggggggaccccgggtaacctgggctaccgtccgtcctgaccgcctccaaccgacggccatccgtccttccccgtgcccnccctcctcaacgagcccacctcggcggggtaccacgtacggcccggtccggtcgggtcctcggtaacccggttggtaccgtaaacgggtacccttaaccgtttcccgacgttaccgtaacgggttacgtttaaaccgcgggtacggccggggtaccggcggtacccggaaggttcccgggaaccgtagtacgggacngcgcgnncgcncgncgcgngcngnncncncnncnncnnncnnaaaaaaaaaaaaannnnngnnncnnnnnnc

SEQ ID NO: 187623 - DNA, 593 bp, Homo sapiens
  misc_feature: GYAE6OF01DNJ2X.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccttcggcaagtttgcattacttgggtgcgacaggcccctggacaagggcttggagtggatgggagggatcgtccctgtctttggagcagcaaactacgcacatgatttccgaggggagagtcacgagttacggcggacgaatcgtacgccacagcctatcgtggagctagaacaacgtgagaccgtagaacgacgacggtaccgtttactacgtgcgcgagacgacgtcccggacccccccgaacggggacccggaaccggacgggtaagtacgggtcgggggaccgtaaccgggtcgttttacggggtacccttaccttaccgttaccgtaacgttaaccg

SEQ ID NO: 187624 - DNA, 724 bp, Homo sapiens
  misc_feature: GYAE6OF01DC6H1.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctggaggtgaagacgccgtgggtcctcggtgaaggtctcctgcgaggcgtcgtggggcaccgttcggcaagtttgcctattacgttgggtgcgacgacggcccctaggacgaagggtcttggagtggagtgggaggtatcgtccgtgtcgtttggagcagacaaactcgcacatgacttccgagggagtagtacgacgtagttaccgggacggaacgtaacgtaccgtaccggaccctacgaacgtaccgtacgtaccgtacgggacgtacgtacggtaaaccgtaaccggttagaaccggtacccgtaaggaaaccggtaaccgtaacccggttacccgttttaaccgtaccgttacggaccggtacggtaaccgtacggacccgtacccccggaccccccccgggaacggggaccccgaaaccgggtaacgggttacgggttaacggggtccggggtaccggtaaccgggttaccggttttaccggggtaccctttacgtaacccgttaaccggtaccgttaaacccgg

SEQ ID NO: 187625 - DNA, 577 bp, Homo sapiens
  misc_feature: GYAE6OF01B459H.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccgttcggcaagtttgccattacttgggtgcgacaggcccctggacaagggcttgagtggatgggaggatcgtccctgtcgtttggagcagcaaactacgcacatgatttccaggggagagtcacgattacggcggacgaatctacggccacagcctatctggagctagaacaacgtgacgacctagaacgacacggaccgtttactactgcgcgagacgacgtccggacccccccggaaggggccccgaacggacgggtaagtagggtcgggggaccgaaccgggtccgttttggggaccctttacgtaccttacgtaccgtaacg

SEQ ID NO: 187626 - DNA, 577 bp, Homo sapiens
  misc_feature: GYAE6OF01ADNVF.5.64.F09.1.454.CMB.1.raw
  modified_base (367)..(367): a, c, t, g, unknown or other
  misc_feature (367)..(367): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggcaccttcggcaagtttgccattacttgggtgcgacaggcccctggacaagggcttgagtggatgggagggatcgtccctgtctttggagcagcaaactacgcacatgatttccagggganacgtcacgattacggcggacgagtctacggccacgagccctatctggacgctagaacaacgtcgagaccgtgaacgacgacggtccgttactacgtcgcgacgagagacgtccggaccccccggaaggggcccggaacggacggtagtacggtcgggggaccgtaacgggtcgttttcgggacctttaccgtaccttacgtacgtaaccg

SEQ ID NO: 187627 - DNA, 570 bp, Homo sapiens
  misc_feature: GYAE6OF01B3HQZ.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccttcggcaagtttgccattaccgttgggtgcgacaggcccctggacaagggcttgagtggagtgggagggatcgtcctgtctttggagcagcaaactcgcacatgatttccgagggagagtcacgtagttacgggcggacgaatcgtacggccacacgcctatctggacgcgtagaacaacgtagagactgaacgacgacggtaccgtttacgtacgtgacgcgagagacgtcccggaccccccggaagggaccgaacggacggtagtacgggtcggggacgaacggtcgtttacggcccttataccgtacgtcgtacg

SEQ ID NO: 187628 - DNA, 648 bp, Homo sapiens
  misc_feature: GYAE6OF01COLWY.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaagggtctcctgcaaggcgtcgttgggggcaccttcggctaagtttgccattacgttggtgcgacacggcccctggacaagggcttgagtggatgggaggatcgtccctgtctttggagtcagacaaactacgcacatgatttcgagggagagtcaacgattacggcgacgaactcgtacggccacgacgacctagtcgtaggacgacgtacgaaacgaacgtacgacggaaccgttagaaacggacgtaaccgggtaccgtttaacctaacgtacggtaccgtacggacggacggaccgtcccggtacccccccgggaacgggtacccggaaaccggtacgggtaacgttacgggtcgggggaaccgtaacgggtaccgttttacgggaccgtttaccgttaccgttaaccgtaccgttaaaccgg

SEQ ID NO: 187629 - DNA, 636 bp, Homo sapiens
  misc_feature: GYAE6OF01AE6QI.5.64.F09.1.454.CMB.1.raw
tcagatcagacacgcacgaccggtgctcgatttagcgcgtatacaaggggcatcacataacaaccagattcctcctctaaagaagcccctgggagcacagctcatcaccatggactggacctggaggttcctctttgtggtggcagcagctacaggtgtccagtccccaggtgcaactggtgcagtctggggctgaggtgaagacgccgtgggtcctcggtgaaggtctctgcaaggcgtcgtggggcaccgttcggacaagtttcgccagttacgttgggtgccgacacggcccctggacgaagggcttgagtggagtggggaggatccgtcccgtggtctttggacgcaggacaaaccgtcgcaacagtgacgtttccgaggggagacgtacgaacgtagttaccgggacggaacgaactacgtaccggccaacgtagtactagtcgtaggagacgtagaaacgtaacgtagagaccgtaggaacgacgtaccggtaccgtttactacgtacgaccgcgaacgacgtaccgtccccggaccccccgggaacgggacccggaacggtacggtacgtacgggtcggggaccgtaacggtcgtttcgggacctttaccgtaccttacgtaacgtacg

SEQ ID NO: 187630 - DNA, 560 bp, Homo sapiens
  misc_feature: GYAE6OF01AUAQV.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaggtctcctgcaaggcgtctgggggcaccttcggcaagtttgccattacttgggtgcgacaggcccctggacaagggcttgagtggagtggggagggatcgtccctgtctttggagcagcaaactacgcacatgtatttccgaggggagagtcacgattacggcggacgatctacggccacagcctatctggagctagaacacgtgacgacgtagaagacacggtaccgtttactacgtgcgcgagagacgtcccgccccccggaacgggaccgaacggaggtagtagggtcggggacgacgggtcgtttcgggtcctttacgtacttacctacgtacg

SEQ ID NO: 187631 - DNA, 597 bp, Homo sapiens
  misc_feature: GYAE6OF01ARMG0.5.64.F09.1.454.CMB.1.raw
tcagatcagacacgcacgaccggtgctcgatttagcgcgtatacaaggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccgttcggcaagtttgccattacgttgggtgcgacaggcccctggacaagggcttgagtggagtgggagggatcgtccctgtcgtttggagcagcaaactcgcacatgatttccgaggggagagtcacgagttacggacggacgaatcgtacggccacgacgacctagtctggagctagaacaacgtgacgaccgtagaagacgacggtaccgtttactacgtgcgacgaggacgacgtcccggaccccccggaacggggtacccggaacggacgggtagtacgggtcgggggaccgtaaccgggtcgtttacgggtaccctttacgtaccgttaccgtacgtaaccg

SEQ ID NO: 187632 - DNA, 605 bp, Homo sapiens
  misc_feature: GYAE6OF01CC425.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggccaccgttcggcaagtttcgcctattacgttgggtgcgacacggcccctggacgaagggcttgagtggagtgggaggatcgtccctgtcgtttggagcagacaactacgcacatgatttccgagggagagtcacggtagttacggacggacgaacgtcgtaccggccacgacgaccctagtcgtggacgcgtagaacaacgtagaacgtacctagaacgacgaccggtaccgtttacgtacgtgcgacgacgacgaccgtcccggaccccccggaacgggacccggaacggacggtaggtacgggtcggggacgtacgggttcgtttacgggtaccttacgtactaccgtacgtacg

SEQ ID NO: 187633 - DNA, 611 bp, Homo sapiens
  misc_feature: GYAE6OF01DAUR1.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccgttcggcaagtttgcctattacgttgggtgcgacaggcccctggacaagggcttgagtggagtgggaggatcgtcctgtcttggagcagacaactacgcacatcgatttccgagggagagtcacgattacggcgacgatcgtacgccacacgtcctatcgtggacgcgtagaacgaacgtgacgtacgtacgaacgacaacggtccgtttacgtacgtcgcgacgagacgacgtaccccggacccccccggaaggggacccgaaacggacgggttaacgtaacgggtcgggggaccgtaaccgggttccggttttcgggtaccctttaccgttaccgttaaccgttaccgttaaaccgg

SEQ ID NO: 187634 - DNA, 547 bp, Homo sapiens
  misc_feature: GYAE6OF01CKLML.5.64.F09.1.454.CMB.1.raw
  modified_base (371)..(371): a, c, t, g, unknown or other
  misc_feature (371)..(371): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccttcggcaagtttgccattacttgggtgcgacaggcccctggacaaggggcttggagtggatgggagggatcgtccctgtctttggagcagcaaactacgcacatgatttccgagggganagtcacgattacggcgacgaatctacggccacagcctatctggagctagaacaacgtgagactgaagacacggccgtttactactgcgcgagacgacgtccgacccccggagggcccgaacggaggtagaggtcggggacgaacgggcgtttcgggccttatacctacgtactacg

SEQ ID NO: 187635 - DNA, 634 bp, Homo sapiens
  misc_feature: GYAE6OF01AL6FL.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgaagacgcctgggtcctcggtgaaggtctcctgcgaaggcgtcgtgggggcctaccgttcggctaagtttcgcctagttaccgttgggtgcgacgacggcccctggacaagggtcttgagtggagtgggaggatccgtcctgtcgttggagcgagacaaacgtacgactacgatgtacttccggagggagacgtcgacgtagttacggacggacgaacgtcgtacggaccacgacgcctagtcgtggacgactacgaacgacgtagacgtaccgtagaacgacgaccggtaccgtttacgtacgtcgacgacgacgacgaccgacccggacccccggaacgggacccgaacggtacggtaagtacggggtcggggaccggtaaccggttcggtttaccgggtaccctttacgtaccgttacgttaccgtaaccgg

SEQ ID NO: 187636 - DNA, 828 bp, Homo sapiens
  misc_feature: GYAE6OF01D638D.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctggaggtgagacgcctgggtcctcggtgaaggtctctgcaaggcgtcgtggggcaccgttcggctaaggtttgcccagtttacgttggggtcgaccggacacgggtccccctagggacctaaggggtcctttggaacggttgggagttgggggaggtacgttccggtacccgttggttccgttttggacgtccgagaccgtaaacgtcgacacgtagtcgtacgtttaccggagggacgtacgtcgacggtacgttacgggacggtaacgtaacgttaccgtaaccggtaccgtaccgtaacggtacccgttaacgttaccggtagggtaaccggtaccgttacggtaaaacccggtaaccggttacggaaccggtaccggtttacggaaacgggtaacccgggttaaccggttacccggttttaaccgtaccggttacggtacccggtacgggtaacggaccgggtaaccgttacccccgggaaccccccccgggtaaagggggaccccgtaaacgggtaccggggttaacggtaaccggggttcgggggtaaccccgtaacggggttaccccgggttttacgggtaaccctttaccggttaacccgttaaccgttaaccggttaaaccccggg

SEQ ID NO: 187637 - DNA, 581 bp, Homo sapiens
  misc_feature: GYAE6OF01BDBXR.5.64.F09.1.454.CMB.1.raw
  modified_base (368)..(368): a, c, t, g, unknown or other
  misc_feature (368)..(368): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccgttcggcaagtttgccattacttgggtgcgacaggcccctggacaagggcttgagtggatgggaggatcgtcctgtctttggagcagcaaactacgcacatgatttccgagggganagtcacggtattacgggcggaacgaactcgtacggccacacgcctatcgtggagctagaacaacgtgagacctagaacgacgacggtaccgtttacgtacgtgcgcgagagacgtcccgccccccggaacggggcccgaaccggacggtagtacgggtcggggacgtacgggtacgtttcgggaccctttacgtacctaccgtacgttaaccg

SEQ ID NO: 187638 - DNA, 570 bp, Homo sapiens
  misc_feature: GYAE6OF01BE8XS.5.64.F09.1.454.CMB.1.raw
tcagatcagacacgcacgaccggtgctcgatttagcgcgtatacaaggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgaggtgaagacgcctgggtcctcggtgaaggtctcctgcaaggcgtcgtgggggcaccttcggcaagtttgccattacgttgggtgcgacaggcccctggacaagggcttggagtggagtgggaggatcgtcccgtgtcgtttggagctagcaaacgtacgcacatgattccgaggggagagtcacgattacggcggacgaatcgtacggccacacgcctatcgtggacgcgtagaacaacgtgacgactaggaagacgacggtaccgttaacgtacgtgcgacgagagacgtccgaccccccggacgggaccgaacggacggtagtacggtcggggacgtaacggtcgtttcgggccttacgtactccgtacgtacg

SEQ ID NO: 187639 - DNA, 583 bp, Homo sapiens
  misc_feature: GYAE6OF01E3FQS.5.64.F09.1.454.CMB.1.raw
  modified_base (352)..(352): a, c, t, g, unknown or other
  misc_feature (352)..(352): n is a, c, g, or t
  modified_base (371)..(371): a, c, t, g, unknown or other
  misc_feature (371)..(371): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccttcggcaagtttgcctagttactggggtgcgacacggcccctggacaagggcttgagtggatgggaggatcgtcctgtctttggagcagcaaactcgcanagtgactttccgagggganacgtacacgagttacggcgaacgaatcgtacggccacgacgctatcgtggacgctagaacacgtgacgactagaagacgacggtaccgttactacgtcgcgacgtagacgacgtcccggacccccggaaggggacccgtaacggacggtaagtacgggtcggggtacgaaccggttcgtttacgggacctttacgtacttacgtacgtaacg

SEQ ID NO: 187640 - DNA, 714 bp, Homo sapiens
  misc_feature: GYAE6OF01C3YDH.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctggtgaaggtctcctgcgaaggcgtcgtgggggcaccgttcggctaagtttgcctagttacgttgggtcgcgtacgacggccccgtggacgaagggcttgagtggagtgggaggatccgtcctgtctttggagtcgagcaaacgtcgacacagtcgtacgttaccgaggggagacgtacgacggtacgttacgggacggtaacgagtacgtaccggaccgacgacgtaccgttaacgtcgtagggaagccgtacgaaaccgtaacggtaggaacgtaccgtacggaaacgaaccggtaaccgggttacccgtttaaccgtaccgtacggaccggtacggaacggaccggtaccgtacccccgggacccccccgggtaaacgggggaccccggtaacgggtaacgggttaacggtacggggtacgggggtaccggtaaccggggtttccgtttacggggtaccctttaccgttaacccgttaaccgtaaccgttaaccgg

SEQ ID NO: 187641 - DNA, 570 bp, Homo sapiens
  misc_feature: GYAE6OF01CRKF9.5.64.F09.1.454.CMB.1.raw
  modified_base (364)..(364): a, c, t, g, unknown or other
  misc_feature (364)..(364): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcacttcggcaagtttgccattacttgggtgcgacaggcccctggacaagggcttgagtggatggaggatcgtcctgtctttggagcagcaactacgcacatgatttccgagggganagtcacggattacggcgacgaatcgtacggccacgagccctatcgtggagctagaacacgtgagacctagaacgacgacggtaccgttacgtacgtgcgcgagagactccggaccccccggacgggcccggaacgacgggtagtaacggtcgggggaccgtaacggtccgtttacgggccctttacgtaccttacgtaccgtaacg

SEQ ID NO: 187642 - DNA, 703 bp, Homo sapiens
  misc_feature: GYAE6OF01DS8G9.5.64.F09.1.454.CMB.1.raw
  modified_base (428)..(428): a, c, t, g, unknown or other
  misc_feature (428)..(428): n is a, c, g, or t
tcagatcagacacgcacgaccggtgctcgatttagcgcgtatacaagggggcatcacataacaaccagattcctcctctaaagaagcccctgggagcacagctcatcaccatggactggaccgtggaggttcctctttgtggtggcagcagctacaggtgtccagtcccgaggtgcaacgtggtgcagtcgtggggctggaggtgaagacgccgtgggtccgtcggtagtaaggtctccgtggacgaagggccggtcggtcgggggcctaccgtttcggacgtaaagtttcggacctaagttaccgttggggtgaccgacgaccggcccccgtaggaaccgtaagggcttaggagtggagtgggaggactcgtcccgtgtcgttggagcagtacaaacgtcgactagatgtacgttccgaaggggtanagtacgaacgtagttaacggacggaacggaataccgtacggaccaacgacgtaccctagtaccgtaggtaccgtagtacgaaaccgtaacggtacgtaacggaactaaggaaaccgaacgtaccggttaacccgtttacgacgttcggaccgttacgaacggacgacccgtccccggaaccccccgggtacgggaaccgtaacgggagggtaacgtacggggtccgggacgtaacggttcgttacggtccttaaccgtacgttactacgtaacgg

SEQ ID NO: 187643 - DNA, 624 bp, Homo sapiens
  misc_feature: GYAE6OF01BAET9.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgaggtgaagacgcctgggtcctcggtgaaggtctcctgcaggcgtcgtgggggcaccttcggcaagtttgcctattacttgggtgcgacacggcccctggacaagggcttgaggtggagtgggaggatcgtcctgtcgtttggagcagacaaactcgcacatgtactttccgaggggagagtacgaacggtagttacgggacggaacgtaacgtacgtaccggaccgaacacgaccctagtcgtaggacgtacgtacgaacgaacgtgacgaccgtagaacgacgaacggtacccgtttacgtacgtgaccgacggacgacgaccgtacccggaccccccggaacggggacccggaaccggacgggtagtacgggtcggggaccgtaacgggttcgtttcgggtaccttacgtaccgttacgtaacgtacg

SEQ ID NO: 187644 - DNA, 747 bp, Homo sapiens
  misc_feature: GYAE6OF01DDI9P.5.64.F09.1.454.CMB.1.raw
tcagatcagacacgcacgaccggtgctcgatttagcgcgtatacaagggggcatcacataacaaccagattcctcctctaaagaagccccctgggagcacagctcatcaccatggactggacctggaggttcctctttgtggtggcagcagctacaggtgtccagtcccaggtgcaactggtgcagtcgtggggctgaggtgaagacgcctgggtcctcggtgaaggtctcctgcaggcgtcgtggggcctacgttcggctaagtttcgcctagttacgttgggtgcgacgacggccccgtaggacgaagggtcttggaggtggagtggggagggactccggtcctggttcgtttggacgtcagacaaacgtacgacaacgagttgtacgtttaccggaggggtagacggtaccgaggtaacggttaccgggacgggtaacgaacgttccgtaaccgggccctaacgtacgtacccttaacgtcgtagggacggtaaccgtacggtaaaaccgtaaccgggttacgaacggtaacccgttaggaaaccggtaaccggtacccggttaacccggttttaaccgtaccgttaccgggaccggtacgaacgggtaccgtaacccggtacccccgggacccccccgggtaaacgggggacccgaacgggtacggttaacgggtacggggtcggggaccgtaacgggttcgtttaccgggtaccctttacgtaaccttacgtaccgtaacgg

SEQ ID NO: 187645 - DNA, 828 bp, Homo sapiens
  misc_feature: GYAE6OF01ASFLX.5.64.F09.1.454.CMB.1.raw
tcagatcagacacgcacgaccggtgctcgatttagcgcgtatacaaggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgccgtgggtcctcggtgaacggtctcctgcgaaggcgtcgtgggggcaccgttcggctaagtttgcctattacgttggtgcgacgacggcccctggacaagggcttgagtggagtgggaggtatccggtcctggttcgtttggagcgagcctaaaacgtaccgcaacgtagtacgtacgtttaccggagggggtaacgtacggtaccgaacggtaacgtttaaccggggaccgggtaacggtaacgttaccggttaaccgggacccgaaaccgtacgggtaccccgttaacgttaccggttacgggaacggtaccgttaacggaaaaccggtaaaccggtacggtaacggtaacccgtaagggaaaccgggaaccgtaacccggggtttacccggttttaaccggttaaccgttaccgggtaccgaaccggtaagggtaaccggtacccggtaacccccgggtaccccccccggggaaaccgggggaccccggtaaacgggtaccgggtaagggttaaccgggggtacccgggggtacccggtaaacccggggtttaccgggtttttacccgggtacccggttttacccgtaaccgttaaacccggttaaccgttaaacccggg

SEQ ID NO: 187646 - DNA, 586 bp, Homo sapiens
  misc_feature: GYAE6OF01AZM6R.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccttcggcaagtttgccattacttgggtgcgacaggcccctggacaagggcttgagtggatgggagggatcgtcctgtctttggagcagcaaactcgcacatgatttccgagggagagtcacgattacggcggacgaatcgtacggccacacgcctatcgtggacgctagaaccgaacgtagacgaccgtgaacgacgaccggtaccgtttaccgtacgtcgcgacgagacgactcccggacccccccggaacggggacccgaaccggtaggtacgtacgggtcggggaccgaacgggtcgttttcgggccttacgtaccgttacgtacgtaaccg

SEQ ID NO: 187647 - DNA, 697 bp, Homo sapiens
  misc_feature: GYAE6OF01EJPAF.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccgttcggcaaggttttcgccctatttaccgttggggtgccggacacgggccccctgggacaagggggtcttggaggtgggagtggggagggtatcgtcccgtgtcgtttggacgcagccaaactacgcactatgatttccgaggggtagacgtcgaacgtagttacgggacggaacgtaagtcgtacggccacgacgtcctaagtcgtaggacgcgtagaacgacgtagacgtacctaggaacgtacgaccggtccgtttaacgtacgtacggaccgtcgaacggacggtaaccgtccccggaaccccccccgggaaacgggggaccccgaaaccgggtaacgggtaacggttacggggtacggggggtacccgtaaacccggggttcggttttaccggggtaccctttacccggttaacctttaaccggtaaccgttaaacccgg

SEQ ID NO: 187648 - DNA, 808 bp, Homo sapiens
  misc_feature: GYAE6OF01DXQJB.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctggaggtgaagacgcctgggtcctcggtgaaggtctcctgcaggcgtcgtggggccacgttcggactaaggtttcgacctatttaccgttggggtcgaccgacgacggccccctagggaaccgaaaggggtccgttaggacggttgggagtgggggagggtacttccggtaccccgttggttcgttttgggacgtcgtaaggacctaaaaccgtacgacctaacgtaacgttaggtaacgtttacccggaagggggagtacggtaccgtaaacggacgttttaaccggggacggtaacggtaacgtaccgtaaccgggacccgaacgtacgtacccgtacgttccgtagggaacgtccgtaacggtaaaccgtaaacggtacgacggtaaccgtaacggaacggtaaccggtaacccggttacccgtttaaccgtaaccgtcggtaccggacggtaacggtaccgtaaccggtacccccgggacccccccgggaaacgggggtaccccgaaaccgggtacgggttaacggtacggggtaccggggaccgttaaacgggtcccggtttttacgggtaccccgtttaccgttaaccgttaaccgtaccgtaaccgg

SEQ ID NO: 187649 - DNA, 578 bp, Homo sapiens
  misc_feature: GYAE6OF01C8QY7.5.64.F09.1.454.CMB.1.raw
  modified_base (383)..(383): a, c, t, g, unknown or other
  misc_feature (383)..(383): n is a, c, g, or t
  modified_base (445)..(445): a, c, t, g, unknown or other
  misc_feature (445)..(445): n is a, c, g, or t
  modified_base (482)..(482): a, c, t, g, unknown or other
  misc_feature (482)..(482): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctggaggtgaagacgccgtgggtcctcggtgaaggtctcctgcaaggcgtcgtgggggcaccgttcggcaagtttcgccattacgttgggtgcgacgacggcccctggacgaagggcttggagtggagtgggaggagtcgtcccgtgttcgttggagcagacaaactacgcacatgtacttcgagggagngtcagagttacggcgtacgactcgtacgccacgacgctagtcgtaggcgctagaacgtacgngagacgtagaacgacgacgtacgttactacgtgacgngagagtaccgtcccgacccccggagggaccgacgtacggtagtacggtcggggacgtacggttcgttcggtaccttacgtaccgtacgtacgtacg

SEQ ID NO: 187650 - DNA, 615 bp, Homo sapiens
  misc_feature: GYAE6OF01DKJBG.5.64.F09.1.454.CMB.1.raw
  modified_base (321)..(321): a, c, t, g, unknown or other
  misc_feature (321)..(321): n is a, c, g, or t
  modified_base (372)..(372): a, c, t, g, unknown or other
  misc_feature (372)..(372): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgaggtgaagacgcctgggtcctcggtgaggtctcctgcaaggcgtcgtgggggcaccgttcggcaagtttcgcctattacgttgggtgcgacaggcccctggacagggcttgagtggagtgggaggtntcgtcctgtcgtttggagcagcaaacgtacgcacagtgattccgagggganagtcacgtatacgggacgacgaatcgtacggacacgacgcctatcgtggacgacgtagaacaacggtgaacgaccgtaggaacgaccgtaaccggtaccgtttaacctacgtcggacggacgtacggacgtaccgtaccccggacccccccgggaaggggacccgaacggtaaggtagtacgggtcggggaaccgtaacgggttccgttttcgggaccttacgtaccgttacgtacgtaacgg

SEQ ID NO: 187651 - DNA, 756 bp, Homo sapiens
  misc_feature: GYAE6OF01BUXXY.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctgaggtgaagacgcctgggtcctggtgaaggtctccgtgcgaaggcgtcgtcgggggcctaccgttcggactaagtttcgcctagtttaccgtttggggtgtcggacgacgggtccccctagggaaccgtaaggggtccgtttaggaggttggggaggttagggggaaggggtagttccggttaccccgtttggttccgttttaggggaacgtccgaagtaccgtaaaaccgtccggacacaacgttggtaacgtttcccggaaggggtacgtaacggtacctaacggtaacggttaacgggaccggtaacggtaacgtccgtaaccggacccaacgtacgtacctacgtccggtaggacgtacgtaagtaaacgtaacgtcgaacgtacccgtaagaacggaccgtaaccggtaccgtttaaccgtacgtacgcggacgacggacggaccgaccccgggaccccccgacggggacccggtaaacggtacgggtacggtacgggtccggggaccgtacgggttcggtttacggtacccttagtaaccttacgtacgtaacgg

SEQ ID NO: 187652 - DNA, 586 bp, Homo sapiens
  misc_feature: GYAE6OF01ANU42.5.64.F09.1.454.CMB.1.raw
  modified_base (353)..(353): a, c, t, g, unknown or other
  misc_feature (353)..(353): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccttcggcaagtttgccattacttgggtgcgacaggcccctggacaagggcttgagtggagtgggagggatcgtccctgtctttggagcagcaaactacgcanatgatttccagggagagtcacgtatacggcggacgaatcacggccacacgcctatcgtggagcgtagaacaacgtgagaccgtgaacgacgacggtaccgttactactgacgcgagacgacgtcccggaccccccggaacggggacccggaaacggacggtagtacgggtcggggtacgtaaccgggtcgttttcggggtacccttacgttaccgttacgttacgtaaaccgg

SEQ ID NO: 187653 - DNA, 681 bp, Homo sapiens
  misc_feature: GYAE6OF01EVTEY.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtatccagtcccaggtgcaactggtgcagtctggggctgaggtgaagacgcctgggtcctcggtgaaggtctcctgcaaggcgtcgtgggggcaccttcggcaagtttgccattacgttgggtgcgacaggcccctggacaagggcttgagtggagtgggaggatcgtcctgtctttggagcagcaaactacgcacatgatttccgaggggagacgtcacgacgttacgggcggacgaatccgtaccggccacgacgtcctactcgtggacgcgtacgaacgtaacgtacgacgtaacctacggaagaaccgtaaccgggtaccgttttaaccgttaccgttacggaccgtaccggaacggtacggtaaccgtaccccgggaccccccccgggaaacgggggaccccggaaaccgggtacgggttaacggttaacggggtcggggggaccggttaaaccgggtaccggtttttacggggtccccgtttaaccgttaacccgttaaccgttaaccgttaaacccgg

SEQ ID NO: 187654 - DNA, 653 bp, Homo sapiens
  misc_feature: GYAE6OF01E2HBI.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctgaggtgaagacgctggtcctcggtgaaggtctcctgcaaggcgtcgtcgggggcaccgttcggctaagtttgcctatttacgttgggtgcgacgacggccccgtggacgaagggcgttggaggtggagtggggagggagtccgttcctggttcgtttggacgcagacaaactacgcacgatgtatttaccggaggggagtacgtacgacgtagttacggacggacgtaacgtacgtacggacccacgacgcccttagtcgtgacgtcgtacgaactaacgtacgacgactaggaacgacgtaccggtaccgttactacgtacgtcgacgagacgaccgtccccggaccccccggacggggacccgaacgggtacggtaacggtacgggtcggggtaccgtaaccgggttccgtttacgggtacccgttaccgttaaccgtaccgttaacgttaaccgg

SEQ ID NO: 187655 - DNA, 826 bp, Homo sapiens
  misc_feature: GYAE6OF01C0DXX.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacgaggtgtccagtcccaggtgcaactggtgcagtcgtggggctgaggtagaagaccgccgtcggggtcctcgggtagtaacggtctccgtgaccgaaggcggtcgtcgggggtccaaccgtttcggactaaaggttttcgaccgttaacgtttaaccggtttggggtcgaccggtaaccgaacgggtcccccgtaggggaaccgtaaagggggtcctttagggagggtgggtaaggtaggggggtaacgggtacgttaccccggtcccgtttgggtttaccggtttggggaacggaccgagggaaacctaaaaccggtaccgaactaaccgtagttacgttaacggttttacccgggaagggggtaacgacggttaccgtaaccggtaaggtttaaccggggaaccgggtaacgtaaacgtaccggtaccggacctaacgtacgtacccttacgtaccgtagggacgtacgtacgaaacgtaacggtacgaacgtacgtaacggaaacgtaccgtaaccggttaccggtttacctacggttacggacggtacgaacgtaccgtaccgtaccccgggaacccccgggaacgggtaccggaacggtaggtaacggtagggtacggggaccgtacgggttcgttcgggtaccgttctaacgtacgtaaccgttacg

SEQ ID NO: 187656 - DNA, 705 bp, Homo sapiens
  misc_feature: GYAE6OF01DN6R0.5.64.F09.1.454.CMB.1.raw
  modified_base (349)..(349): a, c, t, g, unknown or other
  misc_feature (349)..(349): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgaagacgccgtgggtcctcggtgaaggtctcctgcaagggcgtcgtgggggccaccgttcggcaagtttgcctattaccttgggtgcgacaggcccctggacaagggcttggagtggacgtgggagggatcgtcctgtctttggacgcancgaaactacgcacatgatttccgaggggagagtcacgattacggcggacgatacgtacggccaacacgtaccctagtcgtacggtagtcgtagaaaccgtaacgtacgtaacggaacctacggaacgaccgtaaccgggtacccgttttaaccacgttacggacggtacgaacggacggtaaccgtacccccggtacccccccccgggaaacggggtaccccgggtaaaccgggtaaacgggttaaccgggtacggggtacccgggggggtaacccgtaaacccggggttaccgtttttaccgggggtcccctttaaccgtttaacccggttaaaccgttacccgttaaacccggg

SEQ ID NO: 187657 - DNA, 602 bp, Homo sapiens
  misc_feature: GYAE6OF01BVLB1.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctgaggtgaagacgcctgggtcctcggtgaggtctcctgcaaggcgtcgtgggggcaccgttcggctaagtttcgcctatttacgttgggtgcgacgacggcccctggacgagggtcttgaggtggagtgggaggatcgtcctgtcttggagcagacaactacgcacagtgtacgttccgagggagagtcacgtagtacggacggacgaacgtcgtaccggccacgacgtcctagtcgtaggacgactagaacgacgtagacgaccgtagaacgaccgacggtaccgtttacgtacgtcgcgacgacgacgaccgtccccggacccccggagggacccgaacggacggtagtacgggtcggggacgtaccgggtcgtttcgggtaccttaccgtacttacgtcgtaacg

SEQ ID NO: 187658 - DNA, 708 bp, Homo sapiens
  misc_feature: GYAE6OF01EBE6L.5.64.F09.1.454.CMB.1.raw
  modified_base (238)..(238): a, c, t, g, unknown or other
  misc_feature (238)..(238): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccgaggtgcaacgtggtgcagtcgtgggctggaggtgaagcgcgtgggtcctcggtgagtctcctgcaaggngtcgtgggggcctaccgttcggactaagtttcgcctattacgttgggtgcgacgacgggcccccggagaaggggtcttaggacggtggagtggggagggtactccggtcccttggttcgtttgggacgtcacggactaaacgtacgaccacgtagtcgtaagttttcccggaaggggacgtacggtaccgaacggtacgttaacgggacgggtaacgaacgttaccggtaaccgggacccaacgtaccggtaccttacgtacggttacgggagtaccggtaacgaaaccgtaacggtacggaacgacccggtagaaacggaccgtaccggtaccgtttaacgtacgtcgtaccggacgaaggacgaccggtccccggacccccgggaaggggacccgaaggtacgggtacgtagggtcggggacctacgggttcgttcgggtaccttacgaccgttactaccgtgtacgg

SEQ ID NO: 187659 - DNA, 831 bp, Homo sapiens
  misc_feature: GYAE6OF01D08VQ.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaacgtggtgcagtcgtggggctggaggtgaagacgccgtgggtccgtcggtgaacggtctccgtgacgaaggcgtcggtgggggcctaccgttcggctaagtttcgacctagttacgttgggtcgacgacgacgggtcccccgtgggaaccgaaggggtcctttgggaaggttgggacggtagggggtacgggtacgttcccggttacccgttggtttccggttttagggacggaccgtaacggtaacccgtaaaacgttaccggaccgtaaacgtaacgttacggttaacgttttacccgggaaagggggtacgtaacgggtaccgtaaacggtacggttaaccggggacgggtaaaccgtaacgtaccgtaacccgggacccgtaacgtaaccggtacccgttaacgttcgtacgggtaacgtaccgtaacggaaaaccgtaacggtacgaacgtaaccgtaacggaacgtaaccgtaaccggtaccgtttaacgtacggtcgaccggtacgaacggaccgtacccggacccccggaccccccgggaacggggaccccggaacggtaacgggtacggtacggggtacggggtaccgtaaccgggtttcggtttacgggtacccgttacgttaaccgttaccgtaacgttaaccgg

SEQ ID NO: 187660 - DNA, 685 bp, Homo sapiens
  misc_feature: GYAE6OF01CIMQ7.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcacgttcggctaagtttcgcctagttacgttgggtgcgacgacggcccctggacgaagggtcttaggagtggagtgggagggtatcgtccctgttctttggagcagacaaactcgacacagtgatttccgagggagtacgtacgacggtagttacgggcgtaacgtaacgtaccgtaccgggacccaacgacgtaccctaagttcgtagggacggtactacggaaaccgtaacggttacggaacggaacccgttaggaaacgtaccgaaccgggttacccgttttaaccgtaaccgtcggtaccgaccggagacgaaccgtcccgggacccccccggaaggggacccgaacggtacggtaacggtacgggtcgggggaccgtaacgggttccggttttacgggtacccttaccgtaaccgtaccgtacgttaaccgg

SEQ ID NO: 187661 - DNA, 604 bp, Homo sapiens
  misc_feature: GYAE6OF01CE6O4.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgaggtgaagacgcctgggtcctcggtgaaggtctcctgcaaggcgtcgtgggggcaccttcggcaagtttgcctattacgttgggtgcgacgacggcccctggacgaagggcttgagtggagtgggagggatcgtccctgtctttggagcagacaacgtacgcacatgagtttccgaggggagagtacgacggagttacgggacggtacgaagtccgtaccggccaacgagtaccctagtcgtaggacgcgtagaacgaacgtagacgacgtagaacgacgaccggtaccgtttacgtacgtcgcggacgtagacgacgtcccggaccccccggacgggacccgaacggacggtagacgggtcggggacgtaacggtcgtttcgggtaccttacgtactactacgtaaccg

SEQ ID NO: 187662 - DNA, 598 bp, Homo sapiens
  misc_feature: GYAE6OF01EKT7J.5.64.F09.1.454.CMB.1.raw
  modified_base (374)..(374): a, c, t, g, unknown or other
  misc_feature (374)..(374): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaggtctcctgcgaaggcgtcgtgggggcaccgttcggcaagtttcgccattacgttgggtgcgacaggccccctggacaagggcttggagtggagtggggaggagtcgtcctgtcgtttggagcagcaaactcgcacatgatttccgaggganagtcacgtagttacgggcggaacgaagtctaccggaccacgacgtcctagtcgtagggacgtctaggaacaacggtgacgtaccgtagaacgacgaccggtaccgttactacgtgcgcgagacgaccgtccccggacccccggaggggacccgaaggtacggtagtacgggtggggaccgtaacgggttcgtttccgggaccttacgtacctacgtacgtaacg

SEQ ID NO: 187663 - DNA, 661 bp, Homo sapiens
  misc_feature: GYAE6OF01CIGA8.5.64.F09.1.454.CMB.1.raw
tcagatcagacacgcacgaccggtgctcgatttagcgcgtatacaagggggcatcacataacaaccagattcctcctctaaaagaagcccctgggagcacagctcatcaccatggactggacctggaggtttcctctttgtggtggcagcagctacgaggtgtccagtcccaggtgcaacgtggtgcagtcgtgggctggaggtgaagacgccgtgggtcctggtgaggtctccgtgcgaggcgtcggtggggctaccgttcggctaaggtttcgctagttacgttgggtcgcgacgcggcccctaggacgaagggtcttggagtggagtgggaggtacgtccgtccgttgttcgttaggacgcgaagtaccaaacgtcgactacgagttcgtacgttacggaagggtacgtacgtacgtaacggtacgttaccgggacggtaacgtaacgttaccgtaccggaccaacgtacgtaccctagtacgtaggacgacgtaacgaacgtacgtagacgtacgtagaacgtaccgtacgttaccgttacgtacgtcgacgacgacgacgaccggtccccggacccccgggacgggaccgaacggacggtaggtacgggtcgggacgtacgggttcgttcggtaccttagtacctacgtacgtacg

SEQ ID NO: 187664 - DNA, 912 bp, Homo sapiens
  misc_feature: GYAE6OF01AN1SY.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccgttcggcaaggtttcgcctagtttaccgttgggtgccggtacacggcccccgtaggacgaaggggtcttggagtggagtggggagggactccgtccccgtggttcgtttagggacgtcgaacgtaccaaaacgtacggaccaacgagttaggtaacgttttaccggaagggggtaacgtacgggttacgaaacggtaacggtttaacggggtaccgggtaaccggtaaacgttacccggttaaacccggggacccccgtaaccgtaacggtaccccgttaaacggttaccgtacgggggtaacgtaccggttaaccgggtaaaaccgtaaacccgggttaacggtaaaccggtaacccggttaagggaaaccggtaacccggttaacccgggtttaaccccggtttttaaacgttaacccggttacgggtacccggtacggtaaacgggtaccgggtaaccgttacccccccggggaaccccccccccggggaaaacccgggggggttaccccgggaaaaacccggggttaacggggttaaaccggttaacgggggtaccgggggggtaacccgtaaacccggggtttcccgggtttttacggggtacccccgtttttaaccggtaacccgtttaaacccgttaacccggttaaacccgg

SEQ ID NO: 187665 - DNA, 717 bp, Homo sapiens
  misc_feature: GYAE6OF01CX5XW.5.64.F09.1.454.CMB.1.raw
  modified_base (513)..(513): a, c, t, g, unknown or other
  misc_feature (513)..(513): n is a, c, g, or t
tcagatcagacacgcacgaccggtgctcgatttagcgcgtatacaaggggcatcacataacaaccagattcctcctctaaagaagcccctgggagcacagctcatcaccatggactggacctggaggttccttcgtttggtggtggcagcagctacgaggtcgtccagtcccgaggtcgcgaacgtggtgcgagtcgtggggctggaggtgaacgcgccgtcgggtcctcggtaggaacggtctccgtgacgaggcgtcgtgggggcctaccgttcggactaagttcgacctagtttacgtggtcgaccgacgaccggccccgtaggacgaagggtcttggacggttaggaggttggggaacgggtcgtccggttacccgttggttcgtttaggagtacgacgaaccgtaaaccgtcgactaagattgtacgttccggagggtacgaagtcgaacggtagtacggacgggaacgtacgtacgacggtccacgacgtacctacgtacgacgganacgtacgaacgtacgtcgacgtaccgagaacgacgtacggtaccgtttacgaccgtacgcgacgtaacgaccgtaccgtcccccggtaacccccgggaacggggacccgtaaacgggtacggtaacggtacgggtaccggggtaccgtacgggtttaccggtttccgggtaccctttaacggtaccgttaacgtccgttaacgg

SEQ ID NO: 187666 - DNA, 533 bp, Homo sapiens
  misc_feature: GYAE6OF01A2DCI.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggcaccttcggcaagtttgccattacttgggtgcgacaggccccctggacaagggcttgagtggatgggagggatcgtccctgtctttggagcagcaaactacgcacatgatttccaggggagagtcacgattacggcggacgaatctacggccacagcctatctggagctgaacaacgtgagacctgaagacacggccgtttactactgcgcgagacgatcgcccccccgaaggggcccgaacgcggtatagtggggcaacggctttggccttctactactctaacg

SEQ ID NO: 187667 - DNA, 864 bp, Homo sapiens
  misc_feature: GYAE6OF01BATSO.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaggtctctgcaggcgtcgtggggcaccgttcggctaagtttcgcctagttacgttggggtgccgacgacgggtcccccgtgggaaccgaaggggtccttaggaggttgggaggtgggggagggtacgttccggtccccgttggttccgttttagggacgtcgtaacggtaccgtaaaaccgttaccgactaacgtagttacggtaacgttttacccggaagggggtaacgtacggtacgtaacggtaacgttaccggggacgggtaaccggtaaacgttaccggttaacccggacccgtaacgtaccggtacccgttaacgtacggtacgggaacggtaccgtaacggaaaccgtaaaccggttacggaacgtaacccggttaggaaccggtaaccggtaacccgggttacccgtttaaccgtaccggttacggaccggtacggtaaccggacggtaaccccggtaccccgggaaccccccccggggtaaaccgggggtaaccccggtaaacccggggtaacgggttaacccgggttaacgggggtaccgggggtaacccggttaacccggggtttaccggttttaccggggtaccctttacccggttaaacccgtttaaccggttaacccgttaaacccggg

SEQ ID NO: 187668 - DNA, 669 bp, Homo sapiens
  misc_feature: GYAE6OF01DWUMA.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctggaggtgaagcgcgtgggtcctcggtgaggtctcgtgcgaggcgtcggtggggcctaccgttcggactaagtttcgcctagttacgttgggtcgcgacgacggcccctggacgaagggtcttggagtggagtgggaggtctcgtccgtgtcgtttggagcgagacaaacgtcgacactatcgtacgttccggagggacgtagtacgaacggtacgtacgggacggtaacgtaacgtaccgtaaccggaccacgacggtacccttagtcgtaggacgtcgtaacggaacgtaacggtagaacgtacgtaggaacgaccgaccggttaccgttacgtacgtaggaccgacgaacgacgaccgaccccggacccccgggacgggaacccggtaacgggacggttaaggtacggggacggggaccggtaaccggttccggtttcgggaccctttacgtaccgttaaccgtacgtaacgg

SEQ ID NO: 187669 - DNA, 661 bp, Homo sapiens
  misc_feature: GYAE6OF01DESEM.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgaagacgcctgggtcctcggtgaaggtctcctgcgaaggcgtcgtgggggccaccgttcggcgtaagtttcgcctagttacgttgggtgcgacgacggccccgtggacgaagggcttggaggtggagtggggagggtatccggtcccgtgttcgtttggagtcagacaaacgtacgacacatgtactttccgagggagacgtcgaacggagttacgggacggtacgaacgtccgtaccggccaacgacgtaccctagtcgtaggacgtctacggaacgtaacgtagaacgtaccgtaggaacgaccgtaaccggtacccgtttactaccgtgacgcgagtacgaccgtcccccggaccccccggaacggggacccgaacggtaacggtaacgtacggggtcggggacgtaaccgggttcgtttacgggtaccctttaccgtaaccttaccgttacgtaaccg

SEQ ID NO: 187670 - DNA, 659 bp, Homo sapiens
  misc_feature: GYAE6OF01BO8JM.5.64.F09.1.454.CMB.1.raw
tcagatcagacacgcacgaccggtgctcgatttagcgcgtatacaagggggcatcacataacaaccggattcctcctctaaagaagcccctgggagcacagctcatcaccatggactggacctggaggttcctctttgtggtggcagcagctacaggtgtccagtcccaggtgcaactggtgcagtctggggctggaggtgaagacgccgtggtcctcggtgaaggtctcctgcgaaggcgtcgtgggggccaccgttcggctaaggtttcgcctattacgttgggtgcgacgacggcccctggacgaagggtcttggaggttggagtggggagggtactcgtcccgtggttctttgggagcgacgacaaaccgtcgacaactagtcgtaactttccggaggggaagacgtacgaacggtacggttaacgggcgggaaccgtaacgtaccgtaccggaccgacgtaacgtccgttacgtaccgtagggagaccgtacgaaaccgtaacggtgaacgacgtacgaacgaccgtacggtaccgtttaacgtacgtcgcgacgtagacgaccgtccccgacccccggaaggggaccgaacggacggtagagggtcgggacgacggtcgtttacgggaccttacgtactacgtacgtgtacgg

SEQ ID NO: 187671 - DNA, 584 bp, Homo sapiens
  misc_feature: GYAE6OF01A1BMZ.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctggaggtgaagacgcctgggtcctggtgaaggtctcctgcaaggcgtcgtgggggccaccgttcggcaagtttgcctattacgttgggtgcgacaggccccgtggacgaagggcttgagtggagtgggagggatccgtccctgtcgtttggagtcagcaaactcgcacgatgtatttccgaggggtagagtcacgtattacggcggaacgaatcgtacggccacacgcctatctggagctagaacaacgtgaacgactagaacgacgaccggtacctttactacgtgccgacgaggacgacgtcccggaccccccggagggacccgaacggaggtagtagggtcggggacgacggttcgtttcgggccttacgtacctacgtacgtacgg

SEQ ID NO: 187672 - DNA, 670 bp, Homo sapiens
  misc_feature: GYAE6OF01C2TIH.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctggaggtgaagacgccgtgggtcctcggtgaagtctcctgcaaggtcgtcgtggggcaccgttcggctaagttgctattacgttgggtgccgacgacggccccgtaggacgaagggtcttaggagtggagtgggagggtactcggtccctgttcgttggagtcgagccgaaacgtcgacactatcgtagttccggaggtacgtagtacgaacggtagttaccggacggaacgtaacgtaccgtacgggacccaacgacggtaccctacgtacggtaggtacgtaccgtacgaaacgtaaccggtagaaccgtacgtagaacgacgtaccggtaccgtttaccgtaacgtcgacgtacgacgacgtacccgacccggacccccgggtaacgggaacccgaacggtacggtaggtacgggtcggggaccgtacgggttccgtttacggtccgttaacgtccgtaacgtaccgttaacgg

SEQ ID NO: 187673 - DNA, 747 bp, Homo sapiens
  misc_feature: GYAE6OF01D9KG3.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtgcagcagctacaggtgtccagtcccaggtgcaacgtggtgcagtcgtgggctggaggtgaagacgccgtgggtcctcggtagtaggtctccgtgcgaaggcgtcgtgggggctaccgttcggacgtaagttcgcctagttacgttgggtcgcggacgaccggccccggacgtaacgggtcgtgaggtggagtggggacggtagtccggtccgttgttcgttaggacgcgacgactaacgtacgacacagtacgtactttcggaggtacgacgtcgaacgtaggtacggacggtaacgtacgtaccgtacgacccgacgtacgtacccgtatccggaggtaccgaccgtaagaaaccgtacggtacgaacggttaccgtaaggaacccggtaccgtaccgggtttacccgtttaacacccggtcggacccggtaaacgacggtacccggtacccggtaccccccgggacccccggggtaacgggacccgggtaaaccggtaccggggttacgtacgggggaacggggtcccgggttaacccgtttccgggtttacccggttacccgtttaccgaaaccggtttacgaaacccgttcgggttaacgg

SEQ ID NO: 187674 - DNA, 643 bp, Homo sapiens
  misc_feature: GYAE6OF01DQJRT.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctggaggtgaagacgcctgggtcctcggtgaaggtctctgcaggcgtcgtggggcaccttcggctaagtttcgacctattacgttgggtgcgacacggcccctggacaagggtcttggagtggagtgggaggatcgtcctgtctttggagcgagactaaacgtacgacacatgtagttccgagggacgagtacgaacgtacgttacgggacggaacgtaacgtaccgtacggaccacacgtacctagtcgtaggacgtactacggaaactaacgtagaacgtaaccgtagaacgacgacggtaccgtttacgtacgtcgacgcgaaggaccggactccccggaccccccggaacgggacccggaaacggtacgggtaagtacgggtccggggaacgtacgggttaccggtttcggttaccgttaccgttaaccgtccgtaacgtaaccgg

SEQ ID NO: 187675 - DNA, 732 bp, Homo sapiens
  misc_feature: GYAE6OF01CY3SD.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctgaggtgaagacgcctgggtcctcggtgaggtctcctgcaggcgtcgtgggggcaccgttcggcaagtttcgcctagttacgttgggtcgcgacgacggtcccctggacgaagggcttggaggtggagtggggagggattccggtcccgttggttcgttggacgtcagaccaaactacggcactatagtagtttccggaaggggtacgagtacaacggtagttacgggcggaacgaatcgtaccggaccacgacgaccttatccgtaggacgtacgtacgtaaaccgaacgtacggacgtaaccgtaggaacgtaccgtaaccggttacccgttttaacgtaccgtacggaccggaccggtaacggaccgtaacccggtaccccccgggaccccccccgggaaacggggggtaccccggaaaccgggtaacggggttaaggttaacggggtacgggggaacccggtaaccgggtttaccggtttttaccggggtaccccgttttacgttaacccgttaaccgttaccgttaaacccgg

SEQ ID NO: 187676 - DNA, 664 bp, Homo sapiens
  misc_feature: GYAE6OF01BMKPQ.5.64.F09.1.454.CMB.1.raw
  modified_base (218)..(218): a, c, t, g, unknown or other
  misc_feature (218)..(218): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctggagtgaagcgcgtggtcctcggngaaggtctctgcgaaggcgtcgtgggggcctaccgttcggacgtaagtttcgacctagtttacgttgggtcgaccgacgaccggtccccgtaggaccgaagggtcttaggaggtggaggtgggaggtacttccggttcccgttgttcggtacggacgacgtacgaaccgtaaacgccgaactacgtagtacgttaccggtaagggaggtaacgtacgtacgtaacggttaacggacggtaacgaacgtacgtaccgacgtacgacgtacctagtcaggacgtacgtagaacgtaacgtgaacgtccgaagtacggaacgtacggttccgttaactaccgtacgcgtacggacgtacgaccgtaccccggaccccgaccgggaccgacggaaggtcggtaggcggggtcacggttcgttcggtaccttctaactcgtacgtctacgg

SEQ ID NO: 187677 - DNA, 780 bp, Homo sapiens
  misc_feature: GYAE6OF01CVYUM.5.64.F09.1.454.CMB.1.raw
  modified_base (591)..(591): a, c, t, g, unknown or other
  misc_feature (591)..(591): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctcttggtggtggcagcagctacaggtcgtccacgtcccaggtcacaaccgttggtgccgtagtcgtggggctggaggtaggaagccggtccgtcgggttccgtgggtaggtaacggttccgtccgtggaccgtaagggtccggttcggtcggggggacctaccggttcggacgttaaggtttcgaccgttaacgtttacggtttcggggtacgtaccggtaacgacccggtccccgttagggaaccgtaacggggtccttaggaggtcggaggtaggggaggtacctccggtcccgttaggtccgtttagggacgtacgaacgtaccgtaaacgtacgacctaacgtacgttacgtacgttaccggaaggggtactacgtaccgaaggtacgtacgggtacggaacgtacgtacgacgaccgacacgtcacgtcgacggtatcgtaagaacgtacgganaccgtaacgaggaaccgacgtacggtaacccgttacgtacgtcggaccggacgtacggaccgtccggtaccccggacccccgggtaaagggacccggaaacgggtacggtacggacgggtacgggggaacccttaggggttccggtttccgggtacccttaccggttaccgtaccgttaacggtaccgg

SEQ ID NO: 187678 - DNA, 792 bp, Homo sapiens
  misc_feature: GYAE6OF01EGSIT.5.64.F09.1.454.CMB.1.raw
tcagatcagacacgcacgaccggtgctcgatttagcgcgtatacaagggggcatcacataacaaccagattcctcctctaaaagaagcccctgggagcacagctcatcaccatggactggacctggaggttccttctttgtggtggcagcagctacaggtgtccagtcccaggtgcaactggtgcagtcgtggggctggaggtagaagcgccgttgggtcctcggtgaaggtcctccgtgaccgaagggtcgtcggtcgggggctaccgttcggactaagttcgcctagtttacgttgggtcgacgacgaccggccccgtagggacgaagggtcgttgggaaggtgggaggttaggggaggtacgttccggttccgttaggtttccggtttaggacgacgtaacggaaccgtaaaaccgttaccggacaacgtaacgttaggtttaaccggttaccgggtaaggggtacgtacggtacgtaacgtaacggttaccgggacggaaccgtaacgttaccggtaaccggacccgtaacgacggttccctaacgtcgtgggaacgtacgtaacggaaccgtaacggtcgtaacggtaccggtaagaaccggtacgtaaccgggttacctttaaccgtacgtaccggacgacggacgtaacggtacccggacccccggtaaacccccgggaccgggggaacctaacggggtacggtaacggacggggttccgggtaaccgggtacggttccggttttaccgggacctttacggtaaccttaacgtaccgttaaccgg

SEQ ID NO: 187679 - DNA, 660 bp, Homo sapiens
  misc_feature: GYAE6OF01BBYSX.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctgaggtgaagacgccgtgggtcctcggtgaaggtctcctgcgaaggcgtcgtgggggcaccgttcggctaaggtttcgcctattacgttgggtgacgacgacggcccccggaagacgggtcttggaggtggagtggggaggactcggtccctgtcgttggagtacagacaacgtacgacactatagtactttacggagggagagtacacgtacgttacggacggaacgtaagtccgtacgacccaacgacgtacctagtcgtcgggactcgtagaacgtaacggtcgaacgaccgtagaacggaacgtaccggtaaccgtttaacgtaccgtacgtcggacgacgtacgtaccgtaccccggacccccggaaggggacccgtaacggaacgggtacgtaggggacggggtaccgtaacgggttcgtttcgggtaccttcgttaaccgtacgttacgtacgtacggg

SEQ ID NO: 187680 - DNA, 662 bp, Homo sapiens
  misc_feature: GYAE6OF01AFSN6.5.64.F09.1.454.CMB.1.raw
  modified_base (340)..(340): a, c, t, g, unknown or other
  misc_feature (340)..(340): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctggaggtgaagacgcctgggtcctcggtgaggtctccgtgcgaggcgtcgtgggggcctaccgttcggctaagtttcgcctattacgttgggtgcgacacgggcccctaggacgaacggggtcttggacgtggagtggggaaggtntccggtcccgtgtcttggagcagacaaacgtcgacacgatgtacttccgaggggagacgtcaacggtacgtacgggacggacgactcgtaccggccacgacgccgtaagtcgtagggacgacgtacggaaacgaacggtgaacggtaacctaggaacgtaccgacggttacccgtttaacgtacgttcgaccggacggaacggacgaccgtccccgggaccccccgggtaaagggacccggaacggtacggtacggtacggggtcggggaccgtaacgggttcggtttcggaccctttaccgtacgtaccgtacgtaaccgg

SEQ ID NO: 187681 - DNA, 634 bp, Homo sapiens
  misc_feature: GYAE6OF01DDNU2.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccgttcggcaagtttcgcctattacttgggtgcgacgaggcccctggacaagggcttggagtggagtgggagggatccgtcctgttcgtttggagcagacaacgtacgcaacatcgtactttccgaggggagtacgtcgacgtagttacgggacggacgtaacgtccgtaccggaccacgacgtcccttacgtcgtagggagtacgtagaaccgaacgtcgacgtaccgtagaacgacgaccggtaccgtttactacgtgcggacgagacgacgtccccgaccccccggaacggggtcccgaacgggtacggtaaggtacgggtcggggtaccgacgggttaccgtttgggtacccttacgttaaccgtcgttacgttaaccgg

SEQ ID NO: 187682 - DNA, 632 bp, Homo sapiens
  misc_feature: GYAE6OF01B0J1T.5.64.F09.1.454.CMB.1.raw
  modified_base (244)..(244): a, c, t, g, unknown or other
  misc_feature (244)..(244): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgaagacgccgtgggtcctcggtgaaggtctcctgcaaggcgtcgngggggcaccgttcggctaagtttgacctattacgttgggtgcgacgacggcccctggacgaagggcttggagtggagtgggaggactcgtccgtgtcgttggagcagacaactacgcacatgtacttcgagggagagtacacggtacgttacggacggaacgaacgtacgtaccggaccacgtacgacctagtcgtaggacgacgtaacgaacgtaacgtagacgacgtagaacgacgaccggtaccgtttacgacgtcgacgacgacgacgaccgtaccccggaccccccggacgggacccgaacggtacggtacggtacgggtcggggaccgtaaccgggttccggtttaccgggtacctttaccgtacgtaccgtacgtaaccgg

SEQ ID NO: 187683 - DNA, 689 bp, Homo sapiens
  misc_feature: GYAE6OF01DNR41.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacatggaggttcctctttggtggtggcagcagctacaggtgtccagtcccaggtgcaacgtggtgcagtcgtggggctggaggtgaacgcgccgtgggtccgtggtgaacggtcctccgtgacgaagggtcgtcggtcgggggcctaccgttcggactaaggtttcgcctagtttaccggttggggtgaccgaacggaccggcccccgttagggaacgaacgggtctttaggagggtgggtaggtggggaagggtactccggttcccgttggttcgtttaggacgtcgaaggtaactaaacgtacggactactagtacgtacgttaccggaggggaacgtacgtacgaacgtacgttacggacggtaacgtaactccgaacggcccacgtacgtactacgtgacggacgtcgacgtaaacgacggtagacgacctagaagaccgtacggttacgttactagtcggcgagacgacgaccgtccccggaccccggagggaccgaacggtaggtacggtagggaccggggacgacggttcggtttacgaccgtttaccttacgtacgtaaccg

SEQ ID NO: 187684 - DNA, 585 bp, Homo sapiens
  misc_feature: GYAE6OF01AMLNO.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccttcggcaagtttgccattacgttgggtgcgacaggcccctggacaagggcttgagtggatgggagggatcgtccctgtctttggagcagcaaactacgcacatgatttccgaggggagagtcacgattacgggcggacgaagtctacggccacgacgcctatctggagcgtagaacgaacgtgagacccgtagaacgaccacggaccgtttactacgtgacgcggagacgacgtcccggaccccccgaacggggcccgaaacggtacggtagtacggtgggggaccgaacgggtcgttttcgggcctttaccgtaccgttacgtaccgtaacg

SEQ ID NO: 187685 - DNA, 693 bp, Homo sapiens
  misc_feature: GYAE6OF01AD3FU.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcgagtcgtgggctgaggtgagcgccgtgggtcctcggtgaggtctcctgcgaggcgtcggtgggggctaccgttcggcgtaagtttcgacctagtttacgttggggtcgaccgtacgacgggtcccccgtggaaccgaaggggtcttggacggtgggaggtggggtagggtacgttccggtcccgttggttcgtttaggacgcgagacctaaaccgtcgacacgtagttaggtacgttaccggaggggtagacgtacgaacggtacgttacgggacggaacgtagtccgaccggacacgacgtactagtcggaggactacgtacgtaacgacgtagacgtacgtagaacgaccgtaccggtttaccgttacgtacgtcggacgtacggaacgacgtacccggacccccggaccccgggaacggggtacccgaagggtaccggtagggtacgggtcgggtacgtaccgggtttcgttaccgggtactttaccggtactacgttacgtaacgg

SEQ ID NO: 187686 - DNA, 767 bp, Homo sapiens
  misc_feature: GYAE6OF01CJ4RA.5.64.F09.1.454.CMB.1.raw
  modified_base (288)..(288): a, c, t, g, unknown or other
  misc_feature (288)..(288): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaacgtggtgctagtcgtgggctgaggtgaagacgccgtggtcctcggtgaggtctctgcgaggcgtcgtggggctaccgtcggcgtaagtttcgctagttacgttggtgcgacncggccccgtaggacgagggtcgttggacggtggacggtgggacgggtacgtccggttcccgttggttcgtttggacgtccgaacggtaccgtaaaccgtacgacctaaccgtagtacgtacgtttaccgggaggggtaacgtacggtacgaacggttaacgttaaccggggaccgtaacgaaacgttaccgtaaccggacccgtaacgaacgtacccgttaacgtacggtagggtaacgtacgtaacggaaaccgtaacgtacggtaacggaacccgtaggaaaccgaccgtaacccggttaacccgtttaccgtaccggtacggccggaacgacggtaccggaacccggtacccccggaaccccccgggaacgggacccgaacgggtaacggttacggtaacggggtacgggacccggttaacgggttaccgtttaccgggtacccgtttaccgtacgttaacccgtacgttaaccgg

SEQ ID NO: 187687 - DNA, 578 bp, Homo sapiens
  misc_feature: GYAE6OF01APVTE.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccttcggcaagtttgccattacttgggtgcgacaggcccctggacaagggcttggagtggagtgggagggatcgtccctgtcgtttggagtcagcaaactacgcacattgatttccgaggggagagtcacggattacgggcggaacgaactctacggccacgagcctatcgtggagctcgaacaacgtgagccgagaacgacgacgccgttactacgtgccgcgagagacgtcccgccccccggacgggacccggaacggacggtagtacgggtcggggaccgaccggttcgtttcgggacccttacgttacctaccgtacgtaaccg

SEQ ID NO: 187688 - DNA, 737 bp, Homo sapiens
  misc_feature: GYAE6OF01BFQPD.5.64.F09.1.454.CMB.1.raw
  modified_base (345)..(345): a, c, t, g, unknown or other
  misc_feature (345)..(345): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgaagacgcctgggtcctggtgagtctcctgcaggcgtcgtggggcacgttcggctaagttcgcctagttacgttgggtgcgacgacggcccctaggacaagggtcttggaggtggagtgggaggatccggtcctgttcgtttggancgacgactaaacgtcgtacaactagtagtactttaccggaggggagaggtacgaacggtacgttacgggacggtaacgtaacgttaccgtaaccgggccgaacgtacgtaccccgttataccggtagggtaacgtcgtaacggaaaccgtaacggtggtaaaccggacgttaacggaaacgtaaccggtaacccggttaccggtttaaccgtaaccggtacgtaccggacggaacggttacggaacccgtaccccccgggacccccccggggtaaacgggggaccccggtaaacgggtacgggtaacggtacggggtacggggtaccgtaaaccgggttccgggtttacccgggtaccgtttaccgttaaccgttaaccgttcgtaaaccgg

SEQ ID NO: 187689 - DNA, 674 bp, Homo sapiens
  misc_feature: GYAE6OF01AST0P.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgagacgcgtggtctcggtgaggtctcgtgcgaggcgtcgtgggggctaccgttcggctaagtttcgcctagtttacgttgggtgccgacgacggtccccgtggaaccgaagggcgttggaggtggagtggggaggtactccggtcccgtgttcgttggacgacgacgacaaacgtcgacacgtactgtacgttcggaaggggagtacgtcgacgtaacgttacgggacggtacgaacgtcgtacggacctaacgacgtacctagtcgtaggacgtacgtacgaacgtaacgtggaacgtaccgtagaacgtacgtaaccggtaccgttacgtcgtacggcgacgacggacgtaccggtccccggaccccccgggtaagggacccggtaacggtacggtaaggtacggggtacggggaccggtacgggttaccgtttacggtacccgttacgttaaccgtaccgttaaccgtacgg

SEQ ID NO: 187690 - DNA, 574 bp, Homo sapiens
  misc_feature: GYAE6OF01BJDLD.5.64.F09.1.454.CMB.1.raw
  modified_base (366)..(366): a, c, t, g, unknown or other
  misc_feature (366)..(366): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggcaccttcggcaagtttgccattacttgggtgcgacaggcccctggacaagggcttgagtggagtgggaggatcgtccctgtctttggagcagcaaactcgcacatgatttccgaggganagtcagagttacggacgacgaatcgtacggccacacgcctatcgtaggacgctagaacaacgtgacgacctagaacgacgacggtaccgtttactacgtcgacgcgagacgactcccggaccccccggagggacccgaacggacggtagtagggtcggggacgtacgggtcgtttcgggaccctttacgtaccttacgtaccgtaacg

SEQ ID NO: 187691 - DNA, 717 bp, Homo sapiens
  misc_feature: GYAE6OF01D4G8D.5.64.F09.1.454.CMB.1.raw
tcagatcagacacgcacgaccggtgctcgatttagcgcgtatacaaggggcatcacataacaaccagattcctcctctaaagaagcccctgggagcacagctcatcaccatggactggacctggaggtttcctctttgtggtggcagcagctacgaggtgtccagtcccaggtgcaacgtggtgcagtcgtggggctggaggtgaacgacgccgtgggtcctcggtagaaggtctccgtgacgaggcgtcggtggggcctaccgttcggacgtaagtttcgacctagtttacgttgggtcgcgacgacggcccgtaggacgaagggtcttggagtggagtggggaggtactccgtccgtgttcgttggagcgagacaaacgtcgacagtagtagtacgttacggagggatacgtacgaacgtacgttacgggacggaacgtaacgtaccgtaacccggaccgaacgtaacgtacccttagtacggtagggactacgtaacgaaacgtaaccggagaaccgaaccgtagaacggaacgtaccggttaccgtttaaccacgtagaccgacggaagaccgtacccgtacccccgggaaccccccgggaaacgggtacccggaaacggtacgggtaaggtacggggtccggggaaacgttaccgggttccgtttaccgggtacctttacccggttaaccttaacggtaccgttaacccggg

SEQ ID NO: 187692 - DNA, 753 bp, Homo sapiens
  misc_feature: GYAE6OF01BS0HE.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaacgtggtgcgagtcgtgggctgaggtgaacgacgccgtacgggtccgtcggtggaacggtcctccgtgcgaaggtcggtcggtcgggggctaccgttcggctaaggtttcgacctagttacgttgggtcgcgacgacggcccctggaacgagggtcttaggagtgggagtggggaggctaccgtcctggttcgttggagcgagtacctaactcgacactagtacgtagtttaccggaagggtacgtacgtaaccgtaacggtacgttaaccgggacggtaacgtaacttaccggtaacccggaccctaacggtaccgtacccgttaacgtcggtaacggacgtacgtaacgaaccgtaacggtacgacggtaacctaggaacgtacggtaaccggttaccgtttaacgtacgtacggaccgtacgggaacgtaccggtacccgtaccccgggaccccccgggtacgggaaccccggaaacggggttaacggtacgggttacggggtaccggggtaccggtaaccgggtttaccgttcggttacccgttacgttaccgttaaccgtacgttaaaccggg

SEQ ID NO: 187693 - DNA, 756 bp, Homo sapiens
  misc_feature: GYAE6OF01D693P.5.64.F09.1.454.CMB.1.raw
  modified_base (234)..(234): a, c, t, g, unknown or other
  misc_feature (234)..(234): n is a, c, g, or t
  modified_base (360)..(360): a, c, t, g, unknown or other
  misc_feature (360)..(360): n is a, c, g, or t
tcagatcagacacgcacgaccggtgctcgatttagcgcgtatacaagggggcatcacataacaaccagattccctcctctaaagaagcccctgggagcacagctcatcaccatggactggacctggaggttcctctttgtggtggcagcagctacaggtgtccagtcccaggtgcaacgtggtgctagtcgtggggctgaaggtgaagacgcgtgggtacctcggtagaggtcnccgtggacaagggtcgtcggtgggggcctaccgttcggcgtaaggtttcgaccgtatttacggtgggtcgcgacgaccggccccgtaggaaccgagggtcttggaaggtggagtaggggaacggtnttccggtcccgttggttcgtttcggacgacgtacgtaccgaaaactccggactacgtgtagtacgttacggacgggtaagacgtacgacggtagttaccgggacgaaccgtaacgtaccgttacggaccgtaacgacgtcctacgtacgtacggtagtacgtaacgaacgtaagtacggacgaaccgtacggaagtaacccgtcggttaacctttaaccgtaccgtacgtaccggacggtaacgaacggtacccgaccccggggaccccccgggaaacgggacccgggaaaccgggttacgggtaacggttacggggtacggggtaacccggtaaccgggttccggttttcgggtaccctttacccggtaacgttaacccgtaacgttaacccggg

SEQ ID NO: 187694 - DNA, 650 bp, Homo sapiens
  misc_feature: GYAE6OF01CCSWT.5.64.F09.1.454.CMB.1.raw
  modified_base (326)..(326): a, c, t, g, unknown or other
  misc_feature (326)..(326): n is a, c, g, or t
  modified_base (344)..(344): a, c, t, g, unknown or other
  misc_feature (344)..(344): n is a, c, g, or t
  modified_base (455)..(455): a, c, t, g, unknown or other
  misc_feature (455)..(455): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgaggtgaagacgcctgggtcctcggtgaaggtctcctgcaaggcgtcgtgggggccaccgttcggctaagtttgcctattacgttgggtgcgacacggcccctggacgaagggtcttgagtggagtgggaggntcgtccgtgtcgtttggngcagacaactacgcacatgtacgtttccgagggagtagtcgacgtagttaccggcggaacgtaacgtcgtaccggaccacgacgcctagtcgtggagctagaacgtaacgngacgaccgtaggaacgaccgaccggtaccgtttaccgtaccgtcggaccgtacggacggtacgaccgtccccgggaccccccgggaacggggacccggaacggtacgggttacgtacggggtacggggaccgtaacggggttcccggtttcgggtaccccgtttaccgttaaccgttacccgtaacgttaaccgg

SEQ ID NO: 187695 - DNA, 813 bp, Homo sapiens
  misc_feature: GYAE6OF01BP4S9.5.64.F09.1.454.CMB.1.raw
  modified_base (343)..(343): a, c, t, g, unknown or other
  misc_feature (343)..(343): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctggaggtggaagacgcctgggtcctcggtgaaggtctcctgcgaaggcgtcgtgggggcaccgttcggactaaggtttgccatttacgttggggtgccggacgacggcccccgtaggacgaagggcgttcggaggtggagtggggaggngtccgtccctgttcgttggagtcgacgacctaacgtacgacacgtatagtacgtttaccggaggggtagacgtacgaacggtagttaccgggacggtaacgtaatccgtaaccggaccacgacgtaccgttacgtcgtacgggacgtcgtaacggaaccgtaacggtacggaacggtaacccgtaggaaaccgtaaccggtaaccgggttaccccggttttaaccgtaaccgtacgggtacccggtaacggaacggtaacccggtaaccggtacccccccgggaaccccccccccggggaaacggggggtaacccccgggtaaaacccggggtaacggggttaaaccgggttaccggggtaacccgggggggtaacccggtaaacccgggggtttacccgggtttttaccggggtacccccggttttacccgttaaacccggtttaacccgttaaacccggttaacccgg

SEQ ID NO: 187696 - DNA, 927 bp, Homo sapiens
  misc_feature: GYAE6OF01AYVT4.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgaagacgccgtgggtcctcggtgaaggtctccgtgcaggcgtcgtgggggcctaccgttcggctaagtttcgacctagttacgttgggtcgacgtacgacggtcccccgtagggaccgaaggggtccttaggagtgggagtgggggaagggtacgtccgttacccgttggttcgttttgggagtaccgaacggtacctaaaacgtcgaccgtaactagtaggtaacgtttaccggagggggacgtacggtaccgtaacggtaacgtttaccggggaccggtaaaccggtaacgttcccggttaaccgggaccctaaccgtaacggtaccccgttaacggttaccggtacggggtaaccgtaccgttaacggtaaaacccgtaaccggttaacggtaacggtaaccccggttaagggaaaaccgggtaaaccggtaacccggggttaaccccggtttttaaacccgtaacccgttaccgggtaaccggtaaccgggtaacggtaaacccgggtaccccggttaaccccccgggaaccccccccccggggtaaaccggggggtaaacccccgggtaaaacccgggtaacgggggttaaaccgggttaaccggggggtaccggggggtaaccgggtaaaccccggggtttacccggtttttaaccgggggtaccccgttttaaaccccgttaaaccccggtttaaacccgttaaacccggtttaaacccgg

SEQ ID NO: 187697 - DNA, 717 bp, Homo sapiens
  misc_feature: GYAE6OF01DCRB1.5.64.F09.1.454.CMB.1.raw
tcagatcagacacgcacgaccggtgctcgatttagcgcgtatacaaggggcatcacataacaaccagattcctcctctaaagaagcccctgggagcacagctcatcaccatggactggacctggaggttcctctttgtggtggcagcagctacgaggtgtccagtcccaggtgcaacgtggtgcagtcgtggggctggaggtgaagaccgccgtgggtccctggtagaaggtcctcctggcgaaggcgtcgtggggccaccgttcggctaagttcgacctagttacgttgggtcgcgtaccgacggtcccgtaggaacgtaagggtcttggaggtggtaggtggggaggtctccggtccgttggttcgttggacgtacagaccaaaacgtcgacacgtagtcgtacgttaccggaggggaacgtacgtccgaacggtacgttaacgggaccggtaacgtaacgtcccggtaacgggcccctaaggaccgtaccttacgtacgtagggacgtacgtaagaaaccgtacgtacggaacgtaccgtaaggaaccgtaccgtaaccggttacccgtttaacgtacgtcggaccggtacgaaccggacgaccccggtacccccggacccccgggaacggggacccgaacggtacggtaggacgggtcggggacctaacggggttccgtttcggaccctttacgaacctccgttaacgtacgg

SEQ ID NO: 187698 - DNA, 938 bp, Homo sapiens
  misc_feature: GYAE6OF01BEKN8.5.64.F09.1.454.CMB.1.raw
tcagatcagacacgcacgaccggtgctcgatttagcgcgtatacaaggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctggtgaaggtctcctgcaaggcgtcgtgggggcaccgttcggcaagtttgccattacgtttgggtcgtcggacgacggtcccccgtaggacctaaggggtccgtttggaaggttcgggagttagggggaacggggtaacgttcccggttaccccgttggtttccgtttttaggggaacgtccgtaacgaccgtaaaaccttaccggacctaactaacgttaggtaacgttttaccggaagggggtaacgtaacggttacgaaaccggttaacgttaaccggggaccgggtaaccggtaaacgttaccgttaacccgggtacccgaaccgaacggttaccccttaacgttacgttacgggtaacggtcccgttaacggaaaccgtaaaaccggttacggaaccggtaacccgttaagggaaaccggtaacccggtaaccggggtttaaccccggttttaaccgttaacccgttaccgggtacccgggtaccggtaacgggtaacggtaaccccggtacccccgggtaaccccccccccggggtaaaacggggggaacccccgggtaaaaccggggtaaccggggtttaaacgggttaaccgggggtttaaccgggggggtaacccggtaaacccgggggttttacccgggtttttacccgggggttacccctttttaaccccggttaacccgtttaaaccccgtttaaacccggttaaacccggg

SEQ ID NO: 187699 - DNA, 644 bp, Homo sapiens
  misc_feature: GYAE6OF01BXW3Z.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgccgtgggtcctcggtgaaggtctcctgcaaggcgtcgtggggcaccgttcggctaagtttcgcctattacgttgggtgcgacgacggcccctggaccaagggcttggaggtggacgtggggagggacgttccgtcccgttgttccgtttggacgcgagacaaacgtcgacacagtgtactttccgagggacgagtacgaacgtagtacggcggaacgtaacgtccgtaacggaccacgacgtacctacgtcgtggagtcgtaagaaacgtaacggtcgaacgaccgtagaacgacgtaaccggttaccgtttactacgtacggacgtacggagacgaccgtccccggacccccggaagggacccgaacggaggtagtacgggtcggggacctaacgggttcgtttacggccctttacgtaaccgtacgtaccgtaacg

SEQ ID NO: 187700 - DNA, 658 bp, Homo sapiens
  misc_feature: GYAE6OF01BSRYO.5.64.F09.1.454.CMB.1.raw
  modified_base (372)..(372): a, c, t, g, unknown or other
  misc_feature (372)..(372): n is a, c, g, or t
  modified_base (410)..(410): a, c, t, g, unknown or other
  misc_feature (410)..(410): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaacgtggtgcagtcgtgggctggaggtgaagacgccgtggtccgtcggtgagtctccgtgcgaaggcgtcgtgggggctaccgttcggctaacggtttcgacctagtttaccgttggggtcgcgaaccgacggccccgtggacgagggtcgttggaggtggaggtggggaggtactcggtcccgtgttcgtttggacncgagacaaacgtcgcaagtatcgtacgttccgaggganagtcgaggtacgtacggacggacgaatccgtaccggccacgacgcctagtcgtaggacgacgtacgaacgtacgtacggaacgtacgtaggaacgacgtaccggttaccgttaactacgtcgcgacgaacgtaccgaccgtaccccggtacccccgggaacgggacccgtaacggtacggtaggtacgggtacgggaccgtaacgggttcgtttaccggtacccgttactaccgtaacgttacgtacg

SEQ ID NO: 187701 - DNA, 732 bp, Homo sapiens
  misc_feature: GYAE6OF01ER0B9.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtcgtccagtcccgaggtgacaacgtggtgctagtcgtgggctggaggtgaacgacgccgtgggtccgtcggtagaggtcctaccgtgacgaggtcggtcggtcggggcctaccgttcggactagttcgcctagttacgttgggtcgcgacgaccggtccccgtagggaaccgtagggtcgttacggagggtacggaggttacggggaacggtcgttcccggttcccgttgggttacggtttacggagaccgtaacgtaccgtaaacgtaccggactacgtagtacgtacgtttaccgggagggtacgtacggtaccgtacggtacggtaccggacggtaacgtacgtacggtaccgaccgtacgtactacgtagtcgagtaaccgtacgtaacgacgtaacgcgtacgacgttaacgaccgtaccggtcgtaacccgttcgtacgtcggaccgaacggtacacccggtaccccggaccccccgggaaccccgggagggaacccggtaaaggccggttagggacgggtcggaccggttacgttcggtaccgttaccttactaaccgtgtctaacgg

SEQ ID NO: 187702 - DNA, 848 bp, Homo sapiens
  misc_feature: GYAE6OF01D6SG2.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttggtggtggcagcagctacgaggtcgtccagtcccgaggtcgactaacgtggtgacgtagtcgtggggcgtggaggtaggaacgaccggtccggttcgggtcccgttcgggtacggtaacggttcccgtccgtcggacgaacgggtccggttaccgggtacgggggtacctaccggttccggacgttaacggtttcgaccgttagtttacggttcgggtcgaccgtaccgaccggtccccgtaggaacgacgggttcgttggaggtggagggtgggacggtacgttccggttccgttgttcgttcgggacgtacgaaccgtaaccgtaacgacggaactacgtacgttacggttaccgttaccgggaaggggtactacgtacggtaacggtacggttaacggggaccgtaacgtaacggtacccgtaacccggaccctaacgaccgttacccgttacgtacggttacggaacgtaccgtaacgtaaaccggtacggtaccgaaccggtacgtaacggaaccgtaccgttaacccggttaaccgtttacgtaccgtcggaccggacgaacggtacccgaccccggacccccgggaacccccggggacgggaacccggtacggtaccggttagggacggggtaccgggacccggttaaccgggtttccggttaccggttaccccgttaagtacccgttacgtaacgttaccggg

SEQ ID NO: 187703 - DNA, 608 bp, Homo sapiens
  misc_feature: GYAE6OF01AFPAU.5.64.F09.1.454.CMB.1.raw
  modified_base (379)..(379): a, c, t, g, unknown or other
  misc_feature (379)..(379): n is a, c, g, or t
tcagatcagacacgcacgaccggtgctcgatttagcgcgtatacaagggggcatcacataacaaccagattcctcctctaaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccgttcggcaagtttcgcctattacgttgggtgcgacgacggcccctggacgaagggtcttgagtggagtgggaggatcgtccgtgtctttggagcagcaaactcgcacatgtactttccgagggganagtcgacgtagttacgggacgacgactcgtacggccacgacgacctatcgtggacgtcgtagaacgacgtgacgacgtgaacgacgtaccggtaccgttacgtacgtcgacgacgacggacgaccgtacccggaccccccggaacggggacccgaacgggtacggtacgtacgggtcggggaccgtaacgggttcgtttacgggtaccttacgtactaccgtacgtacg

SEQ ID NO: 187704 - DNA, 786 bp, Homo sapiens
  misc_feature: GYAE6OF01DYY7G.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacgaggtgtccagtcccaggttgaccaacgtggtgcgtagtcgtggggctggaggtgaacgacgccgtgggtcctagggtgtaacggtccttccgtaggcgaaggtccggtcggtcgggggactaccggttcgacgttaagtttcgacctagttacgttgggtcgacgacgaccggtccccgtaggaacgaacgggtcttagggtagtgggaggtcggggaaggttccgttaccggttcccgttaggtttcgtttacgggagtaccgaacgtaaccaaacgtccgactaccgaatgtacgttccgggaagggtacgacgtacgtaacggtaacgtaccgggacggtaactacgtaccgtaccggaccacgacgtacccgttagtacgtacggtacgtactaagggaacctaacggtcgaaccgtacgtaaggaaccgtaccgtacggtttacccgttaacgtacccggtggaacccgagggtaacgacccggacccggtacccccccgggaacccccgggaaaggggaacccggtaaacggtacgggttaacgggtacggggtcggggaccgttaacgggtttccggtttaccgggtaccctttaaacggtacccttaaacgtccggtaaacgg

SEQ ID NO: 187705 - DNA, 774 bp, Homo sapiens
  misc_feature: GYAE6OF01EOADU.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgaagacgccgtgggtcctcggtgaacggtctcctgcaaggcgtcgtgggggcaccgttcggctaagttgcctattacgttgggtgcgacgacggccctggacgaggcttgaggtggagtggggaggacgtccgtacccgttgttcgtttgggacgcgacgacgaaacgtacgacaacgtacgtggtaacgttttacccggagggggtaagaacgggtaccaacggtaaggtttaaccggggaccgggtaaccgtaacgttaccgtaaccgggaccctaaccgtaacgacccgttaagtccgttagggacggtaccgtacgaaaccgtaaccggtacggaacggtaacccgtacggaacggaccgtaaccggtacccggtttaacgtaccgtacggaccgtacggaacgtacggtacccggtaccccgggaacccccccccgggtaaacggggaaccccggtaaaccgggtaacgggtaacggttacggggtaccggggggaacccggtaacgggtacccggttttaccgggacccgttttaccgtaacccggttaaccgttaacccgttaaccgg

SEQ ID NO: 187706 - DNA, 676 bp, Homo sapiens
  misc_feature: GYAE6OF01BB7BQ.5.64.F09.1.454.CMB.1.raw
  modified_base (391)..(391): a, c, t, g, unknown or other
  misc_feature (391)..(391): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctgaggtgaagacgccgtgggtcctcggtgaaggtctcctgcaggcgtcgtgggggccaccgttcggctaagtttcgacctattacgttgggtgcgacgcggcccctggacgaaggcgttggagtggagtgggaggtatcgtcccgtgttcgttggacgtcagacgaaactacgacacatgacgtttccgaggggtanacgtcaacggtacgtacgggacggaacgtaactccggtaacggacccacgacgtacctacgtccgtaggaacgtccgtacggaaaccgtaacgttacggaccgaaccggtacgaaccgtacgtaccggttaaccgttaccgtacgtaccgcggacgaacgtaggacccgtaccccggaccccccgggaaagggaccccggaacggtaacgggtacgtaacggggtcggggacgtaccgggttaccggtttcgggaccctttaccgtacgtacgttaccgtaacgg

SEQ ID NO: 187707 - DNA, 606 bp, Homo sapiens
  misc_feature: GYAE6OF01CVQ3D.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctggaggtgaagacgcctgggtcctcggtgaaggtctcctgcaaggcgtcgtgggggcaccgttcggctaagttgccattacgttgggtgcgacgacggcccctggacgaagggtcttgagtggagtgggaggagtcgtcctgttcgtttggagcagcaactacgcacatgtatttccgagggtagagtacacgtagttacggacggacgtaatacgtacggaccacgacgcctacgtcgtaggacgcgtagaacgaacgtagacgaccgtacgaacgaccgtaacggtacccgtttacgtacgtgcggacgagacgacgtcccggaccccccggacggggaccgaacggacggtagtacgggtcggggaccgacggttacggtttcggtaccgttcgtactacgtacgtacg

SEQ ID NO: 187708 - DNA, 764 bp, Homo sapiens
  misc_feature: GYAE6OF01CP156.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctggaggtgaagcgccgtgggtcctggtagaggtctcgtgacgaggtcgtcggtgggggcctacgttcggacgtaagtttcgacctagtttacgttgggtcgaccgacgacggccccgtaggaccgaagggtctaggtaggtggaggtggggtaggtcgtcccggttccgttggttacggtttagggacgaccgtaacggaacctaaaccgtacgaccgtaactagttacggttacctttccgaggttacgggagtacgtaacgtacggtaacgttacgggacgggaacgtaacgtaccggtaaccggccaacgtaccgtaccgtagtcggtcggacgtccgtaaacggtaaccgaacggtcgaacgtaccggtaaggaacggtaacccggtacccggttacctttaacgtccgcgggaccgtacggacgaaccggtcccggtaccccccgggaacccccggggagggaaccccgggtaacgggtacgggtaacgggtacgggggtacggggaaccggttaccggtttcgggtttaccggtaccctttaacgtaccgttaacgttaaccgg

SEQ ID NO: 187709 - DNA, 564 bp, Homo sapiens
  misc_feature: GYAE6OF01D0NPU.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccgttcggcaagtttgcctattacgttgggtgcgacaggcccctggacaagggcttgagtggagtgggaggatcgtccctgtctttggagcagcaaactacgcacatgatttccgaggggagagtcacggattacggcgacgaatcgtacggccacacgctatctaggacgcgtagaacgaacgtagacgacctagaacgacgacggtaccgttactacgtcgcgcgacgacgactcccgaccccccggagggacccgaacggacggtagtacggtggggaccgaggtcgtttcggacttctactctacgtacg

SEQ ID NO: 187710 - DNA, 879 bp, Homo sapiens
  misc_feature: GYAE6OF01AHJ0O.5.64.F09.1.454.CMB.1.raw
  modified_base (230)..(230): a, c, t, g, unknown or other
  misc_feature (230)..(230): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgaagacgcctgggtcctcggtgaaggtctcngcaggtcgtcgtggggctaccgttcggctaaggtttcgcctagttacgttgggtgccgacgacggtcccctaggaccgaagggtcttaggaggtggagtggggacggtacgttccggtacccttggttccgttagggacgtacgtacgaccgtaaaacctcggacacgtacgtaggtaacgtttaccgggaagggtacggtacggtaccgtaaccggtaacggtttaccgggaccggtaaccgggtaaacgttacccggtaacccgggtacccgtaaccgaccggtaccccgttaacgttaccggttagggaaccgtaccgtaacgggtaaaccgtaacgggttaccggaaccggtaacccgtaacgggtaaaaccggtacccggttaacccgggttaacccggttttaaccggtacccgttaccgggtaacccggtaccggtaacgggtaaccggtaacccccggttaccccccggggaacccccccggggtaaacgggggtaccccggtaaacccggggttaacgggttaaccgggttaaccggggtaccgggggttaacccgtaaacccggggttttccggttttaccccgggggtacccttttacccgggttaaacccgttaaccggttaacccggttaacccgg

SEQ ID NO: 187711 - DNA, 709 bp, Homo sapiens
  misc_feature: GYAE6OF01CHP36.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgaagacgccgtgggtcctcggtgagtctcctgcaggcgtcgtgggggcctaccgttcggactaaggttttcgcctattacgttgggtcgacgaccgacggcccccggagaaggggtccttggagttggagtggggacggtacgtccgttcccgtgttcgtttggagtcgaacgacaaaccgttacgccaactaagtcgttacgtttacccggaagggggtacgtacggtaccgtacggtaacggtttaaccgggaccgggtaaacgtaacggtaccgtaacccggacccctaacgtaacggtacccttaacgtccgttacgggaacgtaccgtacgaaacgtaacggtacgaacgacccgtagaacgtaccgacggtccgttacacgtcgcgagacgacgtccgaccccggacccccggagggacccgaacggaggtacggagggtacgggtaccgtaacgggttcggtttacggtccctttagtaacccgttacgtacgttacgtacgg

SEQ ID NO: 187712 - DNA, 785 bp, Homo sapiens
  misc_feature: GYAE6OF01D43NR.5.64.F09.1.454.CMB.1.raw
  modified_base (742)..(742): a, c, t, g, unknown or other
  misc_feature (742)..(742): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttggtggtggcagcagctacgaggtcgtccacgtcccgaggtgactaacgtggtgcgacggttcggtggggtctgggagggtaggaacggaccggtccggttcggggtccgttcgggtaggtaacggttccgtcccgtaggaccggtaacgggccggttcgggtcggggggtaccctaccggttcggtacgttaacggtttcgtacccgttaagtttacggtttcgggtcggaccgaccggtaccggtcccccggtaggaaccggtaagggtcgttagggagggtaggtaggggtggggaacggtcgtcccggtttccgttggtttcggttaggacgtacgaacggaacctaaaccgtacgacgtaacgtacggttacgtacgttaccgggaagggtagtaccggacgtaacggtacggttacgggaccgtaacgtaacgtccggtaaccgaccgtaaccgacgtaccgtcgtacggtacgggacgtacgtaacggaaccgtaacggtacggaacgtaccgtaaggaccgtaacggtacccgttacgttacgacgtcgacgacgagacccgtccgacccccggacgggaccggacgacggtggacgngggcggacggtacgttcggttccgtcgtacctctagacgtacg

SEQ ID NO: 187713 - DNA, 795 bp, Homo sapiens
  misc_feature: GYAE6OF01ASOQN.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacgaggtcgtccacgtcccaggtgcaactggtgcagtcgtggggctgaggtgagacgcctgggtcctggtgacgtctcctgcaggcgtcggcgggggcctaccgttcggacgtaagtttcgacctatttacgttggggtgccgacgacggccccgtaggacgaagggtcttggaggtggaggtggggaggtactccggttccctgttcgttggacgcgaagacgaaactcgacacattagacgtttaccggaggggtacgtagtacgacggtacggttaaccgggacgtaacgggtaacgtaccgttaaccgggacccgtaaccgtaaccggtacccgttaagtccggttaacggggacgtaccgttaacggaaaccggtaaaccggtacggtaacggaacccgttaaggaaaccgggaacccggttaacccgggttaaccccggttttaaccgtaccggtacggacccggtaacggacggtaacccggtacccggttccccccgggaacccccccgggaacgggggaaccccggtaaacgggtacgggtaacggttacggggacgggggttacccgtaacccgggttccggttttaccggggtccctttacgtaacccggttaaccgtacccggttaaacgg

SEQ ID NO: 187714 - DNA, 866 bp, Homo sapiens
  misc_feature: GYAE6OF01C84DO.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttggtggtggcagcagctacaggtgtccagtcccaggtgcaactggtgcagtcgtggggctggaggtgaagacgtccgtcgggtccgtcgggtgaaggtcctccgtgcgaggcgtcggtgggggccaccgttcggctaaggtttcgcctagtttacgttgggtgcgacgacggtcccccgtaggacgaagggtcgttggaggtgggagtgggggaggtacgtccggttcccgttgttcgtttgggacgacctaggaacctaaaccgtaccgacctaacgtagtacgttaacgtttaccgggaaggggtaacgacggtaccgtaaccggtacggttaaccgggaccgggtaacgtaacgttaccgaacccgggaccccgtaacgaaccgttaccccgttaagtacgttacgggacgttacccgtaaggaaacccgtaaggtcggaaccggtaacccggttaaggaaaccgtacccggtaacccggggtttaacccgtttaacccggttaccgggttaccggacggtaacccgggtacggtacccgggtaaccccggtaccccccggggaaccccccccggggtaaaccgggggaccccgggtaaacggggtaacgggttaaccggggtacggggttacccggggggtaaacccgttacccggggtttacggttttacccggggttaacccctttaccggttaacccggttaacccgttaacggttaacccgg

SEQ ID NO: 187715 - DNA, 743 bp, Homo sapiens
  misc_feature: GYAE6OF01DVQNY.5.64.F09.1.454.CMB.1.raw
tcagatcagacacgcacgaccggtgctcgatttagcgcgtatacaaggggcatcacataacaaccagattcctcctctaaagaagcccctgggagcacagctcatcaccatggactggacctggacggtttcctctttgtggtggcagcagctacgaggtgtccagtcccgaggtgcaactggtgcgagtcgtgggctggaggtagaacgacgccgtgggtccgtcggtgacggtcctccgtgacgaggtcggtcggtcggggcctacgttcggactaagtttcgacctagttacgttgggtacgacgacgaccggtccccgtggaacgaagggtcgttaggaggtgggaaggtggggacggtacgtccggttccgttggtttacgttggacgtacgacgtaaccgtaaacgtacgactacgtacgtacggttaacgtttacgggaaggggtacacggtaaccgaaggtaacggttaccgggaacgggtaactaacgttcccggtaacggacctaaccgtacgtacccgttagtaccggtacggtacgtacgtaaccggaaacgtacgtacgaacgtaacggtacgaacgtaccgtaacggttacctttaacgcgtcgacgacgacggaccgaccggtaccccgaaccccgggacgggtaccgaaacggttagggtacggtacgggtccgggaacgtacggttacggttccggttacgttaaccttacgtaccgtagtaacgg

SEQ ID NO: 187716 - DNA, 834 bp, Homo sapiens
  misc_feature: GYAE6OF01B69DJ.5.64.F09.1.454.CMB.1.raw
  modified_base (357)..(357): a, c, t, g, unknown or other
  misc_feature (357)..(357): n is a, c, g, or t
tcagatcagacacgcacgaccggtgctcgatttagcgcgtatacaagggggcatcacataacaaccagattcctcctctaaaagaagcccctgggagcacagctcatcaccatggactggacctggaggttcctctttggtggtggcagcagtctacgaggtgtccagtcccaggtgcaactggtgccagtcgtggggctggacggtaggaacgaccgccgtcgggtccgtacgggtagaacgggtcctccgtcgacggtaacgggccggtcggtcggggggcctaccgttcggacgtaagttcggcctaagttacgttgggtcgcgacgacggtcccctggacgagggtcttaggnggtggacggtggggaggtcgtccggttccgtggttacgttggagacgaggaaccgtaaactccgacacgtaagtcggtaacgtttaccggaagggacgacgtaccgtaagtacggttaaccgggacggtaacgaactccgtaaccggacctaacgacgttaacccgtagttacggtacggtacggaccgtaacgaaacgtaaacggcgtaaccggtaacccggtaagtaaaaccgggtaccggtaacccggtttaacccggtttaaccgtaccggtacgggtaccggaacggaacggtaaccggaccccggttaccccccggggaaccccccgggaaccggggaaccccgggttaaacgggtaaaccggggtaaggttaaccggggggtaccggggtaaccggtaaccggggttttcccgggttacgggttaccccgtttaaccgttaccggttaaaccgttaccggttaaacccgg

SEQ ID NO: 187717 - DNA, 703 bp, Homo sapiens
  misc_feature: GYAE6OF01BJ00J.5.64.F09.1.454.CMB.1.raw
tcagatcagacacgcacgaccggtgctcgatttagcgcgtatacaaggggcatcacataacaaccagattcctcctctaaagaagcccctgggagcacagctcatcaccatggactggacctggaggttcctctttgtggtggcagcagctacaggtgtccagtcccaggtgcgaactggtgctagtcgtggggctggaggtgaagacgccgtgggtcctcggtgaacggtctcctgacgaggtcgttcggcgggggctaccgttcggacgttaagtttcgccgtagtttaccgtgggtcgaccgtacgacggcccgtaggacgtaaggtctaggagtggaagtggggaaggctccggtccgttggttcttaggagacacggactaaacgtcgaccagtagtacgtaacgtttccggaagggtagtacgtacgaacggtaagtaccgggacgaacgtaacttccggaccggacctaccgacgtaccgttaacgtcgacggtacgtacgaacggtaaccgacggtacggaaccgtacgtaaggaaccgtaccgtaaccggttaccttaacgtaccgacgcggtacgtaacggcgaacccggtccccgacccgggaaacgggaccgaacggtaacggttacggcgggtaacgggtacgtaaccgggtttcgttacggtaccttaacgacgttaccgtacgtacgg

SEQ ID NO: 187718 - DNA, 635 bp, Homo sapiens
  misc_feature: GYAE6OF01A9F0J.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgaagacgcctgggtcctcggtgaagtctcctgcaaggcgtcgtgggggcaccgttcggctaagtttcgcctagtttacgttgggtgcgacgacggcccctggacgaagggcttgaggtggagtgggaggatcgtcctgtcttggagcagcaaactcgcacatcgacttcgagggtagagtcacgtagttacggacggtacgaacgtccgtaacggccaacgacgtacctagcgtggacgtgaacgaacgtagacgaacgtacgtagaacgtacgaccggtaccgttaacgcgtcggacgacggaagaccgtacccggtacccccggaccccgggtaacgggacccgtaacgggtaacggtaaggacggggtacgggaaccgtaccgggtttaccggttccggttaccttaaccgtacccttaacgtaaccgtaccg

SEQ ID NO: 187719 - DNA, 1067 bp, Homo sapiens
  misc_feature: GYAE6OF01ETX9H.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacgaggtcgtccacgtcccgaggtcgacaacgtgggtgcgtacggtccggtggggccgtggtagggtacggaacggtaccggtcccgttcgggggttcccgttaccggggtaggtaaaccgggggttcccttaccccgttacgggaccggtaaaacgggggtcccgggttcccggggttaccggggggggtaccccgttaaccccggttttaccggggtaccggtttaaacgggtttttaccggtaacccgttaaacggttttaaccggttttcggggggttacggacccgggtaaaacccggtaaccccgggggttcccccccggttaacggggggtaacccgggtaaacggggggtaccggttttaggggtaaccgggggttagggggtaaacgggggttacgggggggtaaaccggggttacgggtttacccgggtttcccccgggttttaggtttccgggtttacggggaacggtcgtaaaccggtaaccgtaaaaaccgtaccggtacgtaaaccgtacggttacggtaacccggtttacgggaagggggtaacgtacgtaaccggtaacggtacggttacgggtaccgaacggtactaaccggtacccgaccgtaacgtaccggtacctacgtcggtacggaacgaccgtaaacgtaacgaaccggtacggaaccggtaaccgtaacgggaaccggtaacccggtacccgggttaacccggtttaacctaccggtacggtaaccggtaacgtaacggacccggttaaccccgggtaccccgggtaaacccccgggaaccggggtaacccggtaacgggtaaccgggtacgggtacggggtaccggggaccgttaaccgggttcggtttacccgggaccgtttaacgtaacccgttagtaccgtaacggg

SEQ ID NO: 187720 - DNA, 818 bp, Homo sapiens
  misc_feature: GYAE6OF01ARCZH.5.64.F09.1.454.CMB.1.raw
  modified_base (452)..(452): a, c, t, g, unknown or other
  misc_feature (452)..(452): n is a, c, g, or t
tcagatcagacacgcacgaccggtgctcgatttagcgcgtatacaaggggcatcacataacaaccagattcctcctctaaagaagcccctgggagcacagctcatcaccagtggactggacctggaggttcctcttgtggtggcagcagctacaggtgtccagtcccgaggtgcacgtggtcgcgtagtcggtggggtctaggacggtaggaacgacggtccgttcgggtcccgttgggtaggtaaccggttcgtccgtaggaccggtaacgggcggtccggtcgggggtcctacccgtttccgggacttaaggtttccgtaccgttagtttacggttggggtacgccgtaccggaccggtcccgtaggacggtagggtcgttggacggtaggtaggtgggacggtacgtccgtccgtgttcgttagcgtacacgacgaaccgtcgtacganagttacgtacgttacggagggtacgtagtacgtacggtacgttaaccgggcgtaacgttaacgtaccggtaccggaaccctaacgtaccgtacgttaacggtcgtaacggtacgtaccggtaaaccggaacgtaaccggtcgaaccgtaaccgttaggaaaccggttaccgggtaaccgttaaccccgttaacgtccgggtaagcccggttaagaccgggacccgttacccggacccccccggaacccggggaccgggtaaccggtaccggtaacggggtaccgtaacgggtcccggggtaccgtaaccggggtttccgttaaccgggtacccttaacgtacccgttaaaggtccgttaaaccggg

SEQ ID NO: 187721 - DNA, 645 bp, Homo sapiens
  misc_feature: GYAE6OF01DXX4E.5.64.F09.1.454.CMB.1.raw
  modified_base (533)..(533): a, c, t, g, unknown or other
  misc_feature (533)..(533): n is a, c, g, or t
tcagatcagacacgcacgaccggtgctcgatttagcgcgtatacaaggggcatcacataacaaccagattcctcctctaaagaagcccctgggagcacagctcatcaccatggactggacctggaggttcctctttgtggtgcagcagctacaggtgtccagtcccaggtgcaactggtgcagtcgtgggctggaggtagaacgacgccgtgggtcctcggtgaaggtctccgtgcaggcgtcgtggggccaccgttcggcgaagtttgcctagtttaccgttgggtgtcgaccgacggcccctagggacgaacgggtcttggacggtggagtagggagggtatccggtcccgttgttcgtttggacgtcgagactaaactacgcaactatcgactttaccgagggacgagtcaggtatacggacgtacgaactccgtacgtccgacacgtacctatcgtggaccgacgtagaacctaacggtcgaacgtactaaggaacgacgtacggtaccgtttaacgtaccgtgaccgngtagaccgtcgacccccggtacccccgggaacgggaccgaacggtacgggtaagacgggtcggggacgtaccgggttcgtttcgggacctttcgtaactacgttactaacgg

SEQ ID NO: 187722 - DNA, 724 bp, Homo sapiens
  misc_feature: GYAE6OF01A38UD.5.64.F09.1.454.CMB.1.raw
tcagatcagacacgcacgaccggtgctcgatttagcgcgtatacaagggggcatcacataacaaccagattcctcctctaaagaagcccctggagcacagctcatcaccatggactggacctggaggttcctctttgtggtggcagcagctacaggtgtccagtcccaggtgcaactggtgcagtcgtgggctgaggtagaagacgccgtggtccgtcggtgaacggtctcctgacgaaggtcgtcggtcggggctaccgttcggactaagttcgccgtagtttacgttgggtcgaccgaacgaccggtccccgtaggacgaacgggtccgttaggtaggtcgggagtacgggggtacggtacggttaccggttccccgttaggttccgttttgggaacgtaccggaaacgtaaccgtaaaacgtcccgaaccgacgtacgttacgtaacgtttaccgggaaggggtacgtacggtaccgaacggtaaccgttaccgggaacgggtaacgtaaacgtaccgtaccggacctaacgacgtacccttagacgtggaacgtctaaacgaacgtacgtagaactacgtagaacgtaccgtacggtcttaacgcgtacggacgtacgagacgtacccgaccccggaccccggtaacggccgaaacgggtcggtagacgggtcgggaccgttaggtccgtttcggcctttaaccacgttacctcgtaacg

SEQ ID NO: 187723 - DNA, 813 bp, Homo sapiens
  misc_feature: GYAE6OF01CO4XG.5.64.F09.1.454.CMB.1.raw
tcagatcagacacgcacgaccggtgctcgatttagcgcgtatacaaggggcatcacataacaaccagattcctcctctaaagaacgccccgtgggagcacagctcatcaccatggactggacctggaggttcctcgtttgtggtggcagcagctacgaggtcgtaccacgtcccgaggtcgactaacgtggtgcgtacggtcggtggggcgtaggagggtaggaacggccggtccgtcgggttccgtcgggtacggtaacggttccgtccgtacggaccgaacggtcggtaccgggtcgggggacctaccggttcggacgttaacggtttacgtaccgttaagtttcggttacgggtacgaccggtaaccgtaccgggcccccgtaggggaacggtaacgggtcgtttaaggacggttaggggtaggtacggggtacgggtacgttcccggttaccgttgggttacgttacgggacgtaccgacgtaaccgtaaaccgtaccggactaacgtacgttacggtaacggtttaccgggaaggggtagtacgtaacgtaacggttaggtaaccgggacggtacgtaaccgttacggaaccgaccgacgtacgtaccgtagtacgtaggcgtacgtacgaacacgggtagacgtaccgtaggaaccgtacggtacccggttacttacgacggcgtacgacgtaacgcccgtacccggtaccccgggaccccggtacgggaccgtaaacggtcggtacggacgggtccgggtaaccgtcggttaccgttcggtacctacgtaacctcgtacgtaccgg

SEQ ID NO: 187724 - DNA, 765 bp, Homo sapiens
  misc_feature: GYAE6OF01C9N6X.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctgaggtgaagacgccgtggtcctcggtgagtctccgtgcgaacggcgtcggtggggcctaccgttcggctaaggtttcgacctagtttcgttagggtcgcggaccgacggtccccgtggaacgtaacgggtccgttggtaggtcggaggttggggaggtactccggtccgttgttcggtttggacgtcagacctaaacgtcgacaacagtcgtacgttccggaggggtatacgtcgaacggtacgttacgggaccggtaacgtaacgtccgtaaccgggaccctaacgtacgtaccgttacgtccggtagggtacgtaccgtaacggaaaccgtaacggtaacgaaccggtaacccgtagggaaaccgtacccggtaccgggtttaaccccgttaaccgtaccgttcggaccggtacgtaacgggacgtacccggtaccccccgggacccccgggaaacggggacccgtaaacgggtaccgggtaaggtacggggtcggggaacccgtacggggtttacccggtttacgggacccttaccggttaacccttaaccggtacgttaacccggg

SEQ ID NO: 187725 - DNA, 1024 bp, Homo sapiens
  misc_feature: GYAE6OF01BL505.5.64.F09.1.454.CMB.1.raw
tcagatcagacacgcacgaccggtgctcgatttagcgcgtatacaaggggcatcacataacaaccagattcctcctctaaagaagcccctgggagcacagctcatcaccatggactggacctggaggttcctctttgtggtggcagcagctacgaggtgtccagtcccgaggtgacaacgtggtgctagtcgtggggctggaggtaggaagaccggccgttcggggtcccgttcgggtacggtaacgggttccttccgtcggacgaagggtccggtcgggtcggggggacctacccgttccgggtacgtaacggttttcggtaccgttaacgtttaccggttcggggtacgtaccggaaccggtaccgggtacccccggtacggggtaacggtaacgggggttaccggtttagggtacgggttacggggtaacgggttaggggggtaacggggttaccggtttaccccgggtttccccggttttacgggtttaccgggttttacggggtaaccggtaaccggtaaccggtaaacccgtaaaaaccggtaaccggtaacccgtaacggttaaacgttacggttaacccggtttaaccggggaagggggtaacggtaccggtaaccggtaaacggttaaccgggtttaaacccggggaccgggtaaaccgttaaacccggtacccgggtaaacccgggaacccgtaaccgtaaaccgggttccccgttaaacggttccggtaacggggtaacggtacccgtaaacgggtaaaccccggtaacgggttaccggaaacggttaccccggtaaaggaaacccgttaccgggtaacccggtttaacttttaacccggaacgggttcgaaccgggtacggaacggtaccggtacccggtaccccccggggaaccccgggaaaggggtacccgtaaacgggtcgggttaaacgggtacggggtacggggaacccgttaaccgggttccggtttacgggaccctttaaccgtaaccttaaacgtccggtaacg

SEQ ID NO: 187726 - DNA, 763 bp, Homo sapiens
  misc_feature: GYAE6OF01E0WKY.5.64.F09.1.454.CMB.1.raw
tcagatcagacacgcacgaccggtgctcgatttagcgcgtatacaagggggcatcacataacaaccagattcctcctctaaagaagcccctgggagcacaactcatcaccatggactggacctggaggttcctctttgtggtggcagcagctacaggtgtccagtcccaggtgcaactggtgcagtcgtggggctggaggtgaagaccgccgtgggtccttcgggtgaggtcctccgtgcgaaggcgtcggtgggggcctaccgttcggctaagtttcgcctagtttacgttggggtacgccgacgacggccccgtaggaaccgaggggtcttggtagtgggaggtggggagggtactccggtcctagtttcgttggagcgagactaaacgtacgacaacctagttcgtacgtttccggaaggggacgacggttaccgaacggttaacggtaaccggggccggtaacggtaacgtaccgtacccgggtaacccaaccggtacgtcccgttaacgtacggtacgggactaccgtacgtaacgtaacggtacgaacgtaccgtaggaaccgtaccggtacccggttaccgtttaacacgttacgggacccggacggtaacggaccgtaccccggtacccccggaccccccggggtaaagggaccccggtaagggacgggttacggttacgggggaccggggtacggtaccgggttcggtttacgggtaccctttacgtaccgttaccgttaaccgtgtaaccggg

SEQ ID NO: 187727 - DNA, 853 bp, Homo sapiens
  misc_feature: GYAE6OF01APSYE.5.64.F09.1.454.CMB.1.raw
tcagatcagacacgcacgaccggtgctcgatttagcgcgtatacaaggggcatcacataacaaccagattcctcctctaaaagaagcccccgtgggagcacgagctcatcaccatggactggacctggaggttctctttgtggtgcagcagctacaggtcgtccagtcccaggtcgcaacgtggtgcagtcgtgggctgaggtgaagacgccgtgggtcctcggtgaacggtccttccgtacgacgtaacgggccgttcggtcggggggtcctacccgttcggtacgtaagtttcggaccctaagtttaccgttggggtcgaccgacgaccggtcccccgtaggaaccgaaggggtcttacggagtaggaggtacggggaggacgttcgtcccgttagttcgttaggacgcaacgtaccaaacgtaccgacgtaactacgtgtaactttccgggaaggggtacgaggtaccgtaaggtaacggttacgggacggtaacgtaacgtcccggacggtaccctacgaccggtaccctaacgtcgtacgggtacgtacaacggtaaaccgtaacggtacgaacgtacccgtaaggtaaccgtaaccggtaaccggtttaccgttaccgtaccgttaccggacgttaacggacgaacccggtaccgtacccccccggggaacccccggttaaccgggggaaacccgtaaacccggggttaacgggttaacccggtacgggggggtaaaccccggggttaccgggttaaaaccccgggttttaccccggggtttaccgggttacccccgtttaaaccggttacccgttaaacccgttaaaccccggtttaaacccgggg

SEQ ID NO: 187728 - DNA, 562 bp, Homo sapiens
  misc_feature: GYAE6OF01DWFMU.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggcaccttcggcaagtttgccattacttgggtgcgacaggcccctggacaagggcttgagtggagtgggagggatcgtccctgtctttggagcgagcaaactcgcacatgatttccgaggggagagtcacggattacgggacggtacgaagtcgtacggccacgagccctatcgtggagactgaacaacgtgagacctgaagacgacggccgttacgtactgcgcgagacgactcccggaccccccgaaggggacccgaacggacggtagtaggtcggggacacgggcgtttcgggccttacgtactcgtacgtacg

SEQ ID NO: 187729 - DNA, 775 bp, Homo sapiens
  misc_feature: GYAE6OF01DPNO7.5.64.F09.1.454.CMB.1.raw
tcagatcagacacgcacgaccggtgctcgatttagcgcgtatacaaggggcatcacataacaaccagattcctcctctaaagaagcccctgggagcacagctcatcaccatggactggacctggaggttccttctttgtggtggcagcagctacgaggtcgtccagtccccgaggtgccaacgttggtgctagtcggtggggtctggtagggtagaacgaccggtccgtcgggttccgttcgggtaggtaacggtccttaccgtggaccgaagggtccgtcggtcgggggacctaccgttcggacgtagtttcgcgtagttacgttgggtcgcgtaccgaccggtcccgtaggacgtaacgggtcgttaggaggtgggaggtgggaggttaccggtccgtttccgttcggttcgtttgggacgtacgaacgtaaccgtaaaccgtcgaacctagttacgttacggtacgttacgggaagggtacgtacgtacgacggttacgtacgggacgtaacgtcgtaccgtacggaccctagaccgtacgtacgcggtaagacggtacgacgtaaacaggtacgacgtacgtacgaacggttacccgtgttaacccgtttagacggtccgtacggacgaaccgtaccgggtaaccccgtacccccgggaccccggggaaacgggaaccggtacggttaagggtcgggttaacggggccgggtaacgtttaccgggttccggttaccgttaccgttacgttacccttacgaaccgttacggg

SEQ ID NO: 187730 - DNA, 896 bp, Homo sapiens
  misc_feature: GYAE6OF01EQSZ0.5.64.F09.1.454.CMB.1.raw
tcagatcagacacgcacgaccggtgctcgatttagcgcgtatacaagggggcatcacataacaaccagattcctcctctaaagaagccccctgggagcacagctcatcaccatggactggactgaggttcctctttgtggtggcagcagctacgaggtgtccgacgtcccaggtcgcaaccgtggtgcagtcgtggggcctggaggtagaacgacgcgttcgggtccgtcgggtagaacggttcctccgtagacgaaggtcggttcggtcgggggacctaccggttcggtacgttaaggttcgtacctactttacggttcgggtcgaccggtaccgaccggtcccccgtaggaaccgtacgggtccgtttagggacggtggggaggtcggggtaggtacgttccggttccgttcgtttacggttcggacgtacgacgaacgtaaacgtaccggcaagtacgtagtacgtttaccggaggggtataacggtacgacggtaacggttacggacgtaacgaacgtacccggtaacgcctaaccgacgtaccgttacgtacgtagggtaccgtacgtaacggtaaccgtaacggtacgacggtaccggtaacggaacgtaaccggttacccggtaaccccggttttaacgtccgttacgggaaccgggtacgtaacggaccggtaacccccggtacccccgggtaacccccccgggggaaaccgggggtaaccccggtaaaccggggtaaccggggtttaacgggtaacccggggggttaacccgggggtaaacccgggttaacccgggggtttacccggggttttaaccccgggtttacccccgtttttaaccggtttaaaacccggtttaaaccccgttaaacggttaaaccccgggg

SEQ ID NO: 187731 - DNA, 865 bp, Homo sapiens
  misc_feature: GYAE6OF01CJNJ8.5.64.F09.1.454.CMB.1.raw
  modified_base (202)..(202): a, c, t, g, unknown or other
  misc_feature (202)..(202): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccgacgtcccgaggtgctaacgtggtggcagtcgtgggtcgnggaggtaggaagacgccgtgggtccgtcggtggtaaggtcgtccgtgcgaaggcggtcgtggggggcctaccgttccgggtctaaaggtttcgaccctaagtttaacggtttcggggtacggtccggaaccgtacggtccccccgtggggtaaaccgaaggggcgtttaccggaggtaggggtaaggtggggacggggtaacgttcccgggttccccgttacgggtttacggttttcgggacggtaacgaccggtaaccgtaaaaccgtaccggtaccgtaacgtagtacggttaacgttttacccgggaagggggtacgtaaccggtactaacgggttactaaccggggaccgggtaacgtaaaccgtacgttaacccgggaccgtaaccgacggtaacccgtaacgttacggtacgggaaccgtcgtaacgtaaaccggaaaccggtacggtaaccggtaccggtacgtaaacggtaacccggtaccggttaacccggtttacctaaccggtgaaccggtacgacggtacggacccgtaccccggaccccccggggtaaccggggacccgtaaaccgggacggttaaagggtacggtcgggggtaccgtaaccgggttcggtttacgggcccctttaacgtccgtaccgttaacgtaacgg

SEQ ID NO: 187732 - DNA, 842 bp, Homo sapiens
  misc_feature: GYAE6OF01C5EJL.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctcttgtggtggcagcagctacaggtgtccagtcccaggtgctaactggtgcagtcgtggggctggaggtgagacgcctgggtcccttcggtggaaggtcctcctgcaagggtcgtacgtcggggggtccaaccgtttcggaccgtaaaggttttcggacctaagtttaccggtttaggggtacgacggtaccgaaaccgggtcccccgtaggggaacgtaaaacgggggtccttttaggggaacggttggggtaacgttaggggggacggggtaacgttcccggttaccccgtttggttaccgttttaggggacggtacccaagggttaaccaaaaccgtacggtacctaaaccgtaagttcggttaacgttttacccggaagggggttaacgaccggttaccggtaaaccggtaacggtttaaccggggaaccggaacggtaaacgtttacccggtaccgggaaccctaacgaaccggtacccttaacgtaccggttaggacgtaacgttggaaaaccgtaacggtacgtaacgtaaccgtacgaacgtaacccggtaacggttacccgtttaacgtaccgttcgcggtacgtaacggacgacgtacccccggaccccccgggaggggaaccgtaaccgggagtaccgtaggtacgggacggtaaccgtacggttcggttaccgtaccgtttaactaccgtacgtaacg

SEQ ID NO: 187733 - DNA, 761 bp, Homo sapiens
  misc_feature: GYAE6OF01ELWG7.5.64.F09.1.454.CMB.1.raw
  modified_base (593)..(593): a, c, t, g, unknown or other
  misc_feature (593)..(593): n is a, c, g, or t
  modified_base (603)..(603): a, c, t, g, unknown or other
  misc_feature (603)..(603): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtggggctggaggtgaacgacgcgtgggtccgtcggtgacggtctccgtgacgaggcgtcggtgggggcaccgttcggcgtaagtttcgcctagtttacgttgggtcgacgacgacgggtccccgtagggacgtaagggtcgttaggacggtggggagtgggggaagggtacgttccggttcccgtggttcgtttagggacggacgtaacggacctaaaaccgtaccggacaacgtacgttacgttacgtttaccgggaaggggtacgtacgtaccgtaacggtacggtttacgggacgggtaacgtaacgtacccggtaacggacctacgacgttcctagtacggtggaacgtcgtaacgaacgacggtcggactacgaagaacgaccgtaccggtacgtttacncgtcggacgnggaagaccggttacccgacccccggaccccggggaacgggacccggtaaacgggtcgggtaacgggttcggggtaccgggggtaaccgtaccggggtttacccggttttaccgggtaccgtttaacccttaaccggttaaccgttaccgttaaccggg

SEQ ID NO: 187734 - DNA, 852 bp, Homo sapiens
  misc_feature: GYAE6OF01CY2MM.5.64.F09.1.454.CMB.1.raw
  modified_base (226)..(226): a, c, t, g, unknown or other
  misc_feature (226)..(226): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctcttggtggtggcagcagctagaggttgtccagtcccaggtcgacaacgtggtgctagtcgtgggcgtggaggtgaagcgcgtcggtcctggtnaacggtctctgcaaggtcgtggtcggggcctacgtcggctaagtttcgaccgtaacttacggtttgggcgtaccggaacgacggtacccccgttagggaaccgtaaacggggtcttaaggaggttaggggaagtagggggtacggtacttccggtacccgttagtttcggttacggaggtccgaaggaccaaaacgtcgaaccctagtacgttaggtacgtttaaccgggaggggaacgtacgtaaccgaacggttaaacgttaaccggtaaccgggtaaacgtaaaccggtacccggtaccggaaccccgtaaacggtaacccgttaaccggttacggtaacgtaacgggacgttaaccaaccggtaaaaccggtaacgtacggtaaccggtaacgttaaaccggaacgtaaaccggttaccccggtttaaccgtttaacccggtaacgttaccggacggtaacgtaaccggtaccgtaaccccggtaacccccgggaaacccccccgggaaacgggggaaccgtaaccgggtaggttacgggtaacggggtacgggtaaccgggtaaccgggtttacggttacccgggttaacttaccgtaaacgtcccgtaaacggttaaccg

SEQ ID NO: 187735 - DNA, 827 bp, Homo sapiens
  misc_feature: GYAE6OF01A54KB.5.64.F09.1.454.CMB.1.raw
  modified_base (353)..(353): a, c, t, g, unknown or other
  misc_feature (353)..(353): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgctagtcgtgggctggaggtagaagacgccgtgggtccgtcggtagacggtctcgtcgacgaagggtccggtcggtcggggggtcctaccgttcggacctaaggtttcgaccgtagtttcggttgggtcgcgaccgccggtacccccgtggaaccgaagggttctggtaggngggtacggtgggggacggtacgtccggttccgttagtttcgtttgggagaccgtaaggacctaaaccgtaccgaccaacgtacgttagtaaccgtttccgggaagggaacgtaccggtacgtaaccggtaacgttaaccgggggtaccgtaacgtaaccgttccggtaccccggaacctaacccggtaccgtaccgtaacgttccggtaacgggaccgtaccgggttaaacgaaaccgtaaccggtacggaaccggtaaccgtaacggaaccgtaacccggtaacccggtttaaccggtttaacctacgggtccgtaccggacgtagggaccggtacccccggtaccccccgggaacccccgggacggggaaccccggtaacgggtacgggttacgggtaggggtaccggggtaaccgtacgggtttccggttaccgggttaccttaaccggtcccttacggtaacccgtacgg

SEQ ID NO: 187736 - DNA, 883 bp, Homo sapiens
  misc_feature: GYAE6OF01AFHFM.5.64.F09.1.454.CMB.1.raw
  modified_base (180)..(180): a, c, t, g, unknown or other
  misc_feature (180)..(180): n is a, c, g, or t
tcagatcagacacgcacgaccggtgctcgatttagcgcgtatacaagggggcgatcacataacaaccagattcctcctctaaagaagcccctgggagcacagctcatcaccatggactggacctggaggttcctctttgtggtggcgagcagctacgaggttgccgtagtctcgtaggtncaacgtggtgcagtcgtggggctggaggtgacggaccgccggttcgggtaccgttcgggtacggtaacggtccgtccgtcggacgacgggcggttcggtcgggggtacctaccggttacggacgttaacggttccgtccgtaacgtttacggttcgggtacggtaccggtaaccggaccgggaccccgtacgggtaaccggtaaacggggttctacgggtaaggggtcgggaagggtacgggggacggggttaacggttcccggttaccggttacggtttccggtttaacgggacgaccggtaacggaaaccggtaaacgtaccgtaacccgacgtaacggtttaccgttaacgggtttccgggaaaggggggtaccgtaccgtaacggtaccggtaaacgggttaacccgggtacggtaaaccgtacggtacccggtaacccggaccgttaaaacggcccgttacctaacgggttcggacggtaacggtaaccgtacggtaacgtaaccggtggtaaccgtacgacgggtaaccgaaccggtaccggttaccgttaaccgtacggccgcgttaacggacgtaccggaacccggtccccgaccccggggaacggacggtaaccggtacgggtacggtacggggtaccgggtaccggtacgttcccggggttacgtaccccgttagttcccgtaactaaccggg

SEQ ID NO: 187737 - DNA, 625 bp, Homo sapiens
  misc_feature: GYAE6OF01CAHTW.5.64.F09.1.454.CMB.1.raw
  modified_base (502)..(502): a, c, t, g, unknown or other
  misc_feature (502)..(502): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctggaggtgaagacgccgtgggtcctcggtgaaggtctccgtgcgaaggcgtcgcgggggctaccgttcggactaagtttcgcctatttacgttgggtgcgacgcggccccgtggacgaagggtcttggagtggagtgggaggtactcgtccgtgtcgttggagcagacaacgtcgcacatgtacttcgagggacagtacacgtattacgtacggaacgactccgtacggccacgtacgacctagtcgtaggtacgtctaacgtaacaacggtacgacgaaccgtagaacgtacgaccgttaccgttacncgtcgacgtacgagacgtaccgcccggtacccccggagggtacccgaaggtacgggtacgacggggtcgggaccgtacgggttccgtttcggtaccctttacgtacctaccgttacgtaacgg

SEQ ID NO: 187738 - DNA, 792 bp, Homo sapiens
  misc_feature: GYAE6OF01C81M0.5.64.F09.1.454.CMB.1.raw
  modified_base (209)..(209): a, c, t, g, unknown or other
  misc_feature (209)..(209): n is a, c, g, or t
  modified_base (258)..(258): a, c, t, g, unknown or other
  misc_feature (258)..(258): n is a, c, g, or t
tcagatcagacacgcacgaccggtgctcgatttagcgcgtatacaagggggcatcacataacaaccagattcctcctctaaagaagccccgtgggagcacagctcatcaccatggactggacctggtaggttccttctttggtggtggcagcagctacgaggtcgtccagtcccgaggtgcgtaactgggtcgcgtagtcggtggggtntggaggtagaacggccgtcggtcggtccgtcggtagtaacggtcctcgngacgtaaggcggtcggtcggggctaccgttggacgtaagttcgacttagttacggtgggtcgaccgtacgaccggtcccgagggaacgtacgggtctggaggtaggaggtggggagtaccgtccggttccgttagttccggttaggacgacgaacgtaccgtaaacgtcgactaacgtagttacgtaacgttacgggagggtaactacggacgtaacgtacgtaccggacgtaatacgtcgtaaccggcctaacgcgtcgtagtggtacgagtcctaacggaaacgtacgtacgaaccgtaacgtaacggaacgtaacccggtacggtttaacccgttacgtaccggtcggaaccggtacgaacccggtacccggttaacccccggaccccccgggaacccccggggtaaacggggaacccggtaaaccggtaggggttaaaccgggaccggggtccgggtaaaccggttacccgggttttccggttaacccggtaaccctttaccgtaaacccgttaaccgttacgtaaccgg

SEQ ID NO: 187739 - DNA, 892 bp, Homo sapiens
  misc_feature: GYAE6OF01DUT6Q.5.64.F09.1.454.CMB.1.raw
tcagatcagacacgcacgaccggtgctcgatttagcgcgtatacaagggggcatcacataacaaccagattcctcctctaaaagaagcccctgggagcacagctcatcaccatggactggacctggaggttcctctttgtggtggcagcagctacaggtcgtccagtcccgaggtgcaacgtggtgcagtcgtgggctggaggtgaacgacgccgtgggtccgtcggtagtacggtctccgtgacgaaggtcgtcggtcggggcctaccgttcggcttagttcgccttagttacgttgggtcgacgacgtccggccccgtaggaacgaagggtcgttggacggtaggaggttggggaacggtacgtccggttaccgtggtttcgttaggacgtcgaacgtaaccgtaaaccgtccgacgtaacgtaggttacgtaaccggtttaccggggaaggtcgtaacggtaccgtaacggtacgttacccggggaacggtaaccggtaactcccgggttaaaccgacccgtaacggtaccgtacccggtttaagtaccgggttaacgggtaccgtaccggttaaacggtaaaccgggtaaacggtacggtaaacccgacggtaacgtaaacccgggtaccgttaacccgggttaccgtttaaccggtaccggttaggggaacccgtccgggtaaacgaccggggttaccccccggtaccccccggggaaaccccccgggggtaaaccgggtaaaccgggaaacccggttacgggggttaaacggtaccggggggttcccgggggtaaacccggtttaacccggggtttccggtttttaaccggggaccccttttaaaccgttaaaacccggtttcccgttaaaccgggttaacccggg

SEQ ID NO: 187740 - DNA, 913 bp, Homo sapiens
  misc_feature: GYAE6OF01A6Y0F.5.64.F09.1.454.CMB.1.raw
tcagatcagacacgcacgaccggtgctcgatttagcgcgtatacaagggggcatcacataacaaccagattcctcctctaaagaagccccgtgggagcacagctcatcaccatggactggacctggaggttcctctttgtggtggcagcagctacaggtgtccagtcccaggtgctaacgtggtgcgtagtcgtggggcgttggaggttaggaacgaccggtccgttcggggtccgtcggtacggaacggttcctccgttggaccgtaagggtccggtacgggtcggggggtacctacccggtttaccggtacgtaaacggtttttcggacccttaacggttttacggtttcgggggttaccgaccggtaaccgtaccccggggtcccccgtaaggggtaaaccggtaacggggttcgtttacgggtacgggttaagggggtaggggttacggggggtaacgggtaccggttttcccggtccccggtttacgggtttccggtttaaggacggttaccgaaccggtaacctaaaacgttaccgacgtaacgtacgtattaaccggttaccgggaagggtacgtaacggtacgtaacggtacggttaccggacggtaaccgtaggttacccggaaccgcccgaacgtacgtacctacgtacgtacgggagaccgtaacggtaccgtaaacgttacggaaccgttacggaacgtaacgacccggtaaccgttacgttaaccggtccggtacggacgtacggtaaccggacggaccccggaacccccgggtaccccggggaaaccgtacccgggtaaacgggtacgggtagggtaaccggggtccgggaaacccgttaacgggtttcgtttacccgggttcttacccttaaaccggtacccgttaaccgtaaccggg

SEQ ID NO: 187741 - DNA, 911 bp, Homo sapiens
  misc_feature: GYAE6OF01CWTXZ.5.64.F09.1.454.CMB.1.raw
  modified_base (136)..(136): a, c, t, g, unknown or other
  misc_feature (136)..(136): n is a, c, g, or t
tcagatcagacacgcacgaccggtgctcgatttagcgcgtatacaagggggcatcacataacaaccagattcctcctctaaagaagcccctgggagcacagcctcatcacccatggactggacctggaggttcctntttgtggtggcagctagctacaggtgtccagtcccgagggtgcaacgtggtgctagtcgtggggctggaggtgaagaccgtccgtgggtcctgggtggaggtctcgtgcgaagggtcgtcgggtcgggggcctaccgttcggtcgtaagtttcgcctagtttacgttgggtcggcgaccgacggccccgtacggaacgaacggggtcttaggtcggtaggggtaggttgggggaaggggtacgttccggttccccgttggttaccggtttttacggggcgggtacccggaaccgtaaacgtacccggtacgtaaccgtacgttaacgttacggtttacccggtacgggggaacggtagggtacccggtaacggtaacggtttacgggaaccggggtaacggtacgttaaccggtaccgggaacccgtaaccggaccgtacccgttacgtccggtacggggtaggtacccgtagggtaaccgtaacgggtaacgtacgggtaaccgtaacggtaacggtaccggttaaccgggttccggtttaacccgttaacgggtaccgtccggtacccgggtaacgggtaaccggtaccccgggtaacccccggggaaccccccccggggaacccgggggaacccggggtaaccgggtaaaccggggttaaacgggtttaccgggggaacgggggtacccggggttaacccgggttcccggggttttccggttaccccgtttaccggtacggttaacccttaaccgttaccggttaaaccggg

SEQ ID NO: 187742 - DNA, 797 bp, Homo sapiens
  misc_feature: GYAE6OF01CMOJM.5.64.F09.1.454.CMB.1.raw
  modified_base (137)..(137): a, c, t, g, unknown or other
  misc_feature (137)..(137): n is a, c, g, or t
  modified_base (625)..(625): a, c, t, g, unknown or other
  misc_feature (625)..(625): n is a, c, g, or t
tcagatcagacacgcacgaccggtgctcgatttagcgcgtatacaagggggcatcacataacaaccagattcctcctctaaagaacgcccccgtgggagcacagctcatcaccatggactggacctggaggttcctntttgtggtggcagcagctacgaggtgtaccagtcccgaggtgcaacgtggtgctaggtcgtgggctggaggtgaacgccgtcgtgggtccgtgggtagtacggtctccgtgacgaagggccgtcggtcgggggtcctaccggttcggacgtaaggtttcgacctacgttacggttggggtcgacgacgaccggtccccgtaggggactaaggggtctttagggacggttaggaggtagggggacggtacgttccggttcccgttaggttcgttacgggagccgtaagtaccaaacgtaccggactacgtaagttacggtaacgttaccgggagggaactacggtacgacggtacggttacgggcgtaacgtaacgtaccgaccggaccagcgtacttaacgtcgagggtacaccgtttaaacggaacggtacgtaggaaccgtaacggtaacggaaacggttaaccgtaccggttaccggttttaacncggtaccgtcggaacgtaacggaccggttaccccggaacccccccggggtacccgggtaaccggggaccgtaaacgggtaacggttacggtacggggggacccggttaacgtacccgggtttcgggttaccggttaccctaacgggtttaacccgtgttaacccggtaacgg

SEQ ID NO: 187743 - DNA, 893 bp, Homo sapiens
  misc_feature: GYAE6OF01A5ISR.5.64.F09.1.454.CMB.1.raw
  modified_base (173)..(173): a, c, t, g, unknown or other
  misc_feature (173)..(173): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtncaactggtgcagtcgtgggctggagtgaagacgccgtggttccgtcggtagaaggtctcctgacgagggtcgtcgtcgggggctaccgttcggctaagtttcgacctagttacgttgggtcgcgacacggcccctaggaacgaagggtcttaggagttggaacgtaggggacggttacgtccggttccccgttggtttacgtttcgggaacgtaccgacggacctaaaaccggtacgaccgtaacgtacgttacggtaacgtttaccgggaagggggtaacgtacggttaccgaaccggttaaggtttacccggggaccgggttaaaccggtaccgtttacccgtaacccgggacccctaacgtacccggtcccgtttaacgttccggtagggtaaccgtaccgtaacgaaacccggtagtaaccgggtaaccgtaaccgtacgggaaacggtacccggtaaccgggtttaaccgtttacccgtaaccgttccgggaacgggttaccggtaaacggtacccgttaccccggtaccccccgggtaaccccccccggggaaaccgggggtaaccccgggtaaaccggggtaaacgggtttaaccggggtaacgggggttacccgggggtaaaccggttaccccgggggtttacggtttttaccccggggttaccccttttaacccgggtaacccttttacccgtaaacggtttaaacccggg

SEQ ID NO: 187744 - DNA, 735 bp, Homo sapiens
  misc_feature: GYAE6OF01AYOIF.5.64.F09.1.454.CMB.1.raw
  modified_base (236)..(236): a, c, t, g, unknown or other
  misc_feature (236)..(236): n is a, c, g, or t
  modified_base (338)..(338): a, c, t, g, unknown or other
  misc_feature (338)..(338): n is a, c, g, or t
  modified_base (376)..(376): a, c, t, g, unknown or other
  misc_feature (376)..(376): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtccccaggtgcaactggtgccagtcgtgggctgaggtgaagacgccgtgggtcctcggtgaacggtcctccngccaaggcgtcgtgggggcctaccgttcggacaagtttcgcctagtttacgttgggtgcgacgacggcccctggacgaagggtctggagtggagtgggaggnttcgtcctgtgttagcggcaagaccaactcgactacgntagtacgtttacgaggggtagtacgtacgaccgtaacgtacgggtacggaacgtacgtacgaccgtaccaccgacgtccctaagtaccgtaggacgtaccacggtaacggaacgttacggaacgtaaccgtagaaccgttacgaaccggttacccgtttaacgtacgttacggacgtacggaacggacgtacccgttacccccggaacccccgggaacccggggtacccggaaacgggtaccgggttaaaggtaccgggggttaccgggggtaacccggttaacgggtttacccgggttttacccgggacccgtttttaaccccgaacccggtttaacccgttaaccgttaaacccggg

SEQ ID NO: 187745 - DNA, 888 bp, Homo sapiens
  misc_feature: GYAE6OF01A7DVI.5.64.F09.1.454.CMB.1.raw
  modified_base (424)..(424): a, c, t, g, unknown or other
  misc_feature (424)..(424): n is a, c, g, or t
  modified_base (680)..(680): a, c, t, g, unknown or other
  misc_feature (680)..(680): n is a, c, g, or t
tcagatcagacacgcacgaccggtgctcgatttagcgcgtatacaaggggcatcacataacaaccagattcctcctctaaagaacgccccgtgggagcacagctcatcaccagtggactcggaccgtggtacggtttccttcgtttggtggtggcagcagcctacgagggtcgtaccacgtcccgaggtgactacgtggtgcagtcggtgggcgtggaggtaggaacgacggtccgtggggttccgtcgggtaggtacggtccttccgcggaccggaacgggtcggtcggggtaccgggggtcctacccgttcggtacgtaaggtttccggaccgttaggttacggtttggggtaccgccggaaccggccggtcccccggagggtaaccggtaacgggttccgttggtagggtagggtacgggnggggtacgggtacctttccggttacccgttggtttccggttgggacgtccgaacgtaccgtaaaccgtcgtacgtaacgtgtacggtacggtacgggtaagggtcgtacggaccggtaaaccggtagggttaccgggacgggttaaccgtaacggttaccccggaaccggaccgtaacggtaccgttacccgtacgttaccggaagggtaccggtaacgtacggtaaaccgtggtaaccggtactaacccgggtanaacccgggttactacccggggtttaaccctacgttaccggtacgggaccctacgggtaaccgaacccggtaccccgggacccgggtacccccgggaacgggtacccgggtaaggaccgggttacgggtacggggttcggggaccccggtttaccgttcgggtttaccccggagtttaccccggttaacctcgtaacgggtttaaccgg

SEQ ID NO: 187746 - DNA, 796 bp, Homo sapiens
  misc_feature: GYAE6OF01CFYTP.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaacgtggtgcagtcgtggggcgtgggaggtagaacgccgtccggtcgggtccgtcgggtaggtacgtcctccgtgacgaggtccggtcggtcggggacctaccgtcggagtacgttcgcgttacgttcggttgggtcgaccggaccgaccggtcccgtagggaacggtacgggttcgttaggaggtaggtagggtacggggacggttcgttcccggttcccgttggttcggttaggacgaccgtaacgaacgtaaaccgtcgactagtagttacgtacgttacgggaaggtagtacgtactaacggttacgtacggacggaacgtacgtaccgaccggtaccacgtacgtacgtacgtcggtacggacgtacgtaacgaacgtacggtacggaaccgtacgtaagtaaccggacccgttaccggtttacccgttacgtacgtcgggacgtacggtaacggacccggtaccccggaccccccgggtaaccccggggacgggaaccccgggtaacgggtaacgggttacggggtaacgggggtacccgggtacggttaacccgggtttccgggttaaccgggttaccctttaaccggtaaccttaaccggttaccgtaaacggg

SEQ ID NO: 187747 - DNA, 588 bp, Homo sapiens
  misc_feature: GYAE6OF01A4TVH.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtggggggctaccgttcggccaaggttttgcctattacgttgggtgcggacacgggccccctggaccaagggtcttgagtggagtgggaggatcggtccctgtcgtttggagcagcaaactcgcacatgatttccgaggggagagtcacgtattacgggcggacgaagtcgtacggccacgacgaccctatacgtggacgctagaacaacgtgacgactagaagacgaacgtaccgtttacacgtgccgcgagacgacgtcccgaccccccggagggacccggaacggacggtagtaggtcggggacctacgggtcgtttcgggtccttacgaccttcgtacctacg

SEQ ID NO: 187748 - DNA, 1033 bp, Homo sapiens
  misc_feature: GYAE6OF01DT9YS.5.64.F09.1.454.CMB.1.raw
tcagatcagacacgcacgaccggtgctcgatttagcgcgtatacaagggggcatcacataacaaccagatttcctcctctaaagaacgcccctggggagcacagctcatcaccatggactcggacctggacggtttccttctttgtggtggcagccaggtctaacgtcggttcgtaccgtacgtcccgtaggtcacgtaacggttggtgcgtacggtcggttcgggggtcctaggtcgggtaacgaacggacccgtccggttacggggtttcccggtagggttacgggttaacgtttccgttccgtacggaaccgggtacgggttccggtttcggggtaccggggggttcctttaacccgggtttccggtaccggtttacggttttccgtaaccgttttaggttttaccgggttttggggacggtacccggttaacgggaaccccgggttccccggtaagggtaaccggggttaaccgggttcggtttaggggtacggggttaggggtacggggttacgggggtacgtacgggttttccccgtacggttttcgggttcggtttacgggtaaccgtcgtaaccggaacgtaaaccgtctaactaacgttcgttacgggttacggttaccgggagggtacgtaaccgtacgacggttaaccggttacggaacgggtacctaacggttacccggtaaccgacccgaagggttaccctacgtacgtcggtacgtacggttaccgttacgaaccgttaacgggttaacgaaccgttacgaaccggaccgggtttaacgggtaccccttttacccgttaacggttaacccgggtgttaaacccggggacgtaccgtaaccccggaccccggggttacccccccggaaccccggggggtaggggttaaaacccgtaccgggggtttaacgaggggggttaaacccgggggttccgggtaaaccggggggtttccccttttcgggggtttaccgggtaaccccttttaccgtaccctttttaacggccggttaaccccggg

SEQ ID NO: 187749 - DNA, 922 bp, Homo sapiens
  misc_feature: GYAE6OF01CMMHE.5.64.F09.1.454.CMB.1.raw
tcagatcagacacgcacgaccggtgctcgatttagcgcgtatacaagggggcatcacataacaaccagattcctcctctaaagaagccccctgggagcacagctcatcaccatggactggacctggaggttcctctttggtggtggcagcagctacaggtgtccagtcccaggtgcaactggtgcagtcgtggggctggaggtggaacggaccggccgtcggggttcccgttcggggttaggtaaacgggttccgtcccgtggtaccgaaacggggtccggttcgggtcggggggtaccctacccggtttccgggtaccgttaaaggttttccggacccgttaacgttttaccggtttgggggttccggaccggtaccggaacccgggtccccccggtacggggaaaccggtaacgggggtccgttagggaggttacggggtaagggtacggggggtaacggggtacgttcccgggtttccccgtttgggtttccggtttcgggaacggtaccggtaaacggtaaaccgtaaaacccgtaaccggaccgtaaacgtacgttacggttaacgtttaacccgggaagggggtaacgtaccgtaaccggtaacggtaacgttaccggggaccggtaacggtaacgtacccggtaaccggacctaaccgacgtaccctagtcggtaggacgtacgtaacgaacgtaacggtagtacggtaaccgtaggaacgtacggtaaccggttacccggttaacgtacgtacggcggtacgaaggaccggtacccggaccccccgggtaacccccggggaacggggacccggaaacgggtaacgggttaaggtaccggggtacggggtacccggttacgggttaccggtttaccgggtaccttacccgtaaccgttaacgtaaccgtaccggg

SEQ ID NO: 187750 - DNA, 705 bp, Homo sapiens
  misc_feature: GYAE6OF01A7AHL.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggcctggtgaggtctcctgcaaggcgtcgtgggggcaccgttcggctaagtttcgccattacgttgggtgccgacacggcccccgtggacaaggggtcttaggacgtggtagtggggagggtactccggtcctggttcttgggatcgaggtacaaactcgacacatggtactttcgaggggtacagtcgaacggtacgttacgggaccggtaacgaacgtaccgtaccgggtacccacgaacgtacccgttaacgtccgtaggaaccggtcgtaacgtaaccgtaacgtacggtaacgtaacccgtaggaaaccggtaccgtaccgggttacccgtttacgtaaccgtcggaccggacggtaaggtacgacccgtccccgggacccccccggttaaggggacccgtaacgggtaaccggtaggttagggccgggggtaacctaacgggtccggttttacgggaccctttacgtacctaacggttacctaaaccgg

SEQ ID NO: 187751 - DNA, 666 bp, Homo sapiens
  misc_feature: GYAE6OF01ASST4.5.64.F09.1.454.CMB.1.raw
tcagatcagacacgcacgaccggtgctcgatttagcgcgtatacaaggggcatcacataacaaccagattcctcctctaaagaagcccctgggagcacagctcatcaccatggactggacctggaggttcctctttgtggtggcagccagctacaggtacgtccacgttccccaggtgaccaacgtggtgcgagtcgtggggctggtaggtgaacgacgccgtcgggtaccgtcggtagacgtcctccgtgacgaggtcgtcgtcgggggcctccgtcggctacgtttcgcctgtttagtgggtgaccgacgcccggtccccgtaggtacgaagggtcgtaggaggtggagtggggtaggtagtccgtcccgtgttcgtttggacgtacgacgacaaaccgtacgacctatagtattaacgttaccgaggggtagtagtaccgacgtagtaccgggacgaacgtaacgtcgtaccggcacgacgtccgtactcggtcgagtaccgtagaaccgacgttacgaccgtacagaaccgacgtacgtaccttacgtcgtccgacggacgacgacgccgtccccgaccccggaacggtaccgaacggtacgtacggtacggtcgggaccgtaccggttcggttaccggtcttactaaccgtactcgtaacg

SEQ ID NO: 187752 - DNA, 704 bp, Homo sapiens
  misc_feature: GYAE6OF01BB78X.5.64.F09.1.454.CMB.1.raw
  modified_base (160)..(160): a, c, t, g, unknown or other
  misc_feature (160)..(160): n is a, c, g, or t
  modified_base (569)..(569): a, c, t, g, unknown or other
  misc_feature (569)..(569): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggtttcctctttgtggtggcagcagctacaggtntccagtccaggtgcaactggtgcagtcgtggggtctggaggtggaagaccgccgtgggtccgtcggtagaacggtcctcctggacgaacgggcggtcggtgggggcctaccggttcggacgttaaggtttccgaccttaagtttaccggttgggtagaccgtaccgacggtacccccgtagggaacgtaagggtcgttaggtaggtcgggtaggtaggggacggtacgttcccggttcccgttagtttcggttacgggaacgtacgaacgaaccgtaaacgtcgacgtaacgtagttacgttacgttaccggaggggtacgtacgtacgaacggtacggtacgggacgtaacgtaacttccggaccgacctacgacgtaccctagttcggaggaccgtagagaaaccgngtaacgactacgtaggaacgtacgaccggttactttaccgagtcgacggctaagcctaccgcccccgggaaccgaggacgtaaggcgttaagggcggcgggtactggttacgtccggattaccgatcgacctagg

SEQ ID NO: 187753 - DNA, 545 bp, Homo sapiens
  misc_feature: GYAE6OF02IRCCT.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggcaccttcggcaagtttgccattacttgggtgcgacaggcccctggacaagggcttgagtggatgggagggatcgtccctgtctttggagcagcaaactacgcacatgatttccagggagagtcacgattacggcgacgaatctacggccacagcctatctggagctgaacaacgtgagacctgaagacacggccgtttactactgcgcgagagatccgaccccccggagggcccggaacggacggtactaggtcggggcgtaacggcgtttagggccttcgtacttaccgtactaacg

SEQ ID NO: 187754 - DNA, 544 bp, Homo sapiens
  misc_feature: GYAE6OF02JAVLA.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggcaccttcggcaagtttgccattacttgggtgcgacaggcccctggacaagggcttgagtggatgggagggatcgtcctgtctttggagcagcaaactacgcacatgatttccgaggggagagtcacgattacggcgacgaatctacggccacagcctatctggagctgaacacgtgagacctgaagacacggccgtttactactgcgcgagagactccgccccccgagggcccgaacggaggtacgtaggtacggggcgaacgggtcgtttcgggccttcgtacttaccgtactacg

SEQ ID NO: 187755 - DNA, 536 bp, Homo sapiens
  misc_feature: GYAE6OF02GEE51.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggcaccttcggcaagtttgccattacttgggtgcgacaggcccctggacaagggcttgagtggatgggaggatcgtccctgtctttggagcagcaaactacgcacatgatttccaggggagagtcacgattacggcggacgaatctacggccacagcctatctggagctgaacaacgtgagacctgaagacacggccgtttacactgcgcgagagatccgccccccgagggcccgaacggaggtactaggtcggggcgaacggcgtttcgggccttcgtactactactacg

SEQ ID NO: 187756 - DNA, 565 bp, Homo sapiens
  misc_feature: GYAE6OF02G1WZO.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccgttcggcaagtttgccattacttgggtgcgacaggcccctggacaagggcttgagtggagtgggaggatcgtccctgtcgtttggagcagcaaactcgcacatgatttccgaggggagagtcacgtattacgcggacgaatcgtacggccaacagcctagtctggagcgtagaacaacgtgagacctagaacgacgacggtaccgtttactacgtgcgacgagacgactccgaccccccgaggggccgaacggaggtacgtaggtcggggacgacgggtcgtttcgggccttacgtacgttaccgtactaacg

SEQ ID NO: 187757 - DNA, 567 bp, Homo sapiens
  misc_feature: GYAE6OF02JGYUR.5.64.F09.1.454.CMB.1.raw
  modified_base (367)..(367): a, c, t, g, unknown or other
  misc_feature (367)..(367): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggcaccttcggcaagtttgccattacttgggtgcgacaggcccctggacaagggcttgagtggatgggaggatcgtccctgtctttggagcagcaaactacgcacatgatttccgagggganagtcacgattacggcggacgatcgtacggcacagcctatctggagctgaacacgtgagacctagaagacacggccgttactacgtgcgcgagacgacgtcccgaccccccgaggggacccgaacggacgggtaacgtagggtcgggggaccgaaccgggtcgttttcggggcccttacgtaccgtaccgtaccgttaacg

SEQ ID NO: 187758 - DNA, 575 bp, Homo sapiens
  misc_feature: GYAE6OF02HO2AY.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgaggtgaagacgcctgggtcctcggtgaaggtctcctgcaaggcgtctgggggcaccttcggcaagtttgccattacttggtgcgacaggcccctggacaagggcttgagtggatgggaggatcgtccctgtctttggagcgagcaaactcgcacatgatttccgaggggagagtcacgtattacgggcggacgaatcgtacgccacacgcctagtctggagctgaacaacgtgacgactagaacgacgacggtaccgtttactactcgcgacgagacgacgtaccgaccccccggaggggacccgaacggtacggtacgtacgggtcggggaccgtaacggtcgtttcgggtcccgtttacgtacgttacgttactaaccg

SEQ ID NO: 187759 - DNA, 579 bp, Homo sapiens
  misc_feature: GYAE6OF02HYUF1.5.64.F09.1.454.CMB.1.raw
  modified_base (368)..(368): a, c, t, g, unknown or other
  misc_feature (368)..(368): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggcaccgtttcggcaagtttgccattacttgggtgcgacaggcccctggacaagggcttgagtggatgggaggatcgtcctgtcgtttggagcagcaaactcgcacatgatttccgagggganagtcacgtattacggcggacgaagtcgtacgccgacacgctatcgtggagtctagaacaacgtgacgactgaagacgacggaccgtttacacgtgacgcgacgacgacgtcccgaccccccggaggggcccggaacgacgggtacgtacgggtacgggggtaccgaacgggtcgttttcgggacctttcgtaacgttaccgtacgtaaccg

SEQ ID NO: 187760 - DNA, 589 bp, Homo sapiens
  misc_feature: GYAE6OF02HYJL5.5.64.F09.1.454.CMB.1.raw
  modified_base (367)..(367): a, c, t, g, unknown or other
  misc_feature (367)..(367): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctctgcaaggcgtctgggggcaccttcggcaagtttgccattactgggtgcgacaggcccctggacaagggccttgaggtggagtgggaggatcgtcctgtctttggagcagcaaactacgcacatgatttccgagggganagtcacgagttacggcggacgaatcgtacgccacgagcctagtcgtaggagcgtagaaacacgtgacgtaccgtagaagaccgaccggtaccgtttactacgtgaccgcgagacgacgtcccgaccccccgacggggtaccgaacggaacggtacgtacgggtcgggggaccgaacgggtcgttttacggggccctttacgtaccgttacctacgttaaccg

SEQ ID NO: 187761 - DNA, 557 bp, Homo sapiens
  misc_feature: GYAE6OF02HEZAR.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccttcggcaagtttgccattacttgggtgcgacaggcccctggacaagggcttgagtggatgggagggatcgtccctgtctttggagcagcaaactacgcacatgatttccgaggggagagtcacgattacggcggacgaatctacggccacagcctatctggacgctgaacaacgtgagacctgaacgacacggtccgtttactactgcgcgagacgactccgccccccggaggggcccgaacggacggtacgtagggtcggggacgaacggtcgttttcgggcctttcgtaccttacgtactacg

SEQ ID NO: 187762 - DNA, 577 bp, Homo sapiens
  misc_feature: GYAE6OF02HN9RN.5.64.F09.1.454.CMB.1.raw
  modified_base (367)..(367): a, c, t, g, unknown or other
  misc_feature (367)..(367): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggcaccttcggcaagtttgccattacttgggtgcgacaggcccctggacaagggcttgagtggatgggagggatcgtccctgtctttggagcagcaaactacgcacatgatttccagggganagtcacgattacggcggacgaatctacggccacagcctatctggagctgaacaacgtgagacctagaacgacacggccgtttactactgcgacgagagacgtcccgacccccccgaaggggcccgaaaccggacgggtactacgggtcgggggaccgtaaccgggtcgttttacggggccctttccgtaaccgttaccgtacttaaccgg

SEQ ID NO: 187763 - DNA, 561 bp, Homo sapiens
  misc_feature: GYAE6OF02IXBEX.5.64.F09.1.454.CMB.1.raw
  modified_base (365)..(365): a, c, t, g, unknown or other
  misc_feature (365)..(365): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggcaccttcggcaagtttgccattacttgggtgcgacaggcccctggacaagggcttggagtggatgggaggatcgtcctgtctttggagcagcaaactacgcacatgatttcgaggganagtcacggattacgggacgacgatcgtacggccacagcctatctggagctgaacacgtgacgacctgaagacgacggtaccgtttactactgacgcgaagagacgtcccgccccccgaggggcccgaacggacggtacgtacgggtcggggacgaacgggtcgttttcgggtcccttcgtacctacgtactaaccg

SEQ ID NO: 187764 - DNA, 543 bp, Homo sapiens
  misc_feature: GYAE6OF02JJIM7.5.64.F09.1.454.CMB.1.raw
  modified_base (464)..(464): a, c, t, g, unknown or other
  misc_feature (464)..(464): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggcaccttcggcaagtttgccattacttgggtgcgacaggcccctggacaagggcttgagtggatgggagggatcggtccctgtctttggagcagcaaactacgcacatgatttccaggggagagtcacgattacgggcgacgaatctacggccacagcctatctggagctgaacacgtgagacctgaagacacggccgtttactacgtgcgcgagagntccgccccccgaggggccgaacggaggtagtaggtcgggggcgaacggtcgtttcgggccttcgtacctactactaacg

SEQ ID NO: 187765 - DNA, 592 bp, Homo sapiens
  misc_feature: GYAE6OF02H7AIP.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccgttcggcaagtttcgccattacttgggtgcgacgaggcccctggacaagggcttggagtggagtgggaggagtcgtcccgtgtcgtttggagcgagcaaactacgcacatgtactttcgaggggtagagtcacggtagttacgggacggacgaagtcgtacggccacgacgcctagtcgtacggagtcgtacgaacgaacgtgacgacgtagaacgacgacggtaccgtttactacgtcgcgcgagagacgtcccgacccccggagggcccgaacggacggtacgtacgggtcggggtaccgacggtcgtttcggcctttacgtacgttaccgtactacg

SEQ ID NO: 187766 - DNA, 602 bp, Homo sapiens
  misc_feature: GYAE6OF02H8VA7.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtccccaggtgcaactggtgcagtctggggctgaggtgaagacgcctgggtcctcggtgaaggtctcctgcaaggcgtcgtgggggcaccgtttcggctaagtttgcctattacgttgggtgcgacaggcccctggacagggcttgagtggagtgggagggatcgtccctgtctttggagcagcaaactcgcacatgatttccgaggggagagtcacggtacgttacgggcggaacgaagtcgtacggaccacgacgcctatcgtaggagcgtacgaacacgtgacgactagaacgacacggtaccgtttactacgtcgacgacgagacgacgtcccgaccccccggacgggacccggaacggacggtacgtacgggtcggggtacgtaaccgggtccgttttacgggcccgtttaccgtacgttaccgtacgtaaccg

SEQ ID NO: 187767 - DNA, 580 bp, Homo sapiens
  misc_feature: GYAE6OF02GBBZ3.5.64.F09.1.454.CMB.1.raw
  modified_base (368)..(368): a, c, t, g, unknown or other
  misc_feature (368)..(368): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccttcggcaagtttgccattacgttgggtgcgacaggcccctggacaagggcttgagtggagtgggaggatcgtcccgtgtcttggagcagcaactacgcacatgattccgagggganagtcacgagttacggcgacgagtcgtacggccacgacgcctagtctggagctagaacacgtgagacctgaagacgaccggtaccgtttacctacgtcgcgcgaacgacgacgtacccgaccccccggaggggacccgaacggacggtaacgtacgggtacggggaccgtacgggtcgtttcgggtaccttaccgtaccgtaccgtactaccg

SEQ ID NO: 187768 - DNA, 547 bp, Homo sapiens
  misc_feature: GYAE6OF02IT9OX.5.64.F09.1.454.CMB.1.raw
  modified_base (411)..(411): a, c, t, g, unknown or other
  misc_feature (411)..(411): n is a, c, g, or t
tcagatcagacacgcacgaccggtgctcgatttagcgcgtatacaagggggcatcacataacaaccagattcctcctctaaagaagccctgggagcacagctcatcaccatggactggacctggaggttcctctttgtggtggcagcagctacaggtgtccagtcccaggtgcaactggtgcagtctgggctgaggtgaagacgcctgggtctcggtgaaggtctcctgcaaggcgtcgtggggcaccttcggcaagttgcattacttggtgcgacaggccctggacaagggcttgagtggatgggaggatcgtccctgtcctttggtagcagcaaactcgcacatgactttccgagggagagtcgaacgattacgggcggacgaatcgtacgcacagcctatcgtggagntgaacaacgtcgagactgaagacgacggacgtttacactgacgcgagagacgtccgacccccgagggcccggaacggacggtaagtggtacgggcgaacggtcgtttacggccgttcgtaccttacgtactaaccg

SEQ ID NO: 187769 - DNA, 645 bp, Homo sapiens
  misc_feature: GYAE6OF02I3CQX.5.64.F09.1.454.CMB.1.raw
  modified_base (334)..(334): a, c, t, g, unknown or other
  misc_feature (334)..(334): n is a, c, g, or t
  modified_base (369)..(369): a, c, t, g, unknown or other
  misc_feature (369)..(369): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgaggtgaagacgcctgggtcctcggtgaaggtctcctgcaaggcgtctggggcaccttcggcaagtttgccattacttgggtgcgacaggcccctggacaagggcttgagtggagtgggagggatcgtccctgtctttggngcagcaaactacgcaacatgatttccgaggggagngtcacgtattacgggcggaacgaagtacgtacggccaacgacgaccgttaatctagggacgccgtacgaaacctaacgtaggaacgaccgttagaacggaaccgaaccgggtacccgtttacgtaaccgtcggacggaccgaaggaacggacgtccccggacccccccggaacggggcccggaaacggacgggttaacgtagggtccggggggaccgaaccgggttcggttttacggggtcccgtttaccgttaccgttaccgtaccgttaaccgg

SEQ ID NO: 187770 - DNA, 542 bp, Homo sapiens
  misc_feature: GYAE6OF02GQDPF.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggcaccttcggcaagtttgccattacttgggtgcgacaggcccctggacaagggcttgagtggatgggaggatcgtccctgtctttggagcagcaaactacgcacatgatttccaggggagagtcacgtatacggcgacgaatcgtacggccacagcctatctggagctgaacaacgtgacgactgaagacgacggaccgtttactacgtgcgcgagagagtccgaccccccggagggccgaacggacggtataggtcggggcgaacggcgtttcgggccttcgtactactactacg

SEQ ID NO: 187771 - DNA, 574 bp, Homo sapiens
  misc_feature: GYAE6OF02H4VRV.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccgttcggcaagtttgccattacttgggtgcgacaggcccctggacaagggcttgagtggatgggagggatcgtccctgtctttggagcagcaaactacgcacatgatttccgaggggagagtcacgattacggcggacgaatctacggccacagcctatctggagctgaaccacgtgagacctgaaacgacgaccggaccgtttactactgcgcgagagacgtcccgcccccccggaggggacccgaaccggcggtaacgtacgggtcggggacgtaaccgggtcgttttacggggcctttccgtaccgttacgtacctaccg

SEQ ID NO: 187772 - DNA, 591 bp, Homo sapiens
  misc_feature: GYAE6OF02F2V8B.5.64.F09.1.454.CMB.1.raw
  modified_base (309)..(309): a, c, t, g, unknown or other
  misc_feature (309)..(309): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtggggcaccgttcggcaagtttgcccattacgttgggtgcgacgaggccccctggacaagggcttgngtggagtggggaggatcgtcctgtcgtttggagtcagccaaacgtacgcacatgtactttaccgaggggagtagtacgaacgtagttaccgggacggaacgaactacgtaccggccacgacgcctatcgtggacgcgtagaacacgtgacgactagaacgacgacggaccgttactacgtcgacgacgagacgacgtacccgaccccccggagggacccgacggaacggtacgtagggtacgggacgacggtcgtttcggccgttcgtacctacgtactacg

SEQ ID NO: 187773 - DNA, 556 bp, Homo sapiens
  misc_feature: GYAE6OF02FW4AV.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggcaccttcggcaagtttgccattacttgggtgcgacaggcccctggacaagggcttgagtggatgggagggatcgtccctgtctttggagcagcaaactcgcacatgatttccaggggagagtcacgattacgggcggacgaatctacggccacgagcctatcgtggagctagaacaacgtagagacctgaagacacggccgtttacacgtgcgcgagacgagtcccgccccccgagggccgaacggaacggtactacgggtcggggacgacggtcgttttcgggccgtttacgtactaccgtactaacg

SEQ ID NO: 187774 - DNA, 682 bp, Homo sapiens
  misc_feature: GYAE6OF02HJM4H.5.64.F09.1.454.CMB.1.raw
  modified_base (436)..(436): a, c, t, g, unknown or other
  misc_feature (436)..(436): n is a, c, g, or t
tcagatcagacacgcacgaccggtgctcgatttagcgcgtatacaagggggcgatcacataacaaccagattcctcctctaaagaagacccctggagcacagctcatcaccatggactggacctggaggttcctctttgtggtggtcagcagctacaggtgtccagtcccaggtgcaactggtgcagtctgggctgaggtgaagacgcctgggtcctcggtgaaggtctcctgcaaggcgtctggggggcaccgttcggcaagtttgccattacttgggtgcgtacaggcccctggacgaagggcttaggagtggagtgggaggatcggtccctgtctttggagtcagtcaaactacgacacatgatttaccgaggggtagagtcacggattacggcggacgaatcgtacggccaacgacgcctaatcgtaggganccgttagaaaccaacggttgaagtacccgtagaaacgtaaccgaaccgggtacccgttttaaccgtacttacggccggacgaacggaggaaccttcccgggacccccccccgggaacggggggtaccccggaaaccgggtaacggggtaacgttaaggggtaccgggggggaacccgtaacggggtacccggtttttcgggggaccccttttacccggtaactttacccggttaaccttaacccgg

SEQ ID NO: 187775 - DNA, 601 bp, Homo sapiens
  misc_feature: GYAE6OF02IQA48.5.64.F09.1.454.CMB.1.raw
  modified_base (397)..(397): a, c, t, g, unknown or other
  misc_feature (397)..(397): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtcgtgggctgaggtgaagacgcctgggtcctcggtgaaggtctcctgcaaggcgtcgtgggggcaccgttcggctaagtttggcctagtttacgttgggtgcgacgacggccccgtggacgaagggtcttgagtggagtgggaggatccgtcctgttcgttggagcagcaaactcgacacatgtacttcgagggagagtcacgtagtacggnggaacgaatcgtacggctacgagcctatcgtaggagctagaacacgtagacgactaggaacgacgacggtaccgtttacgtacgtgtaccgacgaagacgaccgtacccggaccccccggacggggacccgaacggacgggtaacgtacgggtcggggaccgtaacggtcgtttcgggccgttacgtaccttacgtacgtaacg

SEQ ID NO: 187776 - DNA, 621 bp, Homo sapiens
  misc_feature: GYAE6OF02HKCFD.5.64.F09.1.454.CMB.1.raw
  modified_base (287)..(287): a, c, t, g, unknown or other
  misc_feature (287)..(287): n is a, c, g, or t
  modified_base (378)..(378): a, c, t, g, unknown or other
  misc_feature (378)..(378): n is a, c, g, or t
tcagatcagacacgcacgaccggtgctcgatttagcgcgtatacaagggggcatcacataacaaccagattcctcctctaaagaagcccctggagcacagctcatcaccatggactggacctggaggttcctctttgtggtggcagcagctacaggtgtcagtcccaggtgcaactggtgcagtctggggctggaggtgaagacgcctgggtcctcggtgaaggtctccgtgcaaggcgtctggggggcaccgttcggcctaagtttgccattacttgggtgcgacnggcccctggacaaggtcttgagtggagtgggaggagtcgtcccgtgttcgtttggagtcgagcaaacgtacgacacatgtattcgaggganagtcaggtatacgggcgtacgaatctacggaccacgacgactaagtcctagggacgctagttaaaccgaacggttgaacggaccgtagaaagaccgaaccgggtacccgttacgtacgttcggacgacgagaggactcccggaccccccggacggggacccgtaacgggaacggtacgtagggtcgggggacctaagggtccggtttcggacccgttaccgtaacgtaccgtacgttaaccgg

SEQ ID NO: 187777 - DNA, 585 bp, Homo sapiens
  misc_feature: GYAE6OF02H6OPW.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaggtctcctgcaggcgtcgtgggggcaccgttcggcaagtttcgccattacgttgggtgcgacgacggcccctggacaagggcttggagtggagtgggaggatcgtcctgtctttggagcagcaactacgcactatgtactttccgaggggagagtcacgagttacggacggacgatcgtaccggccacgacgacctatcgtggagcgtagaacacgtacgacgacgtagaacgacgaccggtaccgtttacgtacgtgcgacgagagacgtcccgaccccccggagggacccgaacggacggtacgtacgggtcgggacgaccggttcgtttcggtcccgttacgtacgttacgtacttaacg

SEQ ID NO: 187778 - DNA, 564 bp, Homo sapiens
  misc_feature: GYAE6OF02GPN4U.5.64.F09.1.454.CMB.1.raw
  modified_base (364)..(364): a, c, t, g, unknown or other
  misc_feature (364)..(364): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgaggtgaagacgcctgggtcctcggtgaaggtctcctgcaaggcgtctgggggcaccttcggcaagtttgccattacttgggtgcgacaggcccctggacaagggcttgagtggatgggaggatcgtccctgtctttggagcagcaaactcgcacatgatttccgaggganagtcacggattacggcggacgaatcgtacggccacagcctagtctggagctagaacgaacgtcgagacctagaagacgacggtaccgtttacgtacgtgacgcgagacgagtcccgacccccggagggcccgaacggacggtacgtacggtcggggacgtacggtcgtttcgggccttacgtacttaccgtacgtaaccg

SEQ ID NO: 187779 - DNA, 569 bp, Homo sapiens
  misc_feature: GYAE6OF02G61ZA.5.64.F09.1.454.CMB.1.raw
  modified_base (368)..(368): a, c, t, g, unknown or other
  misc_feature (368)..(368): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggcaccttcggcaagtttgccattacttgggtgcgacaggcccctggacaagggcttgagtggagtgggaggatcgtcctgtctttggagcagcaaactacgcacatgatttccgaggggagngtcacgtattacggcggacgaagtcgtacggccacacgcctatcgtggagcgtagaacaacgtagagacctagaacgacaccggtaccgtttacgtacgtcgcgacgagacgacgtcccgacccccggacgggacccgaacggacggtacgtacggtggggacgaacggtcgtttcggccgttacgtacgttactactacg

SEQ ID NO: 187780 - DNA, 592 bp, Homo sapiens
  misc_feature: GYAE6OF02JDIZ6.5.64.F09.1.454.CMB.1.raw
  modified_base (373)..(373): a, c, t, g, unknown or other
  misc_feature (373)..(373): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccttcggcaagtttgcctattacttgggtgcgacaggcccctggacaagggcttgagtggagtgggaggatccgtccctgtctttggagcagacaaacgtacgcacatgatttccgagggganaggtcacgagttacggcgacgatctacggcacacgcctatctggagcgtagaacgacgtcgagaccgtagaagacacggtaccgtttacgtacgtcgtcgcgagacgacgtcccgaccccccggacggggacccgaacggtacggtaacggtacgggtacggggaccgaacggtccgttttcgggcccgtttacgtaccgttaccgttacgtaacccgg

SEQ ID NO: 187781 - DNA, 595 bp, Homo sapiens
  misc_feature: GYAE6OF02HJCZM.5.64.F09.1.454.CMB.1.raw
  modified_base (337)..(337): a, c, t, g, unknown or other
  misc_feature (337)..(337): n is a, c, g, or t
  modified_base (426)..(426): a, c, t, g, unknown or other
  misc_feature (426)..(426): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccgttcggcaagtttgccattacgttgggtgcgacaggcccctggacaagggcttgagtggatgggaggatcgtccctgtcttggancagcaaactcgcacatgtacttccgagggagagtcacgagttacggcggaacgaagtccgtacggaccacgacgtcctatcgtgggacncgtacgaaactaacggtgacgactagaacgacgaccgtaccgttacgtactacgtcgcgacgacgacgtaccgacccccggaccgggaccggaccggaacggtacgtacgggtacgggaccggtacggtccggttacgggtccgttaccgttacctaccgtactaaccg

SEQ ID NO: 187782 - DNA, 843 bp, Homo sapiens
  misc_feature: GYAE6OF02G4ZPT.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggctacccgttcggactaaggtttcgaccctaagtttacgttggggtcgccggaaccgacgggccccccgtgggaaccgaaggggtccttggaggtgggagtggggagggtacgtccggtcccgttggttccgtttagggagtaccgacgtacgaaaaccgtaccggactaacctagttacgtaacgtttacccggaagggggtagtacggtacgaacggtacgtttaaccgggacgggtaaccgtaacgtacccggtaaccgggaccctaacgacggtacccgttaagtaccgtagggacgtacgtaacggaaaccgtaaccggttacgaacgtaaccgtaacggaacggaacccggtaaccggtaacccggttttaaccgtaccgttaccggtaccggaccggtaaacgggtaaccgaaccggtaccccccgggtaaccccccccgggaacggggtacccccgggtaaaccgggtaacgggttaaccggttaaccggggtaccggggggaacccggttaaaccgggtttacccgggtttttaccggggtacccctttaccggtttaacccgttacccggttaacccgttaaccgg

SEQ ID NO: 187783 - DNA, 588 bp, Homo sapiens
  misc_feature: GYAE6OF02G887Z.5.64.F09.1.454.CMB.1.raw
  modified_base (377)..(377): a, c, t, g, unknown or other
  misc_feature (377)..(377): n is a, c, g, or t
  modified_base (495)..(495): a, c, t, g, unknown or other
  misc_feature (495)..(495): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgaggtgaagacgcctgggtcctcggtgaaggtctcctgcaaggcgtcgtggggcaccgttcggcaagtttgcctattacttggggtgcgacacggcccctggacaagggcttggagtggagtggggagggatcggtccctggttctttggagcagcaaactacgcacatgatttccgagggganacgtacacgtagttacgggcgacgaagtccgtacggccacacgcctatcgtggagctaggaacaacgtcgagaccgtagaacgacgaacggtacccgtttacacgtgcggcgagagcncccggacccccggacggggacccgaacggacggtagtacgggtcggggaccgtaacgggtcgtttcgggtccttaccgtaccgtactactacg

SEQ ID NO: 187784 - DNA, 675 bp, Homo sapiens
  misc_feature: GYAE6OF02IDX09.5.64.F09.1.454.CMB.1.raw
  modified_base (344)..(344): a, c, t, g, unknown or other
  misc_feature (344)..(344): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcactggtgcagtcgtggggctggaggtgaagacgccgtgggtcctcggtgaggtctcgtgcaggcgtgtggggcaccgttcggctagttcgcctagttagtgggtgccgtacgacggcccgtggacgaggtcttgagtggagtgggaggctccgtccgtgtcgttggacgngacgactaacgtcgcactagtagtacttacggaggggatacgtacgaacgtacgttacgggacggtaacgtaagttaccgtacccgggacctaacgacgtaccgtagtccgtagggacgtaccgttaacggaaacgtaccggtagtaccgtaacgtagaaacggtaccgaccgggttaccttaccgtacgtgacccgtacggacgtacgtaccgtacccccgggaccccccggacggggacccgtaacggtacggtacggtacggggtccgggtacccggacggtttccggttaccgggttcccttacgttaccgtaccttacgtaaccgg

SEQ ID NO: 187785 - DNA, 577 bp, Homo sapiens
  misc_feature: GYAE6OF02ILX86.5.64.F09.1.454.CMB.1.raw
  modified_base (370)..(370): a, c, t, g, unknown or other
  misc_feature (370)..(370): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggccaccttcggcaagtttgcctattactgggtgcgacaggcccctggacaaggggcttggagtggagtgggaggatcgtccctgtctttggagcagcaactcgacacatgtatttccgaagggngagtcacgtagttacggacggacgaagtcgtacggccacgacgtctatcgacggagctagaaccgaacgtgaacgactagaagacgacggtaccgtttacgacgtcgcgacgagacgaccgtccgacccccggacgggaccgaacggaggtacgaggtcggggacacgggtcgtttccgggtcctttaccgtaacgtactacgtacg

SEQ ID NO: 187786 - DNA, 563 bp, Homo sapiens
  misc_feature: GYAE6OF02GD3ZY.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggcaccttcggcaagtttgccattacttggtgcgacaggcccctggacaaggcttgagtggatgggaggatcgtcctgtctttggagcagcaaactacgcacatgatttccgagggagagtcacgagttacggcgacgaatctacggccacagcctatctggacgctagaacaacgtagagaccgtagaacgacacggtaccgttactactgcgcgagacgactcccggaccccccgacggggcccgaacggacggtagtacgggtcggggaccgaacgggtcgtttcgggcctttaccgtacttaccgtactaaccg

SEQ ID NO: 187787 - DNA, 630 bp, Homo sapiens
  misc_feature: GYAE6OF02IOALU.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccgttcggcaagtttcgcctattactgggtgcgacaggccctggacgaagggcttgagtggatgggaggatcgtcctgtctttggagtcagcaaactacgtcacatgatttcgaggggagagtcagagttacggcggacgaatcgtacggcctacgacgcctaatcgtacggagcgtaggaaactaacgtagacgaccgtaggaaacggaacgaaccgggtacccgtttaacgtaccgtacggtacgcgaacggtacgaacgtcccggacccccccggaggggacccggaaaccggtagggtaacgtagggtaccgggggacgtaaccggggtcgttttacggggccctttaccggtaaccttaccgtaccgttaaccgg

SEQ ID NO: 187788 - DNA, 723 bp, Homo sapiens
  misc_feature: GYAE6OF02FSJVC.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctgggctgaggtgaagacgcctgggtcctcggtgaaggtctcctgcaaggcgtcgtggggcaccgttcggcaagtttgcctagttacgttgggtgcgacgacggcccctggacaagggcttggagtggagtgggaggatcgtccctgtcgtttggagcagacaactacgcacatgattcgagggtagacgtacacgtattacgggcgaacgtaacgtacgtaaccggaccaacgtacgtaccgtacgtacgtacgggtacgtacgtacggtaaaccgtaacggttacgacggtaaccgttaggaaacgtacggtaacccggtaccgttttaaccgttaccgttacggtaccgtacggtaacgtaacggtaaccgtaccccgggtaaccccccccgggtaacgggggtaccccggtaaaccgggtaacgggttaacggttaaccggggttaccgggggtaacccgttaacccgggtttaccggtttttacggggtacccgtttaccggtaaccgttacccgttacccggttaacccgg

SEQ ID NO: 187789 - DNA, 585 bp, Homo sapiens
  misc_feature: GYAE6OF02IAG3H.5.64.F09.1.454.CMB.1.raw
  modified_base (373)..(373): a, c, t, g, unknown or other
  misc_feature (373)..(373): n is a, c, g, or t
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtctgggggcaccttcggcaagttttgccattacttgggtgcgacaggcccccggacaagggcttgagtggatgggaggatcggtccctgtctttgggagtcagcaaacgtacgcacatgatttccgaggggagngtcacgattacggcgacgaatctacggccacagcctatctggagctagaacaacgtgacgacctgaagacgacggtaccgtttacgtacgtgcgtcgagacgacgtccgacccccccggaagggacccgaaccggacggtaacgtacgggtacgggggaccgaacgggtccgtttcgggtccctttacgtaccgttactaccgtactaacgg

SEQ ID NO: 187790 - DNA, 673 bp, Homo sapiens
  misc_feature: GYAE6OF02JHQK7.5.64.F09.1.454.CMB.1.raw
tcagatcagacacgcacgaccggtgctcgatttagcgcgtatacaagggggcatcacataacaaccagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaacggtctcctgcaaggcgtcgtgggggcaccttcggcaagtttgcctattacttgggtgcgacaggcccctggacaagggcttgagtggagtgggaggatcggtccctgtctttggagtcagacaaactcgcacgatgatttccgaggggacgagtacgacgtagttacgggcggaacgaatcgtacggccacgagtacctagtcgtaggtacgcttagaacgaacgtagacgaccgtagaacgtaccgaaccggtacccgtttaactacgtcggaccgacggaacggtacgtaaccgtaccccgggaccccccccggaagggggtaccccggaaacgggtaaccgggttaacggttacggggtaccgggggaaccggttaaccgggttaccggttttaccggggtccccgtttaaccgttaacccggttaccgttaaccgttaaacccgg
